United States Patent 7,868,149 (PLANT GENOME SEQUENCE AND USES THEREOF) - sequence listing, part 51

SEQ ID NO: 27393 - DNA, 755 bp, Oryza sativa
  unsure (1)..(755): unsure at all n locations
gtgagaaatctggattatttttgagcaatcaataacagcaaggagcgagcgagcaatgactagacagggtataacgaagaatttatagtcttgtttgcccgttgcctgtacagagttttttcgtttgggaaatgaaattcatccccggcccaccggtgaaaattcaaaaagaaaaatcaagaataatttatagaagcacgcaaatttcatcagaaaacaaacttatccatccctcgatttaacatatactaatattgttctttatttcagcacagatctgaaacaagctagccaggcacacgattctagcacaaatcaaagagcatgtcagttatggcaagcgacacacagtttgtgatcacagcggcaggcaaagagaaaagcttccaagatctagaagagaagctagggctaacgcaaattcgagaaaggaacgtaataagtagagagagatgagaaagaagggatggatgatcatgagactcaccagccaaccagcgagagagacgccgcggacgccggcggcgatggatggagatcgacgcaggcgaggcgtccgggagtcgagggctcgaggcctcaccgaccaaaccaagtatgggctttcacttctcacatggttcacttcgccggcccaagagtgagtgaaccggtgttttggaataggaataagtttactttaggtccctcctcttgacatnnnnnnnnnnnnnnnnnnnnnnnnnnnnnnnnnnnnnnnnnnnnnnnnnnnnnnn

SEQ ID NO: 27394 - DNA, 602 bp, Oryza sativa
  unsure (1)..(602): unsure at all n locations
nnnnnnnnnnnnnnnnnnnnnnnnnnnnnnnnnnnnnnnnnnnnnnnnnnnnnnnnncacttttatccatttacaaaagctgttgctgctacggttatcccatccgggcaaatgtgtgcacacgcgttgggagaataggccttcggatccacgctgttgctgcgacgttcgcacaatcgggcgagcgatcaggtttttggggagcgcaaggcgcgactacttactgatcgccaacatttacttcatcttgaccaacatgtcgaacactggagacaaggagaaggagactcccgtgaacaccaacgtacgcaatactgcctcaaactccaggggaggaccattcttggggtataaccctattacattatttcaattagaagctttactgttaatgttcatcgcaatgtcaacattgggtcattatgtgattgttgacgcttattcaacgttaagcatgctcatgttgattacattcaccactatgactggatcaaatgctatcgaaaatatcatgattattatcttggtattttggattaaaatatgccgaattatgaccaagatttcaacattaataccatgatcaacggcgtatacattgt

SEQ ID NO: 27395 - DNA, 985 bp, Oryza sativa
  unsure (1)..(985): unsure at all n locations
nnnnnnnnnnnnnnnnnnnnnnnnnnnnnnnnnnnnnnnnnnnnnnnnnnnnnnnnnnnnnnnnnnttgtagtacaagacatatagttgagttaattatttgagctttcagtttaaccagatatataataagaggccaacatttagcacttatactgaatttagttgagagactaagcttgaattaagcaagtcgattcttcattctcttcatagacgattctgcattcacctcatagactaagcactggtgctccgtgtgccgatcacgagatcgagacgacatggaactaaactaaacacaattccattcttccatttccatgggaagtcataaaaatcgtggccattctacttcgatagcattcgccgcagcatttcgaggaagtgatgtacagtatattgctgccaccttcatggaatccttcccggtgccgctcattccgatagagagcaactgatgaacatgttcgatgtatcatccaatttttttgctaggcctttttaagcgcttatatattatcctacaatgcaccactaccatcgatctgctggactgtgcttgtgcttggtctcaaggaaaaggacaagtgagagagtacttagtatgatatggagaaaaaaaaagaaggggagatatgtcatggaagaagagaagagattatgagaaatatacatatactgaagagcaaaaggtggatatatatgtacatgtggcatgctaacaagttaatatgcaaaaactagctaggatgacttgacatggatcatacggcatggggaaggttttttttttctctcaggggatgtttttacatgtcacctagaaagctataatcttttcttataaatcacaaatatgactcaaaacagtacacactattaatagtcatattaatagaggtgagtgcacgtgctcataaaaataaggtgtgcctttgtgtattcatagagatgagtgtgtgcgcctatgttcctactgtgtt

SEQ ID NO: 27396 - DNA, 479 bp, Oryza sativa
  unsure (1)..(479): unsure at all n locations
caaagtttgtgtcatcattttcaagcctagttgaaagaatgtaaaggatttttttctcctaatgcaactttagtctattatttgtttctgcttgatgagtgcatatctatgaaattagagtatttttacggtccaacagcctgggtaggtaccaaatctacaccattcattttacttgatcggatggctgagacagattcagtaccgggcagtaccaccgatcgattccatgcagtaccaccgcctgaagggcattttcgtaatttcgcgtagcctcagttcagatcagatcggctcagccagccgcctgcccgttctccatcccaggttctgagcttttttgcagcggcatcagcggcgtcagcccacaggatttgggcagacgacgagctacaggatttgggtcgnnnnnnnnnnnnnnnnnnnnnnnnnnnnnnnnnnnnnnnnnnnnnnnnnnnnnnnnnnnnnnnnnnnnnnnn

SEQ ID NO: 27397 - DNA, 713 bp, Oryza sativa
  unsure (1)..(713): unsure at all n locations
nnnnnnnnnnnnnnnnnnnnnnnnnnnnnnnnnnnnnntttacatctgcttgctgctgagcttgtgttgcctcttcttctctctgcttcagttcttctatgagtagctccgtgaaactcttctctgtttcttcaccagacgcacggctcttaacatccttgaattgtttggaacagtctgcaaatatcaaaagtaaccacaatcagtgaaactgcagcctctaaacaactgcaaaacatgtctataaaagataaatttcaaaaggtgattgtcatgtttattgcaagcttagatcaaatgaggtaacaatgttcattgtcaagataatgattcagggaagaattagagttgctacgatagaggctaaggtcactgaaacaattctcatgaggctgtgtttggcacagcaagttcccatctcctcccctcgttttccgcgcgcacgcttttcaaactgctaaacggtgcgttttttgcaaaaaaaaagtttctatacgaaagttgcttaaaaaatcatattgacccatttttgaaaaaaaaagctaatacttaattaataacgtgctaatggaccgctccgttttccgtgtgtagaagattggttcctatctagcccaagcgaactcagcctgttaagcctccaattctttttggactttgttatttcatactactactaggtattatgaatgagcagctaaagagtttcaaac

SEQ ID NO: 27398 - DNA, 610 bp, Oryza sativa
  unsure (1)..(610): unsure at all n locations
nnnnnnnnnnnnnnnnnnnnnnnnnnnnnnnnnnnnnnnnnnnnnnnnnnnnnnnnnnnntggtaatccagaatcgacttaacatctgcccagaatacatttgtcaactggtcatcttcatccacttggatggcataaaagaaagaaggatgttcacctttcttcctctgcaaatattcataaattgcctgggtatcacctaattgcatatcttttgtgtgccttgtccttacataatttttataatcatttggtatcaaaacaactcttggtggatctggaggctgctgtaactttgctaataacttatgtgatctcagaacctggatgtccaccaaaggagtttcaagatcatgattatgatcagccacatactcagtcactacatatttgccactcacagtgattttaatagtcatgtgtgccagacaaccagttcttgtttctggccgtggcttcttgggatcagtactgacacttttagagcggaatccctctttagaacagacatatgcccgagattttgtagtatttgttgctgttttttccaaccatccttttcggacgctgaaccccacagttccagcataggtgacatagcagtcatagg

SEQ ID NO: 27399 - DNA, 733 bp, Oryza sativa
  unsure (1)..(733): unsure at all n locations
ttttatgcaaaatacccaccactgccatcgaacccaattgatcgagcacatcgccttcctctgatcctctctccctagtgtgcgcgaatccggtgcctcccccggccgtgtgtgcatccgcttcctctctccctatcgtgcgcaaatccttcccaagtccccaccctgcgctgcgcaaatccttcccccgagcccccaccctgagcccgactccttccccaaggcgcgtcgttgtcgccgtctcatccgttggagtatataaagtgaattgatcgtctttccctatcagtttaggcttttaggtgcaactggctggtgcatgtagcttaatatggtatcagagccagaggtctcgagttcgaatcttggctggcgcgcaattaaataaaataattgcagcccactctaatattccacgcttgagacttgagaggggtctcgcgtgagggggagtgttggagtatatatcccattccgcaatagctaagggcattaaagacattagccatttaaactcaataatatatgtctccgataattcaaagaaacaaacaactcataacttattataattctgtttatactaatctggtttaataatttggattacaataatcttaattaaaacaaatatgacctcagaatgttaagctccacatactagtannnnnnnnnnnnnnnnnnnnnnnnnnnnnnnnnnnnnnnnnnnnnnnnnnnnnnnnnnnnnnnnnnn

SEQ ID NO: 27400 - DNA, 687 bp, Oryza sativa
  unsure (1)..(687): unsure at all n locations
nnnnnnnnnnnnnnnnnnnnnnnnnnnnnnnnnnnnnnnnnnnnnnnnnnnnnnntattattattattattattattattattattattattatcttcttgataagtgtggagattatggataccccatatctacatgacggttgtaatttagtcggatatacagtaccaaatatagatggaatatctctatgaagactcgggttaggttctaaacttgtatgtcaaggaaatacccgggatcttagtcggttacgattgtattttatctataattccatattccgttaggatatggactgtattttgtaaagcggactccttcccctatataaggagggtccgtgtgcctcttggggggcgattcttttttccagtttatacaatcaataacatactcggcggaatcatccccggacaggagtagtgtattactttttgaacgagaaggcctgaacctgtataaaattccttgtctccaaacccatccactttcctagcttgatagccacccccttttattattgccgaaatcttgtttcgacagttggcgcgccaggtaagggtagcgtcaagtttttgccgactaagtgcgatggggttctggttctggcatcgacgacttcgcctttccttcccgggcaggcgttccggttcggcagccttaactttatcaccaaacgacttc

SEQ ID NO: 27401 - DNA, 688 bp, Oryza sativa
  unsure (1)..(688): unsure at all n locations
nnnnnnnnnnnnnnnnnnnnnnnnnnnnnnnnnnnnnnnnnnnnnnnnnnnnnnnnnnnnntagcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaagaattggtaacttatatcaattagtcctaattgatggatggttgatggttgtgtagtggaggatggttcatggctagttgatgacaattagttgctctattcctcttcctattccattggtaacttacatcaattactcttaattgattggtggttgatggttgtgtagtggaggatggttcatggctagttgatgacaattagttgctccattcctcttcctatttcatgactcttactcttcatctttcaatcctcttataaaaagggaatgg

SEQ ID NO: 27402 - DNA, 717 bp, Oryza sativa
ataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcag

SEQ ID NO: 27403 - DNA, 1211 bp, Oryza sativa
  unsure (1)..(1211): unsure at all n locations
gtaaaattgctcataattaatagtactcggtgattgcagaacaaatagtaaaccgtaagaatatataattcatgatcaaaataaattaaagcatagtagaccaaaaacgaattatatgctcatcgcagacaaaataaattcatgatcaaaatcatttatttaaatcatttatttgttgtctgcgagtaaatcatttatagttaatttgttgattgcagaacgaaaattgtattatcgttaccttgtccttgggcagcatgagaggatgaaaaagcagtagccatgaccactagagctgccaagaacacggcagccttgcaactagtcttgccaagaagagccatattcagatttaaagggaattagctttttaatgagtggtggtagctaagctattcttaagttcctatggttggtgatccctctctaggtgtttatatagagaaatggnatgatccattcctaatatcatttagaatgcaattaactgttatatatcatagtatatctctccacgacattaatattgtcctttttttctctcaacgtctcaaattggtagcatgcatatcctatatatcttttgggttaatttggtagcatttgatccactcttaatctcttttgttaccattaactttattatattctacaattgtcctcctcttatcgcatcctaagctttgggctgcgatgagcaggtccggtatgaaccgtccatatccgaacatgtcaccaagatgaaagatgtacggtcatattcgttttggatgaatttcaaacgatttggtttcctaagaattaatttctataaaagccattcaattcattaaatgtagatacagaaaaataaaacaaattccttttctacaatgtgtagagagaaaacataggaaattttccattcactcaaacctcttgaaatatgcatacattcatattctttcaccatttctattcgtaatttctgtgttaaaatttcttcaaaacgaataggccctacatgatttatgagaggaggaagctgaattccaaaccttagagattagagaacgtagtagaggaggaggaggaggaggagaagaagaagttgcaccggaaacagttgttggaattttcttttctttcttttttttatgtttttgagaaggcagttnnnnnnnnnnnnnnnnnnnnnnnnnnnnnnnnnnnnnnnnnnnnnnnnnnnnnnn

SEQ ID NO: 27404 - DNA, 845 bp, Oryza sativa
  unsure (1)..(845): unsure at all n locations
cgattataattgaacctacgtgttttcttgtgttcttgctccaacaattatctatgaagatatcttctctgatgcaatcttgtaatggttgtaaatggagctctagctagctctcttgagatattggcctttctttgcaaggagcaaagctagctatatatatatgagtgtgaaggagtccatggagcaattaaaagggtattcttctatggctttataaatgcatgagagcttggtccaagtcatgcactgatcgatcgatggggtttgaatcctcttgctgtcttgacgaatcttcagagcaacatcatgccttttaatttgtacaaagctaagctatagtttgttactatacgctatccttttatgccttttaatttgtctgcgagaaaaagcagctcaaagttgtacttgcatctagctaattaagctacatgtcacctcaacagtggccatccgctggtgcctgactacctggtgatcatgccacgtccatgtcgttgggtgtaagggtgccaagaaatcaaagagccgatcgatgatatctcttcttttgactgagatactgttcaggggaaaggagttttttccccctaaaaagacaagggatttgctagttttcaggcggctaaaaaattataattttagtcgtattttaaccgcaattttgttgttggttttattttaattttacataatttgaattttttgcatgtaactttgtacacttttatgggttaatgtttttcatgtagttttgtaaatttttgtatgttagaacggnnnnnnnnnnnnnnnnnnnnnnnnnnnnnnnnnnnnnnnnnnnnnnnnnnnnnnnnnnnnnn

SEQ ID NO: 27405 - DNA, 1206 bp, Oryza sativa
  unsure (1)..(1206): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacctctgctgcaccccgcagattaccagcttccatccatggctggtctcccctatttatacaccaactccttcccctgccagcttcgtctcccaaggcaagagcaacgcaaagcaaagaacagatacttcttctctccacctgcctcgcaagcttcttctgtttcttggatctcacctcgccacgccattgacgccataaggagcttgtgagaggtggtagccaagaaggaggaggaggagatggggttcgtgctggtgatctcgctgcccttcatcttcttctccatcctgctcggcttcggctgctacttcctcggcaagcacaagggccgcgaggagatgcgcaccggcgtcggcgcccaggtctacggcacgccgctgccgccgcccggcgtcggagcgccgccgccggagccgttcacggcgaagaaggacggccccgagaatctcgtctgatcagcctcggctgctgctgctgctgaatcggctcatttctttttcttgctatactgtactgttcgtgccgcggtggtgtacatgaagtggttaatttggttgttcttcatgttgagttcagtgtgataatttgtaatcacaatctatgtgtttctttttttcttttggtaaaatgggttcgaatccaaaatttgtaatcacaaattcgcaattagcgcccagacaagtgatttgattgattggctattggattgatccatttgaataggttctcttacttgttgctgatcgtggagacgaactcgaaaacgagttgtactctggttgcttccgcatatatgcgagaattcaacaaggtcaatttctccatccattgatctggcacaagagagagagagagagagagagagagagagagagagagagagagagatttccacctcaccctcgagcattttcagacaataattttgatttga

SEQ ID NO: 27406 - DNA, 3887 bp, Oryza sativa
  unsure (1)..(3887): unsure at all n locations
nnnnnnnnnnnnnnnnnnnnnnnnnnnnnnnnnnnnnnnnnnnnnnnnnnnnnnnnnnnnnnnataatttgtaatcacaatctatgtgtttctttttttcttttggtaaaatgggttcgaatccaaaatttgtaatcacaaattcgcaattagcgcccagacaagtgatttgattgattggctattggattgatccatttgaataggttctcttacttgttgctgatcgtggagacgaactcgaaaacgagttgtactctggttgcttccgcatatatgcgagaattcaacaaggtcaatttctccatccattgatctgccacaagagagagagagagagagagagagagagagagagagagagagagagatttccacctcaccctcgagcattttcagacaataattttgatttgatggatccgcttcagccttgcctcgtcttgcagcaagataaaaaccgagaattttcagcatctccgatgagaaggaaatcgaaggtggccgcgacattgccgccctgacgagcagcaaatcgtgggtgacgccgcaggggcggattcttgttcgcgacaccgccgccgcaaccacgttcctgcagcagaatcctcatggctcagtgctacttcgcggcgtcgtgctcggcggatgagagccggtttgtgtatagcaaatgtcaatgtttgtagtgtcattattgcaaatctccctgttcttcccaggccatgatggcgacgcgttcgtctaagatttccaacgtgagagatggcaatggtggagttcttgtagcttccagcggcccacagagtaattgtggatcctgcctactgattgagtagttgtttaggatttgtagtcacagcaaaaatgttcaggttttagcaaatcaacattgggggttgatacatttgacatttttttttgggtcaaatttgataaaaatatcttcctttgttaccagtatcttgttttcggactgtttcgatgtgtcattttgcatcaaacagtctattgtagcccaattatctacagtgcacaaatagcatctgaagaaattttgttagaaagaaaaagtatgcttcaggttgtcattaaagacagattttcatactaaggacctgtttgatacaactccaactcctaaatttagctctaggagttgggcctgtttggcacaactccagctccagctccacccctcctggagctggagctcagccaaacagtttcagctccaccaaaactgggagtggagctgggtggagctctctcacaaaatgaactagagttgtggagctgggtttaggcagctccacaactccactccagacctaacttagggcctgtttggtacagctccagctccagctccacccctcctggagctggagctcagccaaacagtttcagctccaccaaaactgggagtggagctggatgaagctctctcacaaaatgaactagagttgtggagctagatttagacagcaccataactccactccagactgtcctgtcacgccccgaactagtaccgactggaactagcccgtgacgctccaaattaacctgttaatcgataccagtcccaggaaacagtgctggtatcacaggaagacagattatcacagcaacagaggtctctttattatagagtagaggtacagtcatgttgggctgcggacagatcccgagctcacaactgcattacaaaaggggaatggaagccaggacttggatcaaacaatacaggcgtgacttgggaactaggccgaaaccctaaaactcatcgtagccggcttgctcctggaagaactcctcatcagcaggattcgcttcatcttcttcagcaactgggggagattatttatatagagcaagggtgagtacgggagtactcagcaagccatgggaaataagtgtttaatgcaggctttaaaggaagggctgttgtttttgcaattgattttatttgaactcctttctgaaaacaactaggtgagtgcttctcaaacgacacggatgagacagtgcgtctcgtccggtcggagtatgtgcaatgtatcaatctttagaaatgacacaagattggcacctggccaacagcttttcaaccggccacccgggccaacaactttcaaacggccacccgggcctagctgatcccatcagctgcagaatctttcaaacatcgaacccctttccacaacagcaatttcacaagcggtagtcaaagaaaactacactaggaatcacctcacatccgcccatgaccgtgggcatggctgttcgaacagtttgttaacctctgcagagggggtacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccagcccggcgaatccacatgtctctcggcatcaaggctcccctggtaagctagttactccgccaggggtgtcccattccacccatgtggtcgtacttgtcttatgtttggatgaaattccaaggaaatggtccttaagtgcgagagcgggaaaccgtacacccggtacgttccccggtccgcggttttggaaattcatttagttcgcaagcaccgacccaggtgtcgggttttccaagtcttttgtaaacccaagttttacccaagaagtttttcagattttaagtttgaaggcgtccgtcgatactcgcgcaggatgcacggatatcgagacgcaactagatggttacaaggggacatgatataacaattaacaaagggaggatcaaatgcagcaaattatgtaagtccgccaatctgccttgcagacgggacaacagattaagtgcgatcctatcagtgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaagaaaatagggagggattatagacttttcctcgggcggctagggcgcggcccaagggaaaaggagcggaccggacgagctaatgggccggccggcccaaggcggcccaagtgcgcgcgcgcgggaggggaggagagagagggccggtagaccaggctcaccgtgcgcggtcccgagtgggacccgcttgtcagcggctcggctcaccgtgcggagggagcacgcggcgcacgcgcgcgggcgggggagggacgcggtgcacacgcgcggtctgcggaggaacggatgcagcgggcccacgcgcagcctcacggcttgcggtggaacgcgcgctcgggaggggctgaccggggtcggcccgtcctgacctcggctgagctggcgccgacgtggcgcctacgtggctgccacgcgggccggcgggaggtagacgaccacgccggccggaacggacggcggacaacagcggcgagcggcggagcgaaccacggcgataccggcgaaagcgagcacaccgggtggttgcacgagataaggggagacgagcc

SEQ ID NO: 27407 - DNA, 36259 bp, Oryza sativa
  unsure (1)..(36259): unsure at all n locations
nnnnnnnnnnnnnnnnnnnnnnnnnnnnnnnnnnnnnnnnnnnnnnnnnnnnnnnnnnnaaatgagggctcgagtcggggcgggcggctcacgcgctcacgcgcgggcagagcgaagggagcggagaaggggcgctcggctcggcgcgggcggctcacgcgcacgcgcgggcagagcgaggttaaagggagggggcgctcggcgcggcggctcacgcgcacgcgcgcgcggcgcgcgggcggggcggagcggagcggagggagagggggaaagggagcgcgccgggggaggggagggggcgagagagagagagagagggggagaaggagcgcgccgggggaggggagggagagatgggccgagcgagattcggcccatcgaccccggaggaggcaaaatagacttttgcggaggaatttgatttggaaggatttggattcggatttgaacttgacgatagatcggggattgagatcttgagatggcacggacactagacaacaagcaaagaaacaaatctcgtaattagggtttttaagagataattttcccgctaggcgccacgacggaacgggcgccacatgtctcaaccaaattttgtggaggatggaactgtcttccactgttcccagtccaaactccaaaccgaagtataatacgtttggtaaatttgtctcaagtttcagaacatggacaggtgattttatacttttgctaaaaaaaaaaagattcagtcacactgtttggatttggattgagtacatcaaacatgtctcctttacatgcccggctgatgaattattcttttaaactcaaaataccaaaaggggacaattaaaattgtttcttccgagttctactcaagttcggttttcctttttcagagtatcgcgtttgcacgcagttatcgtaaaccaaatcagataagccacaagattttttcttgtttctcgcaagatcaatctagccagaaattacaagaaaccaaagcgacgtcgtcgccgtcaaaatttcttctttgtgttgggcggcgaaaacgatggacacgtcgagcagcggcgttcgtctaccctgcctcgccctggagcacgccggcggcggctccgacaagccggtgctgttcagcatctcggagaggaaggtcatcgacggcggcggccacatccctgggctgacgaatgccaacgcctgggcgacgccgcagggctggatcctagtgcgcgacgccgccgccgccacgttcctgcagaaccctcgcgactcctacgacacgattcctctcccgcatctgccccaagacgacttgccgccgaggaggtgcacctgcctcctctccggcaagccggccggcggcgacggcggctgcgtcgtcctcctcgtccaccctttctccaccgtgttctggcactgccgcgtcggcggcgacggcgacggcgagtgggcgaagcacgagtacgacatcggcacgcagagcgtcgacgacgcgagcctgcgcgtcgagaaggtgccgatctgcccggtcgccgccgctcgccacggcgcgttctacttcaacgccgacgcggccggcaacctcggcgtgctcgacctcgcctccgcggcgccggcgttcgcctccctcgacatcgacgccggggagctgggcgacgtcgaccacgcgcacttcttcctggtggagtcccagggggagctgtacatggtcagcctggtgtacgagctcggcggcgccgggatgacggactgcgagacgcgggtgcacaggctctccgagcacgagcagccgcccccgcggcggtggcgcagggcgcgcgacctcggcggcgggcgcgcgttcgtgatggctccgtggtatttcgcggcgtcgtgcgacgccggcgagtgcgggctggaggcggactgcgtgtacatgttctacccgggggaggacgcgtgcgtgaagatatcgagcgtgagagagcgcggcggggaggagttcgtcggacttccaccggcgaacagagcgtcgtggattctgcacgttgatccatagtttcagcttggaattattaggtggtgtttggataattttagtcactgtcgtatcagatgattgacactaattacaagtattaaacgtaaactaatgataaaactaattgcataaatgagagctaattcgcgagataaattttttaagcctaattaatccctaattagcatatgtttatataggctaatcatagaatgagttttgtcgcctacgtttaatatttctaattagtgttcaaacatccgatgtgacaataactaaaatcaaccaaacagtcgcttatacttcatttatgtttggatttggccagtttatttttcttctcctttttgatattgtagcatactagcaaacgtgcttgtgggatgcaacgggaacaagttcatggttgcaatcaattactttcttccggttgcacctgttctcgaattagttagtaggtgatgatggcaacatgatgaagagtctatttgggaaagcttgtatcagaatccgaagctccccaaacaatctaatttttagtttaaattctgataagttatagttgtagaattcaaaaaataaactaaaagccagactaaaaaatccaaccttttcatattttgacaactctatattttcagattgtagcaactctacttttccaggccttgtttgtttcaacttagaattattataatatggattattagcaataatttgaaacaaatatgtagattattatgatacattattataatctataagctagattagtataatatgataatcttctctaaatgtgccttttcagattattaggtggctaaagaccattaccttacccttaaaagttttatgcaaattacccaccactgccatcgaacccaattgatcgagcacatccgcttcctctgatcctctctccctagtgtgcgcgaatccggtgcctcccccggccgtgtgtgcatccgcttcctctctccctatcgtgcgcaaatccttcccaagtccccaccctgcgctgcgcaaatccttcccccgagcccccaccctgagcccgactccttccccaaggcgcgtcgttgtcgccgtctcatccgttggagtatataaagtgaattgatcgtctttccctatcagtttaggcttttaggtgcaactggctggtgcatgtagcttaatatggtatcagagccagaggtctcgagttcgaatcttggctggcgcgcaattaaataaaataattgcagcccactctaatattccacgcttgagacttgagaggggtctcgcgtgagggggagtgttggagtatatatcccattccgcaatagctaagggcattaaagacattagccatttaaactcaataatatatgtctccgataattcaaagaaacaaacaactcataacttattataattctgtttatactaatctggtttaataatttggattacaataatcttaattaaaacaaatatgacctcagaatgttaagctccacatactagtacatgcccaaagaagaccttagctttgcttgtcccatcccctcccaaacgaacggtcatatgcgtggaatgcaagcccaaagccgcgggcatcttctagggcaagaggtctgaagccctgagcagagaggtgcccggcggggggcggcgtcacttgccggccggcgcggccttttggaaggcaagtgctcggtactagaaggtcgattattcaactgattcgacatgttctgatgaacttctgatatctgaatatctgatggtatttcagtaatccgatttgatcgactcggagtcggattctggttctgctctccaaagggctgtttggttcgcctatttaagatatcgccacgccacaagggtagtttctcttcatcgagacagatcttgctagatccatataagaagtagtaaagggtacgatactctctaggtgtcgccacagcttgcttgggagatttagagcacgatatttgggatggctcctctccctgtgccctgcctcgccttgcagcagcagcagcacggcccggaatcagtgaagacgacactgttcaacatcttcgagggacaggacatcgcctgcgacatcgatgccctgacgaacaacagcagcaaattctgggtgacgccgcagggttggatcctagttcacgacaaaacttcgctgtccaccttcatgttcagccctctgaatcctgacgagaaggttcagatgccacatctacctgacgacttaccaagaaccagctcctgcttgctctcggacaagcctactcttcctggctgcattgttctccttgtcgagcccaatgccaatgtcatctggcactgtggcgtcgacggcaagaagtgggcgagacacgagtacgacattggaacgcagctcttggatccagtcagtgacctgcacgagaaggtgccgatatgcccgatcgccgcttgccggggcaagttctacttcaacagcgagagcctcaccgacatcggtgtgctcagagttctcccccacgccggcgttcagctcgctcgagctcggtggagagctcgaggctgcgaacagggcgaaggtgttcttggtgggatccgaggaggagctctacatggtcagcctggtctatggctttggctgcgacatgattgacggtgaaacccaagtccataagatggatttctctgagcagcggtggtgcagagccgatgaccttggtggccgtgctttcctgctagctcctgggtatttcggtgcatcgtgttcggccgacgatcgtggactggaggcggattgcgtctacatgttttatcccggggataaggcgtgtttgaagatatccaatgtgaaagatggaggggtagaattcatggaagtcccagcggcaagaagagcattgtgggttctgcccacttatccatagtctaggcctaggtttctgcaattttggaattgtgataagtttttgttttgctgcgatattttgtcttgctattgtagatctgtaaaatgagtaatattcttaattagtattttgtacattttgcattgaactgtctattttagcccagttatctgctactacacgatatccctgagacagattttgttggaaaggaaaatgttcagtgtttcaggaatccctgagacaaattttgttggaaaggaaatgttcagtgtttcaggaatccctgagacagattttcacactgataattttagttcagagattgttctgaaccaggaacttcatgaattggactgaaccatggcatcacttgtcacaatttgattagtacagcaagtttgcaactttagattagatattgtttctgaacataatgatatattttttttaaaaaaaaatactgcactcagctgaccaatttcatattgccattcaccagcaaaattttgaggaattgtattccactcttccgggtccaatctttagtgatacgatggctaaatccatcgtcaatttcataacatggacaagtacaccatattaaactttgggcaactgctcaattgaagccgaagagctctaatgatgcttttgtgaacaacagtttgacatgaacagaacaaagccacccgttggtggtgataggactgtttgagtacatgctaagaaatacaaaagtttctattacccatctaaaaattgaatttctgctaccaactttttcattcactagaaaaaaatacccgtgtgttgcaacgggaaaaattaaaattacattaaaatttgggtaattaggattttctatattcatgatctgagcattattcatgcagatgatttgttatcgttcaatagcacttacacaagcatgtgcaatgccggaggtcctgtaacctaattttatcttagctctttggatgaagcataaccgatgaagttaaacgtgtatattaagggagttgattggactttttcctaaataggctacacatgtgcatacaggctccaatatgcgtgcacgtgggctaactgggtcaagtgggccgcaacgcgttgtatgatcttttttttttcgaacgaagaagaattgatcttttgcctccgattccgattacttctgatgtctgataatgttcgtgtcggaatcaacattcctctggcagcagttttcgcctatataagcaccggttttgcagataaaacattaaaagaagagaggaatagaggttgacaacaccacgctgactatggagaacgcaagcccagtcgtcagtgtccctgtgccttgcctctccatggagcaacgcgacgagtctgcagataagcccgtgctgttcagcatctccgacaagaaggccatcatcgacggcgacatcccggggctgaccaacgccaacgcctggttcacgccgcagggatggatcctactccgcctgagcaccgccacgttcctgcagaaccctcaggattcccaagacaagatccatctccctcatctaccagaaggcttgtctaccagatgctcgtgccagctttccggcaagccttctctccccggctgcatcgtcctcgtcgtcgagcccatcgccaccgtcatatggtactgtcgcatcggcgatgacgagtggacgagacacgagtacgacattggaacgttgcccttcgatccacccatcgatggaaaggaccacgatgatgtggcgatatgccagattgccgcttgccatggcaagttctacttcaacggtttcttcgacaccatcggagtgctggagttcaccccaacaccggtgttcagctcgattgagatcgtcgacccgaccccgggaggattaggggtgacgggcgcggcgcacgtctatcttgtagagtccgaggacgaactatacatggtgtgcttgcggattgactatgagtttaccatctacgatatgacagtccacaagatggatttcttgagccgtcaatggcgcagagccgacgagattggcggccgcgcattctttctagctccgttgtacttcggcgcttcatgttcggctgatgagtacgggcttgagaaggattctgtgtatgcctcgtatgcagtggataaatgttttgaggtatccaaggtggaagatgatgaaaccgaggtgcatgatctcattgatgctccagactcgaaaagagggatgtggattttgccggttgaaaaaaaagtagagatgataagagggagtaatagatgtgattgctacctccaaatttatttatggcattcaccaataaattaagatgcaagatactccctccattccaaattgatctgcatatagttttttttgaggttattcctaaatgatctacatatttgtgtttatttattaagtctattcgttatttgtccattggagtaaatggacattgatgcatgcatccatgcacacaagtatttataacccacatgcaatatcttaatttgctattggctaggaaatagtggggatggtgcatgcattgggtttgttgctagagtaaataaaatatgagagagttattagctttttttggtcttggtgtacctatgaaatatgtagatcaatttggaatggagagagtatacaataggtcacctctaatacacaaatatcaatgactttagtactctcacatccttcttgaagtttgtgtggggggtggttcatcatctctgtcctcacttctctcctccacctcatcacccaataggggcagcacataaaacattatagcacttgcactaatgattggaaaaaagtcagaagctatacactctagatggaaatgatgctcacagaaattataaaaatcaaaatttgtatatagctgatcgaaatggtgggaaacagcatcactaaaaaatgatacttggtcggtcggccgggaatttccgccgtcgtttttatttgtttttgcagcgtttggtgagtgcactatctgtaaagtgagtactattcttaatcagtacgtatcttgttttctagttaattgttcgtatttcgagtgcttgatgagagttaattagttaagtcatcatttcccttatgcccgggcgacacacgttttacgatggatgggtgtcaataaaaggaaatggattttttccctcgagggaacgtctcttcgttttatacatatcatttaaaaagttatcaattttttttaaaaaaatatcagattgatcaatatatgatatatctttttgcaaacatgcgagttaaatatcgacttatataattcaaaacacaattaacaaatttgaccgtgaattacgtgttctattcatagtcaaatttgttatttttgtttctacttgtataagttaaatttgaatttgtatgtttataaagtaacatatcacatattgatctatcctactaaactttttaaatttttttatgactttttaggtgacatgtaaaaatagggatatctccttaaaggatgaattgaggttttacgtcgatgaaatcaacattcctttcttccatcacactctgtaatcctatcttactataaagttatcccccactaagtactccttaagcttgacatgcaaagatgccacatcatcattcactaattaacaagatgccacattatcatccattaacaatcatcacatttaaacatcattcaaacatactatatatttatagtttttataatttaagagtttttcaaatacaaacatgttaaattatcatccaacataattcacataatatttcaatgtatatctgtattatgttttatgacattctatatacttatatagtttatcctcacttagttagtgcttaaatgattaatatatggttcaagttatctttctccatttttttcctcaaattaagtcatatcacagcctttagataattaatctacggtccaaactatttccctacttttctttttccataaagtcataccagcttactttttacgtttaaatcaccattctacatactatttaaatttaaattatcataaaccacattaatttacttaatctgatgttatctagctatcttacacgttattttttttattgttatcatacagcaatgcgcggggtttcacctagttattgataaacgcaagcccaaagccttgaaaacgtcattagcattctgccaaagctaagttaggacaaggcggcgggaaattgaaatcatccctcgaggagatatcccctcgtgtcatcaaaaaatatatgaaaaaaattaacaacatagattaatataaaatatatcactccacaaatatgtaagtttctcatcgatctttgattaatataaaatatatcaaaaaatataaaatagatcctccacgaacatgcattccgagtcgatccggcggcggcaagcgtctgacaccttggttccgtcggcggcggagggcaagagtccggaggaattcccgattcgccgccgtgcagatcagcgcgcgaggtcggtgttactttccctggccggtgccagcggtaagtttagcggattccgattagtaattctgatctctgattagctagtttcgcgtgagcttcggccagtgattgctgtgatcgactcggaatctgtctgtacgtactccgattgacacatctgcatgcccggcctatataagagatggttaagcacagttgcagttgatccaacgcgaggagaggagctaggcttttttttatcacaccaagccgacgtcgcatcaccacagttcaccatggacaagacgaacagtgtgccgtgccttgccctgtacgtgaagcacggcgccgactcagacaagccggcgctattcagcatctcggagaagaaggccatcaacaacaacatccccgggctgaccaacacaaactcctgggtgacgccgcagggctggatcctagtccgcgacaccgtctccaccgccacgtttctgcagaatcctcatgattcgaccgataagattcagctaccgcacctatcccagaatgtgcacagcagttccacatgtctgctctcctgcaagcccacgatgcctggctgtgtcgttctccttgttgagccagtcggcactatcatctggtactgtcacattggagacgatgacaagtgggtgaaacatgagtacgacatcggaacgcagccattggacccccccccccccccttggacggcaaggaccacgagaaggtgccgatatgctcgatcgccgctttccagggcaagttctacttcaatggtgacttcgaaagcatcggcgtgctggagttctcccccgagccaacattcagctccatcacaatcaccgaccccatcatcggaggattaggggtggtgggcatggcaaacgtgtacctggtggagtccttggatgaactttacatggtctgccaaatgtatgactctgaaatggagaccatctacgatgtcactgtttataggatggatttctcgaagcagcaatggtgcgtagccgaggacattggtggccgtgcgttcttgacagcttcatgctattttggtgcttcacggtcggctgatgagtatgggttggagaaggattgtgtctacgctatttttgcgcgtgataagtattacgaggtatccaaggtggaagatggagaaaccgaggagcacgagctcatcgaagctccagattcgaaaggagggacgtggattttgcccgttgaataaagtagagatgaaaattgtccaaatcagtaagaaatgacgtcgtctctatggaaacagagctgatagatattagaatgtaagtcaaaatttatatacggctagaataaaaaacttggtaagttgggaatttgtgccaccgtttcaactttcaaccccgttgaaagattgtaaatgtttttcttttcagtatagctattgtttattactccctctattctaaaatataaggtacaatcacccttaattcaaagaccaagaaacaattattaccacctctttatttgaatcgatccatacatgcacccaatagaattaaacatcttgtgagtgtatgatttaaaaaataataatttaggagagaagatatgctaattaattgtcatgcatgcatgcacgccttatattatgaaacacctttaaaaagtcgttgtgacttatattttggaatggagggagtacatgtttttgcaacgcttgatgagagcactatctatgaaatttacatttcgttttttttttgcgtactgtctactgcaagcataacaagatatttcgttgtaaagaaaaggttatgcacacacgaaattaatgattctggtgtattaaaaaaattgagtagtgaaccttgccatcactcatctcagttttattggtttagcattagtcagttcattttcacaagttgtctgtcgaccagaaccaagtagtggatttattggggaaactctaataatcccttaacgcgatatccccttatttttcgcgtcgcttaaaaatcatgaaaaaaattaaaaaaaagttagagcaacatgtgatatatcacttcacaagcatgcatgttcaaattaaacttatataattaaaataaaaacaacaaatttgacaatgaatagaatgcgcaattcactattaaatttgttatttttgtttcgaattgtataagtcgaattttaattgtgaaaagatatatcatatattgatctatcttaacagttttttataatttttttgatgactttcaaatatcatgcacaaaatgaggggatgtcccctcgagtgataaaaaaatccatctcgatttattgaaaacaaaatactgtacctagccgaataatgtcgcactgcatttgcccagttgcctctgaggatgaaattctttcactagttccaaatgaaagtgacacacttggtaaatctatttgaacttgtaaaagcagaggataggccgtaaaattccaggtaaacagtcatgtgtttttttatttcctgtttccaacctgaaaccgaaagattagagcattgttcctacctgatgaacaaagctggtatgcctgcttttactgaagtcctcgtctcggcgcgttccatggccgcctcctcctttctccgcagctaagctcaatccttctccgctgcgctcgtgctcacgggcgatcgcctccatggccgccaccgctagccgttgccccctctatgtcaccgctccggttcgcggcgtgggggtggaggagaatgccgccgcctgcaaggaatgggatgtggggaatacgatcaactcgtgcgtcgcgtcggcgtgggggggacgagatggacgcgatctcacctttttttctcgccggggaaggaggggagcgcggcgtcgactcgccttgtgcggggaagaagacaagaggggtggggtttgccaggttaaatgcctctgatcggtggcaatgaaaaaaataataaaaaaaaagtcgatcgtattttacattacactatttaccatccatatctttagataagatataggtccctatgtgtatatgacatggcaaaagttaaacatcatgataaatagttaagttaaatatctagggtgcgtgaggtttgacattggagagaggcttaggcggaggttaaggccctatttgagagagcttgtcacagctgcagctttttgctagaagctgccccaaacagtccacaacttctgagaatctgtagttacatattatgaaaaatgaactaagaagccagaagttggagaagctgagtttcagagtttttccagattctcagaagctgactaccaaacagctgtttttcagaatctaaagctcccccaaataggccctaagtttatgaacatttgtgaaataacggggtggcatgtgagaatttggttttttttttgacttctactttactttttagttgtataattacatattatcataatatatggatgaacaatgtggattgtttggggaggttgagattctcccaatctagatttttttttatttctagtctatcttttgattttatggttacatattttcagaatatgggcaagaaacttggaccgttggtgaacctagagattctagcagaagctctctcaaacatggccatagattgggagattgtgttcctgtgtgttcctgtgttggaggtggtgggttgagaatgcagtggcggtatggagatggcgttagagggaggaggtggattgagaatacggtggcggtatcagtttgtcactagaggatcggaagaaggattatgcttttcttacttgttggttccctatagcaatgtacttcctccgtttcacaatgtaagactttatagtattgcccatattcatatatatgctaatgaatctaattagcatctatattaatatggacaatgctagaaagtcttacattgtaaaacggaggaagtactaaccaagagcaagaacaatatagtgtatgatatcggcgttttggatagaatgcctacattatgagcgaggatatatttatataccattcaataaaatatttaatacactatttataccatttcgtacaatacatctgttctaaaatatagcaacttttggctatacatagagatatactcttgtttaaattaaatgtactgtggaagttgtaatattaaaagaccctcattgttatttaacaaaatagaatacaaagaaaacaaaattttggttttattaagggtagcgcagtaatcgtacaaaatacaaggacttgtgtgcaaaatatccttctctccggctctcccacaccaaatcctctcaccccccacctgcgccccgcgcctctcgccgccgccgccgccggcgacgacgaatttcttccacccgcatccccctcctcctagcaagctagccgacggcaacgcctcccggttccccctatgaactgacgtcgagacctcatcccggccgccaccagcgccaacgccgctcctcctcctccacgagccggtgcctggatatttctggatctgaggccggcccgtggctgcaggactgcgtgcaccattcttccgacccgacgttctgccgccgcgcgcctccatgccctccggatcaagctccccctgtattagggtggggttttttgcctgggttggcgagcgaggcaagatgctgtggtgggacacgctgctctgctctgctctggcgtacggcgtacctatacgagagaaccaagtgccgcctccgtcagccgtgaggtgctcatggagggcaagcccatccccaccgagctccgcaacaaagacctccaggaccaggaaagagcaggttagtgagctcctgtttctcaacgtttccgctccatctccatcgctgctgccttttctgcttcttctttttcatctatatggctgggtgtgtggtgaattttgcttcagccccaagtatccgcgtagacaatgagtattgacggtggcacgctccacgtgccaagattctcctggccatgtcttgcaatccgagcacggcttgcaatccaagcgtgcccctgatttagtttgtcgaggtgcggcggcctttgaccaggcaacaaattgttcttcacaagttgaattggacacatttggttgacaatgataatcagtaattactgtccattcgctaggaagtcaaacccataattcctgtctcgcaaagactaaactatggtagtcatatttagtatagttcaaaggcaaccttcacaattgaatctattctaaaaaagttcgaagcagtcactaatgaaaatcttgaactactttaattctaacatagttccagaaaagattggtgaagtatactttgaactattctagaaaaagtaatgctgaaggctgttgatgtgcttgctagcagtgagtgtgtcaatggtaccatctttttttttccctaagagggggatgataattcacaaacaaactgtgaattttggattctattcttctgtcttatttgggcataatttatcggttctcatatttaggtttgatcactgtaaaggaaaatgtctctggactcaagccagtgctccatggctttcatgtgcatgcacttggtggcaccactaatggttgcatgtcaatgctacattcatttctttcccccttttctttgtcaggagaaatggattgtggtgcgcgagttggggaaattgttctaaaagtgtaggaataatatactccaatccaactaggaaggaacatggggggcacaagaaggttagaaacgtcatgctggtggcgttggaaatataatgatttgaattggagcggatgcttttttttacagctcttttattgcttacattccaaaaatattttagtacacactgtctgcattggatgaaaatttgatagcttaactacaacgctgtgctatcttaacatttattaggtgttttactcaggtaggttctacagagacctagaaatctgagggacattagtgtgtctaagttatcttgaaatgtttcacgaaaatttttagtgttcaccccaagacatcattagtgtatgcctatgcttaatgaatgtcgttatccgcttgaatgaccaatgtttcttatgtttccttgtaaatcaaatgttatatcattgtctcttgtcatttcatgcagattttcacaccacttagcccaaccctgtttcatgtaatggcttcttgcttaataggccttccaagtaaagatggcataggctgagttgcaggatggaaatttatcaggagtcagctccactttcagtgaatccatccttctcctggaggaagagaagatacatgatgcagtgtatgttctttttattcgtgttctgacattgcatgaagtaacgcttcttatattttatttggaaattggaacgatctctatttttttccttctctcagtgagttcagttttctgaagaaaaaatgtgttttagtttaaacacaaccatttgtttagtagttaatccattacacgtttctgtgaaattttgatcattcgtaacactgttaaattttactttgtgatttgtaataatttcttctgcttctttttctgcagtggacaagttggtgaaaaaaaaggaattgaacttttgcaagatatactgaaataaagtcagtggttaagtctgataaattatctgctgcattgaagtcccctcatgcgtttctgcgcaaggtatgtagttgcatcgtttcctctttacacgcactgaaaaaagacatgttggaaagcctacaaccatagaagtttacattgtccatttttggattatatgttaattgccggaactgatagtcttcagatataatgcataagaatttatattcttgctagggagaaaaaaactcttcatggttttacgaatttcatcacttgcaaaatggagcagcaagttagccactatgggcacattcagttttaaattaggattctgatctgaggatttaggcttgcagggtacagaaatcagaattttcccatttgctctgcttctactggaaacataaaattttaaatgcttgtcctagaaccatgttatttcatatttaagcactatgctttatggtattccacatttaaactttttatttagggattggaggatattgagggggattaattccacaccttaatagatgtggaattaatccccttcgaaatcccccttgattcccttgtagggggattaactgaacaatgccttagtggtcancntnanttncanttccatnntgaaaaggaaataacttttggaaacaagtggccgtgaacttacataataatgcttggctttgttggcagatgatggagagtacaatggatgactggtcaatcagaaagggtcttcaacaaagtggaggtgtggttaaattatatgtacattcaaactaatatttatagatggctttggatgggatttcatggacaatgtttatatacattgtcactatttaggttagagaatacagaacaatacacactgtgtcatatttgggtacagggaccgctcatattctgggatgcattcttcagcttttgttaactgtgatgatgtagccttgagctgcagtcaacaacggttcctttcgattctgtcatgccaatttccccatccctgcactgtctttcacaattaagtcatccctatttttgtacaatgcaatgaacagctgcaagcatagttgcaagagtgatattttggttattcactaatatggtcatattatggtttgaagtttggtcaatttaattaaagagcacctatgttaacaaagcttccaattgtttttatattgttatgatcatgacattaacctgtgtggttgtacttttaattaatatgcacggggagtatttgcacgagcaaatttttacatgaagtttgttcatttgacatttggcgtcactgaatacaaatttctgactatgtatgtactatgttttaagattaccttttttaggttaattgaaatgaaggggaaacattcaatcaataataactaattggcatttcatgagacttttgcttgcgcagctgtgtgcggtagtagcaccgcgcttttcccttctaatactatccgcacactctatttcttttgaatgaaaaagacaggtggggttagaggctacacatgtcaaccactttttttttaccaactctctattttttttaattaaagtgattatatagggctaaagggtccacatgccagtaatagaaatacatacaataattaaaagatgatatacataggaaatgatgataatgcagattaatgatatttttgaaatcccattgcaatgcacacgcaatatggtaatatatataggaaaaagtccaaatcccccctagactatgcccaagagtccatctagcgtcccaaactataaaaccgggtatttagcccccaaaccttataatccagtccatttaaccccctaagctgtttcacaaggcggttttgcacatgtggtgggctgactggaccgtatttgccacgtcgtcatgctgaccaggcaattgcaaagtacaggagggaaaggtgaagtgatcgcgaaataaaatgagggagggaacgcacatcgctccatatatcattcttgcctcatcgtactccctcatcccatctcctaggtttcttctctcgagtgttgcgtctatgacgaccatggctgcctgatcacgcactgacgggaagattaaggtgatcgcggagtacatcttggagtaggtgagatccctgactcgattgcagtctttgatgcaagaaagtttcctccgtttttatctagggttttgtggtgattgttttactcacagtggttgacagcctccacgagggaggtatggaggcaagatataattagctttggtttctttagttttgttttctttttgttccgacattgaggtttagggctttgatgttttctgttgcatagtgcagatcgatgtgtgtaggatgatcttttttaatcttgtcaaatctaatataaattaaattaatttcgtcttttatcatgcagcacaagctagcaagaatgaataatttggagatacttcctgtcagattccattataatggggagttcgccaattctagaaggattgtgcaatacgttggtggagatgaagggatgttatatatagaaaatgataagatttctatgcctgaaattagaggacaccttgcagaccatgtcgaggtcaaggatgccatgcagcttcactggttgtttcctggaaaagaattaagcacatgattacgtttactgacagatgacaaggcatgctttgatatgtcaagttgcattgctgaaggtggagtggctgaaatttttgtggaggaaacaatgtcagattataattctaaagaaagtgattgggaaactgacagtgtgaaatctgatgagatggaaaacgtggaagggacacaatatgatgcaaacaaagaaggaagtgtgggagaagatagtgacactattgatagtgactatcaaccagaaagtggaaatagctcaccagatgatgaggaggtagtaaacctacgaaagtttgctgagatgtataacaaaaagttaaaagcaatgaggctaattctacaagatcctgatgcaaacagtgtgcccattgagttaataggtcatggagatgatagcttgaatgagataattgatgaacctacatatgattctagtgaaggttattcttatgacgatgatagtggtgaacacaacgaccatacagtgaggagaaagagtaggtggacaaggtatgactctaattctgctattccccatttttcggttggcatgacatttagagggaaagaggaaatgaagaaagctttacttaagtacggaatagtgaccaaacgacatatcgtgtttatcaaggatgagagggacaagatcagggctcctagatgtccttggctgatttatggttcaaagagaagcaaatgtgattggtttcaagttggtactctctgtgatgaacacacttgcccacctaaggaggaggtacacagtaaacttgcaaaatatgacatgccttaagtgctatttataagtcaggacaagccatagatggttttattgctcaatgctattcaattgaagagtacaacatatgatcattgcatggagcctgtggaaggagagaagtggcctacatcagatcaccccaagccttcacaacctggttatgtcaagatgcctggcaggccaaaaggaaaagctaggaagcgggagcctggtgagaaacctaaagcaactaaaatgtcaagagttggcacagttatgaggtgtgggctttgtcataaaactaagcataatagcatgggttgtccactcaataaagagagtggcaagaagaaaaatgctcttgtcacaggagctaatagaaaaagaaagcaacctgatggagcaacatcatcgactgttcatacaaaacaacaggcaatcacatctcccttcaactaactgcaaatttaatcctaatatgatttgtgtacattgcaggcatcacatagcttgcaaggagcaggggaaggaacaattcacaggctaggaaagacacctgtaaggagctccaagaaggtttcactgaagggcaagccaactggagtagcaatctgatcagcagtgcttttttgtgtttatacctgtattcttgtcaagatctatgttccttactagtttcctaccacttgtgttagtactctaaacctgaaaaacaatcaaatttgttggatgtactctgaacctgtaagcttgatcttgaacatggccttcgttcctgcacaattctcctgattacagtcatattataaagtaaaaatgtccaaatacaatcacatgaaaaaaatgagaaaaatgcgaataagataatcccaaaaggatacaacgtttgaattgcataataatatgcttactagattatacaatatcacttgggcaatctccacattacactcaacagtagagggataatagatgagcttcttttacacatttcattcctccctaatctatatgcatggatttacactgaaaaaattcttttctatcaccatgttctacagttcatatcacttggccctgtccatccttgccgtgcttgcggccggcgcgtcgagcgtcgccgtgcagcccatgcacctgccccgacagccacagaacttatcctgtagcctacaagctccgggaacgcatgagccccagcgccggcaaagatgacacatacaggatgctgcacgtacggctcctacctgtcgcgggcgccggggtcgtcgcgctcgccgtggctgcgcaccagcgccgctgctatgatttcccgcgctagagtcgcctcgccccaggtccggaatttgacgctgctactgacgtgcgggaagaactcgagatggggaatatgaaccctagagcgagaggaactctccctttccctcctgttacgaagtggtaaatacggtccaatcagcccgccacgtatgcaaaactgccttgtgaaacagcttaggggttgaaatgactggattataaggtttgaggggctaaatacccgattttatagtttggggactatatgaactcttgaacatagaacctgttttattcagcttagaattattataacctggattattagaagtaaagttgaaacaaacaagttaattattatgatagattattacaatctataagccatattattataatctaataatctcctttttttttgagcttttttcagattattgagtggctaaagactcactatttttagatgcctccaataatctagagaaacaaataaattacagtttattttatgtcagcttattataatccagcttagagtaatctgatttaataatctagattataataatcttaagttgaaacaaacatggccatagtttatgggagatttagactttttccatattatctgattatatatataatcaaataattgattatttaaatattacgtagataactaaatgaaacctattatctacacttactatttataaaaacgtaatggtcgtggtgaatcgtccactaatttttcgcaccttcctatattaccccatctttctctttattgaacctacaaagtcaaatgctagatcttctgtacgctcctctcttagaattattcgtacatactccccaatggtcaatcctttaaaatctttaaaaggcatacatttcataagtcacatgttttaaaacataataacacaaaaccccaccttttaccatttgtttcaaggaaccacatattttaaggtaaaatgtttcacaaaaccacatattcattcaaaatacttatacttcgttgtagtacacatatactcgcattaagggctgaacgtttctatactatacgctctatttccttcctacctcacaattcataatgggaaaattgttgatgcaaatagcatctcatgtacaaattacatataagcaaaaaaaaaaaaactcataattcatgaccggtgttctcttgagaaagtggctacatctactcagaaaatgcaacatattatttcttatacatgtattacgcgtaagtataatagccaatgaataatttaggcatatgaatgtaggttttattaaacgttttgccctaaaccccaggttccttgaaacacgctgtaaaatatgtggggtttttatgttacgcatgctttttttttattttgcgaaatttgctcaaataaaaaagaaaaacgcccagaacatcagatccgccacccgcaatccgccggccttgcccgtcacccacgacagccgtcgacggcccctccgcgcctccactgcctccgtccaagcggccaccgccgcgcgggcggacggggatcgcggcggactacggggacgccgcggccttctcctccctctctccccccgcgggaccttcccgtccccgccgatccgccgccccgtacgccgatcgccatctccgccgtccagtccgcggccccctacgccgatcgcgacgcacagcccccctctaacaaggtactgatcccctcatcgcagttaaggtaagcggattcgtcgcagttctatctgattcggtttcagttctccgcttgattcggtctatgatgttctatctgattcgatcgcagttcgtggaatttcatccaggggtttgtccgttgccatgaccgactcgaaatacgctgtggcactccgattggcatctgatttggactcgtcccaacccttcccaatttccccctcctcgcctatataagggagccactacggtggcagatcccacgaagaagagaggaatagaggcttgacaacaccacgcccacgaagaagagaggaatagaggtttgacaacaccacgccgactatgggaggccgtgtccctctgccttgcatcgccctgaagcatggcgccgactcagacaagccggcgtgaccaacagcaacgcctggccgacgccgcggggatggatcctgatccgcgacgacaccaccacgtttctgcagaacccacaggattccgacggaaagattcagctgccgcacctgccggaagtcgtgcacaacagatgcgcatgcgtgctctccggcaaaccgacgatcccaggctgcatcgtgcttctcgtcgagcccgaagacaccatcatctggtactgtcacgtcggaggagaagatgaggagtgggctagacatgagtatgatattggaacacagcccttgcttccactcgtggatggcaagggccacgagaaggcgccgataacctcgatcgctgcttgccaaggcaagttctacttcaatggcagattcaacagcatccgcgtgctggagttcaccccagagccgacgttcagcttcatcgcaatcacggaacccttggatttctggggcgcagctagcgtattcttggtggagtcagagggcgaactatacatggtaagccagctgtttgactacaacctcgagtacatctgcgatgtcactgttcataagatggatttctccaagcatcaatggtgcacagccgaggacatcggtggtcgtacgttcttgatagctccatgttatttcggtgcttcacgttcggccaatgagtgtgggctggagaaggattgtgtctacgctatttttgtgcgttataaatattttgaggtatccaaggtagaggatggagaaaccgaagagtatgatctcatcgaagctccaaattcagatatagggatgtggattttgcccaccgtctagtttcacaattgggaattttatcatcttttttgcatggaaagaaacatgttttttttatccagtgtaaccgtagttaattatttgtatttccaactttagtaagctatatatatgaaacagtattattggtcacacatcaatcagtgttacaagaatttttgttggaaagaaagggagggttcgttgaaagactgtacagaaatattttctctagtgtagccattgtttattatatgtttttgtagcgcttgatgagtgtgctatatatgaaattaagtttttttttctgtcgtactgtccactgaaagcataacaagatatttccttggaaagaaagggttatgcacagagatagcacacaggaaattgatgactattctggtgtattaaaaaccgagtaccgaaccttggcgccactcttctcaattttattggtttatcattatttagttcatattcatgagttgtttgtcggccagccagctgaataatgtcacactgcatgcatgtgccaagttacctgtgaggataaaaatctctccctagtttcaaatggaagtgacacacttggtaaatctatttgaacttgcaaaggcagaggataggccgtaaagttccaggtcatgtgtttttctgttcctgtttccaacctgaagctgaaagatggagcattgtgcctacctgatgagaaagctacatgtgcaggctggaaatttttcatccaaattgttagttgttggtttccatttccccatgagtagttggagtcttggagcactagatgttattaggagagaaaaaccagcacaagatattagatcgatggaccgatggtgtttcgtctcactatttgctttggtagtttgcttggctaatacggccgtcattagtttgtaatatcaatttgatttgactggctaatttcgtactccctccggcttagtaaaacttattattttaaacaacgacacgcggttaaaaaacgatttcaacaactattttttattacaatatatataacaacatcaataaatatataatttattgaagtacttttaggactaatctaacattctgagatgttattttagtcaaagttgtaaaagtttaacaatatttttgttcaaaataataagtattactaaacccaaattgtaattagtggtttgcatgtgttcagattaaaaaaaaatagctaacatcacctcgccatccccgttgccgtgccgctcagctatctcaacgtggatgcctcacttgatttgggaggagagaccgagaacaggagcatgggaggagagtgaggatgatatgtgaggcccggtttgtttttgccatgtaagcgcgtagtcagcacaagtggatcggatcaacttgccacgtcagtagaaaacaaccatctatgctgcgggagggcctaatctatcccagttttgcaagtttgggggtcaaaatttctggtatcgtggtccaaggatacgatttcaaactcgatgtcaagaggagggacctaaagtaaacttattcctattccaaaacaccggttcactcactcttgggccggcgaagtgaaccatgtgagaagtgaaagcccatacttggtttggtcggtgaggcctcgagccctcgactcccggacgcctcgcctgcgtcgatctccatccatcgccgccggcgtccgcggcgtctctctcgctggttggctggtgagtctcatgatcatccatcccttctttctcatctctctctacttattacgttcctttctcgaatttgcgttagccctagcttctcttctagatcttggaagcttttctctttgcctgccgctgtgatcacaaactgtgtgtcgcttgccataactgacatgctctttgatttgtgctagaatcgtgtgcctggctagcttgtttcagatctgtgctgaaataaagaacaatattagtatatgttaaatcgagggatggataagtttgttttctgatgaaatttgcgtgcttctataaattattcttgatttttctttttgaattttcaccggtgggccggggatgaatttcatttcccaaacgaaaaaactctgtacaggcaacgggcaaacaagactataaattcttcgttataccctctctagtcattgctcgctcgctccttgctgttattgattgctcaaaaataatccagatttctcacccttctccattgaatctctacttctcctttttgagtgtcagtcaggctaccaacgaagagaaaattaatttaagtcgctcatccggtttgttgacttgtggaatgatttctctatcccttgattggaccttcaggtcaaggaagcgtgagtgttgaagatgagctgcgagaagttgagccgtcagtctctgcatttggtgttgaacgagggtcgcggcttgttctcgctaaggcacatggacgtatcaaagctcttctacccatcaacggcagaagcactggaagcagaggctaaagctaagaagaagaagaatggcaccaacaaaattgggagcatcggccgtttgccaacaccgagcatacactaccagccatatacgtggtctgcgtctaatccctacagttcactgtgtgcacttgctctctttggtgagaggagcaagaacaagatcctctgcacggacatggcaggccacaccagcatctacaaccccgagttgcgctcattcatgagaatgcctgatctgaattcgcccaagagatacaatagttgtgtggctgtctccatcccaggtgcttctgcccatgccatgtccaactttgacatcgacacagaccacagcctgtacatcatggatatcgatcctacctactggtgtagttctgaggtgcttgcctatgatcctgtggaggagtgttggtgctgggggccactcccgcagccgccattctttcaggaccgagagtataaggtcccccttaagcctcgcttcatggtggtcgatagcaccaagatatgcgtgtctaccaccacggcgacctactcctttgacatggtgacgagagattggaataaggtgggtgattgggtgctgcccttcaatgccgagtatgtccctgagctgggccactgcctcggcatgtcggatggcggcccctttgacctgtgcatcttggacaacctctccaccgccgcaggctctcctccgccggtggtgcggcatgtcgggatggagtttgagctgccggagaactggtctcaggtgtaccgtgacctggtgaaccttggatcactgaggttttgcattgtcaatggctacaccattgaaaacgagcggtacgagtgtgactttaacccagtgactgtcttcaccggcgtggaggtgttgccaacaagcagtgaacaggggctccttatgatcaagcacaagtccaaatgtatcatgacttacatcatgttcgtgctctgaggtcatcgattggtcctcaatatttatccatgtttaacctactgggagaagtaggttcataatagccagtaggaggacaaatgctgcacgcagtgattttgctttaatgtgccatctatatatccatgttactgttgtactagtgttttattttttttgtcgtaaggactatgtatatcttagcccttgtttctctgccgataaaactaatatatgcaagcccaaaggtctggaagatttttggttccgatttgccagttgccgcgcgccgtgcagatctttgccaagacggctggtgcgggaatcgcataattgatttctgtctccgattccgattgcttctgactcgtgctgaaggctaccaaggatcgccatcaccgacacgaactaaccttgctcagcctgcagttttcgcctatattagtgcatgctgggtacagtttgcaaatccaacgaagaagagaggaatagaggttgacaacatcacaacaaacgaaagaagaagaagaggaagaagaacatcacccaatcatggacaacacgagccgcgtctccgtgccttgcctctccttggagcaacgcgacgactccgcggataagccggcgttgttcagcatctcggacaagaaggccatcgacggcggcatcccagggctgaccaacaccaacgcatggttcacgccacagggatggatcctacttcgccagagcaccaccatgttcttgcagaacccacaggatccccaagataagatccgtctacctcatctgctagaaggaggcttgtcgaccatatgctcatgccgtctctccagcaagccatctctccccggttgtgcgtcctcctcatcgagcccatcgccactgtgatttggtattgtcgcattggcgacgatgagtggatgagatacgaatacgacattggaatccagccattggatccgcccttcgaaggcaaggaccatgagaaggtgccgatatgccagatcgccgcttgccggggcaagttctacttcaacagcaactttgagaaaatcgaagtgttggagttaacccccacgccgacgttcagctccattgagatcgcggactctattgccggaggattaggggtgattggcggggcgtatgtgtaccttgttgagtctgaggatgaactatacatggtctgcctgcggcttgaccatgacttcaccatctacgatatgaccgtccacaggatggatttcttcagccatcaatggcgcagagtgtatgagattgggggtcgtgcattctttctagctccgttctattttggcgcttcatgttcggctgatgagtacgggctcgagaaggattctgtgtatgcctcgtatgcactggataagtgttttgaggtatccaaggtagaagatgacgcaaccgatgtgcatgagctcatcgatgctccagactcgagaagagggatgtggattttgcccgttgaaaaaaaaatagagatgttaatgtttggatacagtcggaaaactatataatctctatgaaatcgatgttgatagaaattgaaaaattcaaaatttatatatggctagaattggaagcggcatcacttgtacaaaacatacttggttggaaatttccgccaccgttttgaaccctagttgaaaggttgtaaagaagaatcattttccgaatgtaactgatttattatttgtttttgcagtgcttgatgcctgcactatatatgaaaataatatttcttttctttttggggtactttctactgagagcataaatattccgttggaaagaaagggttatgtacagagagaacacacaagaaaatgatgacctttatttttcgattattaaattgataaccaccttggcaccactcatctcggttttaatggtttattagcattatttagctcatattcgtaagttgtctgtcgaaaacaaccaagtagtggattcactggaaacaaaatactgtacctagctgaatttttttttcagtgtagctgtaaaattccaggttaacagtcatgtgttttttgttcctgttttcaacctgaaaccgaaagattagagcattgtgcgtacatgatgagaaagctgcaactacatgtgcaggctggaaattttcattcaaattgttagttgttggttcccatttcccccatgaatagttggaggcttggagcattttagatgttcctacctgatgagcgaaatctagcatgagcacgttttactcctgtccaggagccgttcggaatccggttatactccggacggctgcttgattccgattcggctgcaagttccctgcccagatgaagtataagaacacgatatttgggatggatcctctccctgtgccctgtctcgccttgcagcagcagcagcagcacggcctggaatcagtaaagacgacactgttcaacatcttcgagggacaggacatcgcctgcgacatcgatgccctgacgaacaacaacagcatccctgtttcttgtctcttttacctcaccacgaaaattggccttttgcctccaattccgattacttcagatgtctgatctctgatgagggatcgccggccgtgactgactctgagtcggaatcaaccctgcttaggtagcagcttcgcccatataagaggagcacagagcacgatttgcagatccaactaagaagagaggaatacaaggttgacaacaccacgccggccatggacaagccgagcggccgcgtctccgtgccttgcctctccatggagcaacacgacgagtctgctgcagataagccggcgctgttcagcatctcagacaagaaggccatcgacggtgacatccctgggctgaccaacaccaacgcctggttcaccccgcaggggtggatcctactacgccagagcaccgccaccttcctgcagaaccctcaggatccccaagacaagatccatctcccagaaggtctgtcaaccagatgctcctgccagctctccggcaagccatctctccctggctgcatcgtcctcctcgttgagcccgtcgccaccaacatatggtactgtcgcatcggcgacgatgaagagtggacgagacacgacgacgacattggaacccagccattggatccacccatggatggcaaggaccacgagaaggtgccgatatgcgagatcgccgcttgccggggcaagttctacttcaactgcttcttcgagagcatcggagtactggagtttacccccacgccggtgttcagcaccattgagatcgtcgatcctatccccggaggattaggggtgataggcgcggcggtcgtgttcttggtagaatccgaggacgaattgtacatgatctgtctgcggcttgaccacgacttcgccatatacgatatgaccgttcataggatggatttcttgagcttgcaatggcgcagagcctatgaggccgtgcgttttttctagctccgttatacttcggcgcttcatgctcggctgatgagtatgggcttgagaaagattctgtgtatgtctcgtatgcactagataaatgttttgaggtatccaaggtggaggatgatgcaactgaggtgcatgagctcatcgatgctccagactcaagaagagggatgtggattttgcctgttgaaaataagtagaaatgaaaatattcggaaactgcctgaaatgatatcatctctgtggaaacgggttgacacagaaagcagaaaaaattatataagactagaattggaaatggctgtcacttctagaaaatttatttggttggtccaaagtttctgtcatcattttcaagcctagttgaaagaatgtaaaggatttttttctcctaatgcaactttagtttattatttgtttctgcttgatgagtgcattatctatgaaattagagtatttttacggtccaacagcctgggtaggtaccaaatctacaccattcatttaacttgatcggatggctgagacagattcagtaccgggcagtaccaccgatcgattccatgcagtaccaccgcctgaagggcattttcgtaatttcgcgtagcctcagttcagatcagatcggctcagccagccgcctgcccgttctccatcccaggttctgagcttttttgcagcggcatcaacggcgtcagcccacaggatttgggccgacgacgagctacaggatttgggtcggtggtaggctgcgggatccgggtcaacggagtgcacgaagccgacggcggcggcgatgggctgcaggatgcgaagcggcagcgggctgcaggatccgttcgagggtgtgcgcgaggccggcgtcgatggcggatgggggaacctagctggcgtcgacgggctggcagggatctggccgccggcctctgtggtgcgcggcggccggcggggccggcgtcgagggcgacggcggcctgaatgttaagtcgacctgacaatgtttccaatcatgcccacggtaattgaacggttggatttcatttggtacctgatgtaccatctgctggaccgtaacaaatctcatgaaattaacatttttatatttttttccatcgtactatctattgaaagcatgagaagatatttcgttaaaagaggggactatgtacagagagaacacacggaaaattgatgacctttattttggtttattaaaaactgagtagtgaaccttggcgccactcatctcaattgtagtaatgacttagcattatttagttcatattcctaagatgcatgtctatcgaaaacatccaagtagtggattcaggggaaagaaaatactgcacgtagctgaatactcgtttttttatgtcacccaaataaccataattttttttaaaaaaattaacaaaatagattaatatgaggcacattgtccacaagcatataaggtcaaattcgacatttacaggttgtgataaaaataacaaattaaatatatacattcagtcatatttgttactttaacttgtatatttgtgctgtaaaatatcttatattaaactatcttgttaattggtttttaatattttagtgcacatgcaagaaataagttgatgtcccattaagggattaaaacacttttcttggataatgtcacactgcatgtgcccagttacatgtgaggatgaaattctctccctagttccaaatgaaagtaacacacttggtaaatatatttgaacttgtagaagagggataggctgtgaaattacaggtaaacagttatgtatgttaatttgttcttgtttccaccctgaagccgaaagattagagcattagctgtcctacttgatgggagagctgcaacctacttgttgatgatcagcaccgagaggtgaggacatcagaacaagtcgcttcagaattcagaattcagaattggacttggaaaagaagagaacgcaagaacctgatagtagcagcgcattgcaaccagaacttctgaagagtgaacaccagttatctgaattttaatggtttataaattacttatcacaaaacataaattacttatttgtctcaaagatgtctaatgcaccaaatattttaaatactgaaactctgtaaagttatcagtcaaaaaaaaaaaacctctgaaaaggggcagttctttggagggattggagatttaggagaaactcacacccgtcgctattactgtgattatctgtaaaactatattaaccatacttttagagactttcctctcttgcgatcacaatcaaaatcagaaaaggaacagaagacatcaaatccgtttccttgttaccaaaaactgaaccacatgaccgctgctataggaaggcgatcgatcttcttgtgactagttgtgagttgtgaaccgactctgaagccgactcgtctcgtcgtctgcaacacggcactgaatcggagtcttcgcctagagtatgtatgtaagagagccaaaagcgttgctacctgcagagatccaacgccgcatactcacatcgatcaccatgatggacaagacgagacatgtccctgtgccttgcaacgccctgaagcacggcgccgattcagacaagccggcgctattcagcatctcggagaaaaaggccatcgatgcctacatacccgggatgacgaacagcaacgcctggccgacgcagcagggatggatcctgatccgcgacgacgccaccatgtttctgcagaacccacaggatcctgacgaaaagattcatctgccgcacctaccggaagtcctgcacagcagatgtgcttgcgtgctcgctctccgacaagccgacgatccccggctgcatcgtgctcctcgtcgagcccgaagacaccatcatctggtactgtcacgtcggagaagatgaggagtgggttaggcacgagtacgatattggcacgcagcacttggatccacccatgaatggcaaggactatgagaaagtactgatatgctcgatcgcagcttgccaaggcaagttctacttcaacgccagattccacaacatcagtgtgctggagttcaccccagagccgacgttcagctccatcgcaatcaccgaccccatggattttgtgggcgcagcatgcatattcttggtggagtcggagagcgaactttacatggtatgtcagctgcttgagtacgacttcaagactgtctacgacgtcactgtttataagatggatttctccaagcatcaatggtgcatagccgaggacattggtggccgtacgttcttgatagctccttgttattttggtgcttcacgttcggctgatgagtgtgggctagagaaggattgtgtatatgctatttttgcgcgtgataaatattttgaggtatccaaggtagaggatggagaaactgacgagtatgatctcatcgaagctccaaattcagaaagagggatgtggattttgcccattactgggtagtctagtttcacaattgggaattggactttgttttatcatatatttcacctgtaaagaaacatgttcttaatcagtgtaaccgtagttaaattcgtgtttccaacttaatgagctatatatatatgaaacaatactatcgttcgtgtatcaatcagcatgacaagaatttttgttggaaagaaagggagggtcagtatttctaatgtgtgacacacagaaaatgcaggaatttgataacttaactttgtatactggtttagctagcatcgtttactttgtaagttctgtcaaaagagccaacacttgattatgtggaaacaaatgactacctagcagtgcatgttgccaaagccggccacctgtagatggaattatattttcatgcaaattattagtttttggttccctgaatagttgggtgttcctacgtgatgaacaaagcacaaattactttgtcgatcagcttctgaagaggagcaaaccctgcagatccagcacatgtacttccttcagaattcagataggcctgattaggcccaaaatgggaaaacgtctgtttatgcaagcccaagcccaaaattggaaaaacgtaagcatctggtctctgatttttcatgtcgtgtcaggctgcnattcgtggagcttcaggcagggattcttgtgaccgactcgtaatccaccgtttgtactccgcaacatctgaccttgtgactcgtctgcaaccagctagcaatcccctacataagagaggcttcggttcggttgcagatccaacgaagaggataggagatagatcagccttgatcaccatggacaagacgagccgtgtccccgtgccttgcctcgccctgtacctaaagcatggcgccgacacagacaagccggcgctgttcagcatctcggagaagaaggccatcaatggcggcgacatccccgggctgaccaacaccaactcctgggtgacgtcgcaggggtggatcttagtccgcgacaccgcctccgcaaccacatttttgcagaatcctcgcgatttcgacgataagattcagctaccccatctaccccaggacgtgcacatcagttccacatgtctgctctcctgcaagcccacgatgcctggctgcgtcgttctcctcgttgagccagtcggcactatcatctggtactgtcacattggagacgacgagaagtgggtggaacatgactacgacattggcacgcaggtcttggaccctcccttggatggcaaggaccacgagaaggtgccgatatgctggatcgccgcttgccagggcaagttctacttcaatggcggcttcgaaagcatcggcgtgctggagttctccccctcgccaacattcagctccatcgcaatcatcgaccccatcattggaggattaggggtgatgggcatggcaagcctgtacatggtcgagtccttggatgaactatacatggtttgccaaatgtatgactctgacatgaagaccatctacgatgttactgtttataggatggatttcttgaagcaacaatggtgcatagccgaggacattggtggtcgtgcgttcttggtagcttcatgctattttggtgcttcacgttcagctgatgagtgtgggctggagaaggattgtgtctactctatttttgcgcgcgataagtattttgaggtgtgtaaggtggaggatggagaaactgaagagtatgatctcatcgaagctccagattcacaaggagggatgtggattttgcccgttgaaaaaaagtagagatgaaaactgttcagaactgtaggaaacaatatcatctctatggaaacaacgctaatagaaattagaaaaatcaaatgttatatatagctagaaacaaggaaacgaatcatttctatgaaaatgatacttggtcaattggaatttctgccactgttttcaacctgtagcgtccgttccgtcgtggcgcctagcgggaaaatttaaattctaaaaaccctaattgcgaaaattgtttcttcgcttgcagtcagtctccgcgccattccggatctcgaatccccgatnnnnnnnnnnnnnnnnnnnnnnnnnnnnnnnnnnnnnnnnnnnnnnnnnnnnnnnnnnnnnn

SEQ ID NO: 27408 - DNA, 630 bp, Oryza sativa
  unsure (1)..(630): unsure at all n locations
ctctagaggatccccgatatttactgtactattaatatatggtcccacctgtcatacacacactgtgtcttggagtccgtgctgcagctggctacagatctgtagcccattgctcttctttctcatcttttatctcattaaaatatgtttatagctagctaatagcctgctattgtacctgctcttatgcaaggtggagaattcaaagagcatcactcttaggatgcgttctgagatgctaaaggccaggtttctaataaatggtgtgttttttcaaatactttatatacaaaagtttcttaaaaaattaaataaatttggttgatgcacggcctgccaaatgcatgttttattgtcggtatagcgtattattataccgtcttcgcatttgaattctttacatgtacgtacaattatagctcgaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27409 - DNA, 760 bp, Oryza sativa
  unsure (1)..(760): unsure at all n locations
aatcactttcttctctctctttttatccacctatccccttgtttcattcttgattctgtagagatagtttctttatctttttatctctctcctcattaactttcttgccacatcagatttttacttatgtggcaatatattaaatgctatgaaactagatgacatggagggttaggatggccttagagcaagtttaatagtatagcccactgctaactccaatttatctatagccaatctaataatcaattcatacaatagatatttactgtactattaatatatggtcccacctgtcatacacacactgtgtcttggagtccgtgctgcagctggctacagatctgtagcccattgctcttctttctcatcttttatctcattaaaatatgtttatagctagctaatagcctgctattgtacctgctcttatgcaaggtggagaattcaaagagcatcactcttaggatgcgttctgagatgctaaaggccaggtttctaataaatggtgtgttttttcaaatactttatatacaaaagtttcttaaaaaattaaataaatttggttgatgcacggcctgccaaatgcatgttttattgtcgttatagcgtattattataccgtcttcgcatttgaattctttacatgtacgtacaattatagctcgaattacttcggatctttctagaggcatttaggannnnnnnnnnnnnnnnnnnnnnnnnnnnnnnnnnnnnnnnnnnnnnnnnnnnnnnnnnn

SEQ ID NO: 27410 - DNA, 519 bp, Oryza sativa
  unsure (1)..(519): unsure at all n locations
nnnnnnnnnnnnnnnnnnnnnnnnnnnnnnnnnnnnnnnnnnnnnnnnnnnnnnnatgtcacctgccacaaaccagtgcggcaacttacaggtggcggtctcaagttaattagccagcatcagtatctgatgagcttgttcaactactgaacggtcatctgccatcttgtaatcatagaactgctccattacatacagctcactgccatcgtaaaaaatttcgaacttggcctcaaaagcatcccacatgtccttcccagaaggcatgtgcatgtacacctccactatgttgtcagcgagtacactgatcaatgcttcacgaaacatgcaatccggatcctctaacttagcctcttcctcaggagaaagaggtggttcacttcgtttgccccaatgaaacatataaacactgcattagtggaaccacaatattgcacgtgctctccatctcttatatgtggaaccatcaaaagcatgtggtttcagcgcagcagcatagccaactaccgaaaatgacct

SEQ ID NO: 27411 - DNA, 685 bp, Oryza sativa
aaatcactgcgtgcagcatttgtcatcctactggctattatgaacctacttctcccagtaggttaaacatggataaatattgaggaccaatcgatgacctcagagcacgaacatgatgtaagtcatgatacatttggacttgtgcttgatcataaggagcccctgttcactgcttgttgcaacacctccacgccggtgaagacagtcactgggttaaagtcacactcgtaccgctcgttttcaatggtgtagccattgacaatgcaaaacctcagtgatccaaggttcaccaggtcacggtacacctgagaccagttctccggcagctcaaactccatcccgacatgccgcaccaccggcggaggagagcctgcggcggtggagaggttgtccaagatgcacaggtcaaaggggccgccatccgacatgccgaggcagtggcccagctcagggacatactcggcattgaagggcagcacccaatcacccaccttattccaatctctcgtcaccatgtcaaaggagtaggtcgccgtggtggtagacacgcatatcttggtgctatcgaccaccatgaagcgaggcttaagggggaccttatactctcggtcctgaaagaatggcggctgcgggagtggcccccagcaccaacactcctccacaggatcataggcaagcacctcag

SEQ ID NO: 27412 - DNA, 1134 bp, Oryza sativa
  unsure (1)..(1134): unsure at all n locations
cgtgcgcggtcccgagtgggacccgcttgtcagcggctcggctcaccgtgcgaagggagcacgcggcgcacgcgcgcgggcgggggaggaacncggtgcacacgcgcggtctgcggaggaacggatgcagcgggcccacgcgcagcctcacggcttgcggtggaacgcgcgctcgggaggggctgaccggggtcggcccgtcctgacctcggctgagctggcgccgacgtggcgcctacgtggctgccacgcgggccggcgggaggtagacgacgacgccggccggaacggacggcggacaacagcggcgagcggcggagcgaaccacggcgataccggcgaaagcgagcacaccgggtggttgcacgagataaggggagacgagccaacggctcggattcgccggaggaagcttgacggcggcgaatcgcggcggcggcaaccggcggggagggaagaggaaaacggcgacgaggtcacgaggggccgattcccggcggcgagagcatctacgcggctacgggaatccgatgctagcgtcggattgggcggagctacgccgagcgaggctggcgacgagcgggtgctacggagctcgagcggcgacgacgacgagcacacggcgagcgacggcaacggtcggggcggcgccggctagctacggggaggctactcgtgctaccaccgaaaactaaggggggaagatggagcgaggaggaagaacggagagaggcactaccgtgcgggtcggggcgcagtgacgagaggccgacggcgcgggagtaatctctccggcctcgggccggggaagaggaaggagagggcgcggccgaagtccccttccgcgtccttgctcgtgccggctcctccgacacgcgcaacgacgaacggcgacggcgaaacagagggatggcaatggcgcggtggcggcgagcgaaacgggagggggaatggatgggagggcgccttggtttataggacgacgatgtcggtttgaaaaccgaccttgggcggtcaaggcgcgagctggcactcggcgctcgcggccaagacggtgacagagggagggaggatgacgccggcgggaggaaaaggggaaaaaggagggggagaaaggggcttgcccccttgccg

SEQ ID NO: 27413 - DNA, 757 bp, Oryza sativa
  unsure (1)..(757): unsure at all n locations
nnnnnnnnnnnnnnnnnnnnnnnnnnnnnnnnnnnnnnnnnnnttgtttcgtctcgtctcctagtagattagtgctgttcgattgcctcggcatgatgatttggctaagcctactggaaacaagtgggtttttttgtaacatctgaactgaaccgctgcgttttcggagaatgatcagcactgcaagttcagtgtgttttccggttgaaatcttctgtgcaagcctgggatgggaagattatggaagtgtttcagagttcagacactgcagcttacacggaatggtcagggaaagactaatgaaacagaaatgaaatcccaaatgttcaattgtctattgagatgcagaaattacgcatgttaaattgtttttttagagggcatatgttaaatttgtaggcgggcccctctattttagcttgtattgggccatttgcagatgggccatggacggatgccagctgattcagccaagacggccggcctaatcaccggttcattagaaggaaaaagtccactttaacttccttaaaaataggccgtatctaattcgtaccctcaattgaaaaaccagataagacaactccccaactattgaaactagtgcaatttaactcccttaatggttttgaagggtggttttgctgatgtggtgctgatgtggtggtgctgacctgatcttcatcccatgtagtgcctatgtggcattaaaattaaaaaatatatgagggacccacttgtcattcaaataaaaaaa

SEQ ID NO: 27414 - DNA, 519 bp, Oryza sativa
gccagcgcgcgtgcccgagccgcgccactccatccgccgcgccctcccgttgtttcccgcgcgcgcgtgccgagtggccgaccatctggtcgccgccgccgtcactctctgccgcgccagcccgcgcctatcgcccgtgtcgtcgcgccgctccaaaccgccccgccgtcatcgccgtcgtcatcgcctcggccccgccactccgcacgcaagccgccaagggacggaggccgagccctcctccctctgccgcgacgcccccgctcccctcctcctttttcctaaatcggcaagggggcaagcccctttctccccctcctttttccccttttcctcccgccggcgtcatcctccctccctctgtcaccgtcttggccgcgagcgccgagtgccagctcgcgccttgaccgcccaaggtcggttttcaaaccgacatcgtcgtcctataaaccaaggcgccctcccatccattccccctcccgtttcgctcgccgcccccgcgccattgccatccctctg

SEQ ID NO: 27415 - DNA, 494 bp, Oryza sativa
caaattggtagcatgcatatcctatatatcttttgggttaatttggtagcatttgatccactcttaatctcttttgttaccattaactttattatattctacaattgtcctcctcttatcgcatcctaagctttggctgcgatgagcaggtccggtatgaaccgtccatatccgaacatgtcaccaagatgaaagatgtacggtcatattcgttttggatgaatttcaaacgatttggtttcctaagaattaatttctataaaagccattcaattcattaaatgtagatacagaaaaataaaacaaattccttttctacaatgtgtagagagaaaacataggaaattttccattcactcaaacctcttgaaatatgcatacattcatattctttcaccatttctattcgtaatttctgtgttaaaatttcttcaaaacgaataggccctacatgatttatgagaggaggaagctgaattccaaaccttagagat

SEQ ID NO: 27416 - DNA, 1025 bp, Oryza sativa
atcataaatcccttgccgtacttagttaactgaacaatggcatttcatccaacaacctgcacggttctctgttgcttggttgttgggagctgacgaccaccgtgagaaatacgcttcttgttaacctgtcacttgctcgtgaaaggattgtgttttgatgttgtactcagtagactgatttgtttctgctaagcttaaagaatgttcgtttcagaggaatataaacttcagttcagccttgttttgcttcctcctttctcttgcatttgacatatcctgtacaacactacaacttgactacacaagtccattcgagtatccagctgctgacattcttgatggcactcttttgacctgcgcacaaggctgaatccgagacttagccgcgctcaattgttccactaacatagaaaagctgctcaagctggcataatttagtttctacattattgccattacataatttacagctagattgctagtactatggtacatgctagtatatcacagcgtacatcacaggaaatcccagactggaatggtgtactggctttgatccgtggcttggtgacccagttgaggattgctgctaagaaactgcaatgactggatgtccggaggtggggcctacacgaaaacacggcatgcgacctactattaatttttgttaagcaattttatatgatcaaaaaacaaaggttaattccactacaagaaaagtatcaaatgagatcatgggacagagtgataacaaaaggttgatttaactataacacacctacatgaaaatcttcaagggaaatatgtgtatactcaacgaacacttgtagtcttagcctagtaattgctaatggaatctgtgaaagtgaaatcccttgggaagggaacatgggtgtaagttataacaatcacctgggggatttgtggaccgctatgaaagggtggttgctgtagatgaggttgctggagaggagcaggtgctggttcctgcaactgttttggagttcaaatttgcaagttataag

SEQ ID NO: 27417 - DNA, 10618 bp, Oryza sativa
  unsure (1)..(10618): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacattacgaccgatctgagttaanagccccaatttctttgaatttcatgcgttgataggttgctcctgcattcttcaatccaaagggcatggtgatgtagcagtaggccccaaagggcgtgataaacgaggtcttcaagcagtcggattcttttagtcggatctgatgatatcccgaataacagtccaagaagctgagtaactcgcagccagccgttgagtcaaccacctggtcaatgcgaggtaacccaaaagggtctttgggacaagatttgttgaggtcggtataatcgacacacatgcgccattgctccgtctttttccgaaccaggactgggttagccagccagtcgggatgaaggacttccttaatgaagcctactgctaacagcttggttaattcctccttgatcgcatccttcctgttctgcgcaaaacggcggagtcgttgcttgatgggtttggcgtcttccttgacatgtaaagagtgctcaatcacctctctggggataccaggcatatcggatggtttccacgcaaaaatatctttattattctgaagaaaggtgatgagcgcgctttcctatttacaatctaactcagcgcctattacagcagtcttatcaggatcggagggatctaaggtaatctttttcgtcttggcatcactttcatcggtcttcgtcagcttggttgcaggcacttctccctcgcttgccgtggtcgcagccagttggatctcttcacgggcgagagtaatctcgtgggtttgggccatctcgcaactttctttgtcacatgtgacggcctgcttgatgtcactctgtagtgatatgactcctcgaggaccaggcatcttcatcatcatgtaggtgtagtgtgggacagccataaattcagctaaagccggtcgtccaagtatagcatgatatgctgtctcgaaatcagcgacttcgaaacagacattttctgtgcgaaaattctcctgagtgccaaaggtgactggaagcgtgatctggccgagtggtgtagctgacaatcctgggatgacaccgtggaagggtgcattactcggctttaattccgtgcgaggaatctgcatatcgtccagggtattagcgaaaaggatgttgagtgcactgccaccatcgatgagagtccgtcggagcttgacattgcgaaccactgggtctagtaccagggggtaccgccccgggtggaccactcggtcgggatgatccgagcggtcgaacttgattgcagtctctgaccaccgaagatattggggcgtgttaggctgaaccgcattgatctcccgttctgttagcttctgttttctcttagactcataagccaggggtccgccgaagatgtgattaagttctttgcgatgatcttgaaaaccagtcggggcatcgtcttcatcatcgttcttatttgatgtgccttgatctccgtctgagggcttacgcgcgttcttgacatattgctccgcaaactgtttgtagacgaagcaatctttggccacgtggttggagttgggatgatgcggacattgggagttcattatcttgtcgaaggtgttgacgcgggaacgttgtcgggaaggtggagaggtggtcgccacaagttcttcaggcttacgcttgcgatccttgtggttgttacttccactccctcctgcggtcggcgtgtccttctttggcttccaagtggtgcccgactgtttggacgcggtaatagcatcttcggctttggcatactcgttggcttttttgaacatctgcttaaccgtcctgggaggtttacgtccgaacttgccaactaggtcctcgtggcgaatgcctttagttaaggcggcgatgatgacgtcgtcggtgatgtcggagatcttgttgcgtagttcagagaagcgtcggatgtaatctcgaagggattctccagacttctgaacgacgttgtagagatcgaactgtgtgccggggcgttcaaaggtgccctggaagttggcgatgaagtgatcacgaagttccgcccatgatccgatcgtgccacgaggtagtccgtggagccaggatcgggcggagtccgctagggccacaggtagatagtttgccatggctttgctgtctcctcctgctgcgcggattgcgagtccgtagacggtgagccaagactccggattagtggtgctgtcatacttctcgattccagtcgacttaaagccggctggccaatctactcgacgcaggtcattagtgaaggcagctactccatccacgtcgtcgtcgtagagatttggtgaatggcggtgacctcgtgctgcacggcgctagttgatcgtgtcgcgaaggtcgacgggacgctggtgaggtggagagcgaggccgttcgactcggcgctccctgtgacgttcgagaggcgagtgaacagatcgttcgtcgtgacccctgctcctgcgactagatcctgtgccgatgatgctgaggcttggctgatgataatcatgagatcggaagtgagggactcggctaccagtcggggtgcgggtgcttgcggagttggctggaaccgaggcagcgatcatggtcttcatctggttcaagatgttgacaacatgatcggcttggttgagtgcgtcttccttgaggagggtatcgaggagagtgattgctgcaaccgcgttctgctggggggtgcgaaagaccgctgttccatcgacgtcttgttgcccaatgagctctctcgctcggcgcccagattccaaggcgcgttcccgtcgatcttcagcctcctttgcaatccgttcgcggtcttgttgttcacgctgtagtcgttctcgctcctgtcactgtcgctcttcctccagtcggcgacgttcagcttcttgccgtgcgcgatcttggtccgcttctcgggcttgacgctgttcctccgtttcgttgtcagccatgaatacgccaaagaagaggggtgtgtagttatcctcatagctgtcgtcgaagttgtcgaggtcgccgtggttgtagtggtagcctaaatcgtcgtagtcgaggatctcggttggtcgagaactgacgccgggggagctgaggtagccatccaaatcttccgtcgagactgtcccaagaggttggagtataacgccaacctctctggatctagattggattggggccgaagccggagctcgcctagatcttcaagtgggagatgtcttggcgatgaagacagcggccaaatcatcaggaagtttcatcaggattgagggataggacccgtcgtcttgatccggccgcggaagagtagattggatctcgtccgagtggtttggagccgactcgggagagatgatcttagagtaggcctcggccgagttcagaataccgaatggcacggggacctggtttctccccgactggtttgagtccgagtcatggagagagatcttgccgaagtcgttggtgatgaagttgaggctgccgaaccggaacgcctgcccgggagggaaggcgaagtcgtcgatgccagaaacagaacccatcgcacttagtcggcaaaaacttgacgctacccctacctggcgcgccaactgtcgaaacaagatttcggcaataataaaagggggtggctatcaagctaggaaagtggatgggtttggagacaaggaattttatacaggttcaggccttctcgttcaagaagtaatacactactcctgtccggggatgattccgccgagtatgttattgattgtataaactggaaaaaagaatcgccccccaagaggcacacggaccctccttatataggggaaggagtccgctttacaaaatacagtccatatcctaacggaatatggaattatagataaaatacaatcgtaaccgactaagatcccgggtatttccttgacatacaagtttagaacctaacccgagtcttcatagagatattccatctatatttggtactgtatatccgactaaattacaaccgtcatgtagatatggggtatccataatctccacacttatcaagaagataataataataataataataataataataataataataataataataataataataataataataataataataataataataataataataataataataataataataataataataataataataataataataataataataataataataataataataataataataataataataataataataataataataataataataataataataataataataataataataatagaagtactattgatatcacctcggctagttatgtcatcaaattttccaacaataaagtcactttgaacttgttaaaaaaaaacttgaaataactatgagcccaacactagcttccaggaaggaaggctagctagggatttgcaaggatgtgattcagtggctacaacacccagagtcttccgcacgtgcattgaaggttgaaactaggaagaactgtgcatacgtggcagtggggcccaccacaatgaggaggcggacagtgcggcggttgacctggcccgatgggccatagaaaaatatgaggttcatacttttttttttttgaaattcataatggtagtccctttcaaaggcttgaaaaggagtccctttcaaaaacactgaacattcttcaacacagcctacagcctatggttggtgttttggtcccttcttgtctgttttctctcctgtagacaaagccagattttgctagctactggttatacttataggtgattttaaactgatttagaaattaaagaaggtgaattcatgttattaattgttattatttgaatgactctatgcaatgcaaccagaaaaaaaaaattacatgagttatgtctctgattgtctaagtagtgaccaattttctatttaaaataggggaagactacataagagtggtgtagaggccatttcttttttagttttgtctctcctaaaaaccaaatatattactttaatagaaaccaatataatatatagtagagtaaaaacaaatttaaagagttgtgtaacagtaccacggttttttactgtgtcttcaacaaatgccacattctttaatactctctccgtttcaggttataagacgctttgagtttggccaaagtcaaattactttaagattgactaattttgtagaaaaaagtagtaatatttttaacccaagactagtatattatgaaaatttactcaattatagatttaatgaaactatgctggggttgtgtactattttttctatagagttagtcaaacttagagtagtttgattttgaccaaagtcaaaacgtcttataacctgaaacggagggagtgccttttagtaaattgtgtctccacttgtcaacataagattatcaaagttctgatcgtaggattgagatcctttggcgtgaagttaaaggaatgtgatcactgatatgtgagtatcaccacccataagcctagtgctatatttttttttagataatggaatataatattccggcctttgcttaaaaagaactacagcctattattacaaagatccactccagaagagagtgtagttcaagacaagttgaacacaccaaacaagagaagagaggacccaaattgaaaaatgcaaaacaaaatgtggagctagaaggcctcgtccaggcctatgactaaagttcgaagccaatgcataaaccaatgacaatatccttgcacgaagaggtttctccaaagcggtgcccccaaggaggatgcgacgtggatcgccgccaccgctcgttcggaaccgaagcaaggttttcacccggagaatatggtagggaaaggaaaggggtatgctaaaacaacgcctccaaggaggggaacgacgccaaacggcgtcgccgttgtcagccggccaaatggctcggcaaggctttcgcccgcgattccctgtccaaacccacaccaccaatccgcacaagaaggatcgtcgtcggtcaacaacattgtcccttcagcgattcggccaaggccaccgcccataattgttcccaccgtcgacggcgcgtccgcacctggactcctccttccccgccgccatagagagtgtcaaaatagttgctatatggaagatcaaatgccatagagagtgtcaaaatagttgctgctgaagaaaatgctataaaacattgaacttatttttactcattattgcaattgaattttttatactagcggtattaactaaaatttgtgctctagctgcggctatggtgctgatcattttcaagctgacgccaaacctttagatatacaagagttgaatcttttattggcacatttatatctgatcaaaacctaaattcaactaaaatacctttaaaaatattttagttttgaatggccaaattatttagtgagccgattgctcccttgaaaacgatataacataaccacattcaggaaagtaccattcgtgtgatggtagagtctttgattggcacatgacttaactcaccaagtataaattctgatgctcataaatagagctatatatatgtattgtgaaaataatcaaatgggttatgcaggagtatattacagtcctacggtctgtataggctccgatgagtacagtgcagatggaacaaacacatgaaaaaactacatattggtcctgtcttttcaagggccgtagtgcaagaacatccacagtacactatagacaattagaacatatggttcatgatgccccgtttcatattcatctgctaataatcaagggcttctcgaagaattatgcgtgctttctgattattggtcgcttgctctactgtcaacgatgacaatgcagctgcctgctatactccataatgtttttttatctggcaacaatagcgactcaccacattagtgtgcaatattaattacaatgtcgtcacttaagaggtttctttttttctccggttacacacttttctggttcttaattactaactcgatgttttgcagattaaaacaaataagtcaattacagtactgactgtccttaaccttgtaaattaataatcgcttctgtcattacaaaaaaagaagtcgttagtcgtccattacatacgaattccctcccctaactcaaaggacaaaattgaatgaaaaaaattcagccttatttaatatatctgaaagtgccttaaactacatctcaaaataacaaaaggtatcttaaccaaaaaattcagaccaaaaacacatcgaattccacaataatttgtttttaggagtgtctatacacttcaggcgactgaatttttcaaaaatttccatcactttttctaccacttggatgatgaaaatccaatggttatcattactcaccaactacttattacttatcactctcaatgattgaacaataaaccgttctaacatacaaaaatttacaaaactacatgaaaaacattaacccataaaagtgtacaaagttacatgcaaaaaattcaaattatgtaaaattaaaataaaaccaacaacaaaattgcggttaaaatacgactaaaattataattttttagccgcctgaaaactagcaaatcccttgtctttttagggggaaaaaactcctttcccctgaacagtatctcagtcaaaagaagagatatcatcgatcggctctttgatttcttggcacccttacacccaacgacatggacgtggcatgatcaccaggtagtcaggcaccagcggatggccactgttgaggtgacatgtagcttaattagctagatgcaagtacaactttgagctgctttttctcgcagacaaattaaaaggcataaaaggatagcgtatagtaacaaactatagcttagctttgtacaaattaaaaggcatgatgttgctctgaagattcgtcaagacagcaagaggattcaaaccccatcgatcgatcagtgcatgacttggaccaagctctcatgcatttataaagccatagaagaatacccttttaattgctccatggactccttcacactcatatatatatagctagctttgctccttgcaaagaaaggccaatatctcaagagagctagctagagctccatttacaaccattacaagattgcatcagagaagatatcttcatagataattgttggagcaagaacacaagaaaacacgtaggttcaattataatcgatcgtggagatggtgaccagcaaggagtttgcaagggatcaggcggccatggatcagaagatcaagagcgacgtcggcgaggtggtgctcgccggagacgaggaagaagacggggacgtggtgctcccggggttcaggttccacccgaccgacgaggagctcgtcacgttctacctccggcggaaggtggcgaggaagtctctcagtatagagatcatcaaggagatggacatctacaagcacgatccatgggatctccccagtaagtgcatccccaattaatttgacaaataacctcaaacacaaatcattttcaaaataattgagctaaattctgtgtttgtgtttgaatgaatggaatgattttgtgcagatgcgagcacggtaggtggagagaaggagtggtacttcttctgcctgagagggaggaagtacaggaacagcatcaggcccaacagggtgacgggatccgggttctggaaggcgacggggatcgaccggccgatctactccgccgccgtcaacagcaactccggcgagtcgatcgggctgaagaagtcgctcgtctactaccgcggcagcgccggcaagggcaccaagaccgactggatgatgcacgagttccgcctcccgccggcgatcgccgccgccgacgcctccccgtgcatgcaagaagctgtaagcacgcactcccatgctctcatgctcgttcgttctccttctccatcgtcgtcaaggcctcgtgtactcgatcccatgtacgtaagaagtgcattcgtaatgggagaattacccaaactcagcctggagagagatggagaattacccagactcaacctggacgagagagatgggtcagactagagggatacgagcaaccaaacacaccatatccatatccggttctcctcatctgtgacagatcacaactacgtacaatttgatagtgtggagtacaatatcatctgcaatactttacatcaccaaatcgtcttaatattttttttcaagctaagttcagcagttctttcgagattacaggcctccttttgaacgaagaaattttgcgaaaattctacaaaaattgaactaatccatgtgaaagtcctactgaaattcccacgttttaaaggagtactggacatcctctcacgttctgacgtgtttctagtattctaccgattgccatttctaaccgataagagtacagcctcctaatagcattgacctctaacttgtgcacttctgactgaaaaaaatgcaggaggtctggaccatctgcagaatcttcaagagaagcatcacctacaggaagcagcagcagcagcaggcctggaggccgccggcgacggtgaccgtcaaggccccaccgccgggggactcgagctccaacaccggcagcttcgagtcggacggcggcggcgacgagttcatgaactgcggcctgactccggccatctcccagcagcagcagcacggcggccgtcatcagatgatgagcacgatgagctgcaacggcggctacttcttcaacgacggcatccatcacagccacagccaccacaagcttcatagtcaatggggctccctacaaatggcgccgccggagccgaagccggagccggagcagaagcctctgagctcgccggcgatgacgatcgccttccatcaaaacgaccatggcttccccgccgccgccgcggatttctacaaggatgggtacttggaagagattgcgaggatgatggaggtggctgatccaagtccaacaggattctatgactgtagatattgatcagtaggaacagggtttcagaatagatgctagatatgcagaattcgccgacaagaacagtgccccctttgtgtgagaggctgacatgtagggcccatgctgcagaggctgctatcactattagtcttgtacttttgttttctgatctaatatatacactccagatgggatgtgaactgtcatacaagatacctgattgttacttgtgtacttgtgtctgtgatgaactgctggctatatgcatactacacctgtttcannnnnnnnnnnnnnnnnnnnnnnnnnnnnnnnnnnnnnnnnnnnnnnnnnnnnnn

SEQ ID NO: 27418 - DNA, 5911 bp, Oryza sativa
  unsure (1)..(5911): unsure at all n locations
atttgtacaaggatgggtcttggaacagattgcgaggatgatggaggtggctgatccaagtccaacaggattctatgactgtagatattgatcagtaggaacagggtttcagaatagatgctagatatgcagaattcgccgacaagaacagtgccccctttgtgtgagaggctgacatgtagggcccatgctgcagaggctgctatcactattagtcttgtacttttgttttctgatctaatatatacactccagatgggatgtgaactgtcatacaagatacctgattgttacttgtgtacttgtgtctgtgatgaactgctggctatatgcatactacacctgtttcaaaatataagtgatattggctatacaattcatagataatatctcttagattttgagatggaggtaatatctcttagtacttaatgaatcattttttggggtgatcatgacgaatgatgttattgcaacagcaatgtgcaactccctttgtaacttacccatctcactcaggtgtacataggcaactactgtcaatggttaaataaaagttggctaaggagaatagctgtaactctggtaacatactcaagaatcaattcaaaggtaataacataagtgctttgtcactgagatttgattaaattcacacaagtcattcaaagctgcacacgtatgcgcagacataaccatctgcaacttgcgtgcgacgtagacatttgatctggtgtaaagatttgtcatcagtggacaaaatgttgttataagttgtagaattgcacataaacaaatcatggatcattttcagaatttcttgtgctgactcctaatttgactcttccagcaccctagaggggatcaactggattactatcaagctggtgtccaggtgattcaattcaatgtatctgaatcacctgatgagtgacagggggtgaaactgtaaaaaattccataagaaatccttttcaggtcacctctatgaacagttgtgcgaaaaagatgtgtacaaccattctggatgctgaatgtgacttcccggaaaattatatcaccatcttgaagctaaaatggcactaagagccataccacatgaacagaaaacatccagccatacgaaatatttatgtgtgatatttaatgtgttaggataaccatggaagcggacaaccagaatttgtggcttctctgaccaaggaaactagagttgtgtttagatgtaaagttaataaaatggtttgagctagcagtgatagactagaaacagtccaaaacagaaccaacagaattggtgacacaatggtaaaaagacaaatttgtattgagcaaaggcaccatcgaatatactccctccgtttcaaaatgtttgacaccgttgattttctaacacatgtttgaccgttcgtcttattcaaaaaaatttgtgaaatatgtaaaactatatgtgtacatgaaagtatatttaacaatgaatcaaatgatatgaaaagaataaataattacttaaattttttgaataagacgaatggtcaaacacatactaaaaaatcaacagtgtcaaacattttgaaacgaatggagtagtacacagcaggataaaaaagttgtttgattctgtttgcatctattctgaagacaaacaggtatgtgtgttcatttatctatgatgtgccgcatatgacaaataatcagctggaataaaacatgaatatataacaggaaatatcagaaaccaccccgcaatttacactaaaaagaaccactgcaaaaggagagaaatatgattcagcagtagcagcatagttcagaatgtcacacctcagctatatttgaaatcagcaatgctgatttttcttaaaatacaattgtcttaatacaaagaaattgacagaaacatcatttctggggactacctagtaggctagtacctgctggaggacagcagagggaagcaggactgtgcaaaacacaccaattaggaagatggcagcggaaaaccataccataccagaagcttaagtacctcttggtggatgaatatatcatgtaatagcagcgacacataggtagttagaagtagatgcggcagtatcattttcctctccttccagcccagaaagctgagatgtgtttccactagagcattttctgccaaaatcatcaaatgagaaagaaaatcgcaccacacaaccatgtggataaaatagtacgatcaccatgtaatttaatataaaacgaaaggaaattcgaacctttgtgaaagcaatttctcatcagataaagccttctcaagcctctcctcgaatggtgttgcgtgccaactcaccttttgatcctaattatgtaacaaactatagataagctatttttatatgtacatatgagaaagtaagagaagcagaagcagactttacttctttgtatttgtttgttgagttgggaatgccatttccatcccaccatttaggagtgaaagtatctggttctgtgtctctccagtgagcagcgaccaatccaataataggcctatcttcttctgaactcttagcagaatgagatctgtcacttgtcaagggctcatccctgaacacctttggatttggaggctttaaccactgtgacaagcttgggaattcaacctcagaatcatttcctttgagcaccttctttctgctggaatgaactagcggctcacttttaagacatttctccacagattctgtgcttgaattctctcttctcttattacaggatgatactgaaccctcagaactctggaatagggaacattcattagatattgaaagttcaacagaaaccaaactgtcattctttgcatacttgaaatcctcatctgatatattgggctgacaggattctagtctcaatttttcacagcttccagaggcctcaacagaactcacagcttcatatgtatgctctgaacaagtcctagtattgttctcatttctcagctcttcctggtcaggtgcatgagttgtagctggtgtctgtatctcagcagtcgcttctgaaggagttgaaatgggtaaagatttggattcaaccaggttgatatcatccctacatgtgaaagacggtgaatctaaggcggttaacttgttcccacagttgattgcactgtcatcattgcccacaacctcaacttctatgctcttgcacacagcttcagaatcattctggtttgatgcatcgcactctttccaagaagaactgtcatagttaagcagaaccatcgaaatattaaattaatctattcagtcattgcagcaaaaaggaagccaccagcctcatcagaagttggtaacaggatgaaggcattggcattagtagcgaatagcacaaggttggcatacctcatagcatcaggtaaaatggagctctgatgagaccctgatggagtttggcaagcctcagccttcagcccttccatgaattgtaagtcatcagaaatggcaggaagacatgtcaaatgtgtttgactttggtcagtattttctggcccttttatgatttcatttgtagtttccaccaatgcatcacggtgtatgagcaaacggacctgttgacaccggtgaaagtcagtctgtctaccaaaatcaaacctactggaaaaggaataacaaataaaaaaatcgttattacacctccactctgtaatctgtattgcctaatgtacagcaacaaattcaaattctcatgtagataggttgggtatgacctatgaacagcatcgtacattcaagaccaatggaacaggttgttattccaatttagaaacacaactggtcgcacaattctaacagataaacaacagccacaagggtcaagggatatattagttctttttgaggttagagtaacatgtaagtatctaccacctagagaacaatgctccttcatcattgttgttttatagaaaaatgacgaatataatatagttaaccgatcaaaaggtccttggttgactacgaatcacagtggggatactagttgtcagtcatccaaattctggctcaagtggcatgatacttgagtgagattttcaaaagggcgaagaactagtcatgataaataatgggaagaaattagcggtgaatcggtatgcggaatcggaatacctcgttcttgtgctcctgatccaccttcgtcctctcagtgatcccgttcgctcccaagctcgtactatgctcaaccctcgacccctcatcttcacccaacaaaaaaaatccaaacaaacccaaaaaaagaaaaaagatcagcacgaataaatgacaaaatcgctacatcacaatccagaaatgatcgcgataataagttcaaagagaggcgcaaaaagggaaaaaaaaactctccagaaatgtaccttctcgcaagaatacagcggagagcgcgttcttggacggcggcctcttcctctccccgacctgcctcaccacgaaacacaacacaaacaatcaacccaaaatccgaaatcgaagcaccccgcaacacaccccccaccaacagcttccccgccgccgccgcataccttgggagcgtccaccggcggcgaaacggagggagacgaaaccagctggtcgcgttcacgttcgcgtcgcccctcgccgctgtacccggccacccggaagcagccgagcagccaccccatcatcctccccctcctcctcaccgcgatgccgccgccgccgccgccctcccccgagaagccgagccgtgggcgcggggcgaagctttcatccgcctcgaggaggaggaggagcagcaactgcgccccaagtggcaggcaggaggaggaggcgaaggtttaagcaggaggaggtggtggggatttgaaatttaaaatcgaggcggaggaggcggcggcgagggaaaagaaaaacgaggcctgcggagtttgcgacgaccgcgtgagcctttttcaggggctttttctttaaaattggaaatgaatgattaacacaagatggggtttatcactttatctctctcttttttctctctctctctctctcactggatgggagcgattttagggggtaataaagtgttgcttgtgaaatggattattatgaaattatgattggtgttaattttgccaatatagtggctcaaatacgatatagggggaaataattgggaatgaactgtgtgtggaaggttctagatgttctcaaaagtatcagcgcgagttgcgaaatctcaagatgaaatttagtttgattggaattttttttgttctttttacttcttgtattgtgttttatacttttattgctctctgtatgcttgcttgggtcccaatcacagactagactactccctccatccaaaaaaaaaagacaaaccctgatttccgtacccaacgtttgaccgtccgttttatttaaaaaattatgaaaaaaattaaaaagacaagtcacgcataaaatattaatcatgttttatcatctaacaacaatgaaaatacgaattataaaaaaatttcatataagacggaccgtcaaagttgaacacggaaactcagggtttgacctttttttttggacggagggagtacactttttcaggtttcagtagataaatgcctttgtttggactagtgtcaaactctactagtacttcctttcaaaaaaaaaaaaaaaactctactagtactagtctttttccatctaggaatatgcagcagttcattctagaattgcgttggaattgacctgaaaatttcgataagggtgcaggaaaggtactacagtttaaatttaccccaagattggatgattatcttttgcaaatgaaaaaagtacaccgcaaaaccggatacaacannnnnnnnnnnnnnnnnnnnnnnnnnnnnnnnnnnnnnnnnnnnnnnnnnnnnnnn

SEQ ID NO: 27419 - DNA, 2110 bp, Oryza sativa
cgaaatctcaagatgaaatttagtttgattggaattttttttgttctttttacttcttgtattgtgttttatacttttattgctctctgtatgcttgcttgggtcccaatcacagactagactactccctccatccaaaaaaaaaagacaaaccctgatttccgtacccaacgtttgaccgtccgttttatttaaaaaattatgaaaaaaattaaaaagacaagtcacgcataaaatattaatcatgttttatcatctaacaacaatgaaaatacgaattataaaaaaatttcatataagacggaccgtcaaagttgaacacggaaactcagggtttgacctttttttttggacggagggagtacactttttcaggtttcagtagataaatgcctttgtttggactagtgtcaaactctactagtacttcctttcaaaaaaaaaaaaaaaactctactagtactagtctttttccatctaggaatatgcagcagttcattctagaattgcgttggaattgacctgaaaatttcgataagggtgcaggaaaggtactacagtttaaatttaccccaagattggatgattatcttttgcaaatgaaaaaagtacaccgcaaaaccggatacaacacatccctcaacttataaaaccgtacgaactaagtcttttgacaccgattttatctggcggctgagtcagcataggacccacgttggtcccacatgtcaggatgccacgtcggcaaggcagcctctcccttcttcctctcctttcctcctccccccccccaccccccctttttttttttctctctcccccactcttctctctggactgggtaggccggcagactagttttgccggtcactcccgaccctagcctcgccgcccactcgcgccgcagccgcaggcacccctcctcctccacaagtagcagatggcgtctcgtcctcctgccaccgcgcgcgcgttccgagagtccagggcggcgttcgatcgattgatttgatttggtccggtgaggcgacgccattgttgcgaccaagaaaccgtggacgcgtggttgtggaacgcggcgtggcgagatgtaggccgtggtggcggccacttctagagcctgggtggcctccccgcggcggcggcatgtcgcctcgtgttcttcttccccgatgacgacgactctgtcgtctctcaatcgatgcacggtcgccggcgtgctgccgctcggcattcgcggcgggcgcatgctgctcgcgcccccacttctgtggaacagcggcgccgcgacgaggaagatggcggtggcgacggccgcggcggcctcgccaccggcggaaggtggcgggaaggcggacggcagcgccgtcgccggcggcgtttcgcggacgatgcagctcggagccatgatcctcgtctggtacctcctcaacatctatttcaacatcttcaacaagctggtctgcacgggcatccctcctgaagcaccggtgcgccgccgccgcgtcgccgcacttcgtgtacatgtcaaccagcgcgttccacgcgacgaaacccagagcaaccttcctttccgcgacgcgccggtgcgcctcccgacccagcgcaaggtctccaatttgcgtgcacgccgagaacgcgacggcggcggcggcgacgatgtcgatgcacacgccactatcatccgccatggcgaagaaaagcaccacagcctcgtcaagaacccgtgcctcgcgtggcttgtcaccatggccgtacaagaaacgagcgcccacgcggaggcgagctcgccgtgtgcgaggtagagctcgacgagcccattgcggacggcggtcgaggccgagctcggccgcgcgtgcctgcacggctggcaccgttctcgctgctgcggcggcggcggcgacgacggtagcggtaatggataaggcgctcggtggcagggcgaggagcggcgaggtcgacgatggccgccgcccacggcgaggtccccgtggaggcggtggtggccgacgcatggaggaagcggagcggagcctgagcgggcaagaggtggttgggcttctcgtcggaggtgtgggttcctaggatgaggcggtgggagcgggtggag

SEQ ID NO: 27420 - DNA, 18278 bp, Oryza sativa
gccgccgccgcctcttcgctcgccgccacgtcgccggccgccggacgtcctcctttcccacgtcgctccggcgacctcttccccacccgccggccggctttgccacttaccgctggatagggatgatgacgtggaggaagggagaggaggggaaagaggtaaggatgatgacgtggcacgctgacatgtggggcccatgtgggtctcactaaaactaggtttaaaacctaaggatctcgggtgcactttttcctttgcaaatttcccttttcctgtactccacatgaaatggcgctaatgcttgtgctaagccggcccatatactatctgcagttgggccatactagctgtggaggggtttccggcccatatactgcctgcctagtactctcacaatcacaaaacacaagaaatttcatttgctcctctggaatctcaaatgccaaaggttcaaaggtatagttcgtgcctctgaagtctgaaccctccatcatctagaatgtgaggcgaaggttcaaattcagtcttcagatatgattgcttgtttcaattactagctagctgcagctaatcctaactcaatctaacagaaatagatgcacttggactacaattcctttattaccatcatcatacacaacaaccaatattcccttcaagacatacagatacaggtggatgagcagcattctgatcctatgatcattttaacatatgctcacaaacagctatggacgtatactacaatctgaatataaatcaactatggacaaaagcttgtgaagcagcgcaaaacggaggtaaggtcgcacctttgttacctcggtcactttactatatctttgaggagcatgtgtggaattagatctctgtggcttgagctgctcgcgatcccgctagggctcgttactacgtctggtgtggtttgatattcccaggtttccatcctagttcacgagctctttcttcccacaaagcagtcagtttcctttgttcaaccaatgcttctgatgatttttcccgggcttcttcacatgtatccatacctgaactgcatttgtcagcctccttttgatattgtgaagctaattttttcgcctccagcaattttacatctgcttgctgctgagcttgtgttgcctcttcttctctctgcttcagttcttctatgagtagctccgtgaaactcttctctgtttcttcaccagacgcacggctcttaacatccttgaattgtttggaacagtctgcaaatatcaaaagtaaccacaatcagtgaaactgcagcctctaaacaactgcaaaacatgtctataaaagataaatttcaaaaggtgattgtcatgtttattgcaagcttagatcaaatgaggtaacaatgttcattgtcaagataatgattcagggaagaattagagttgctacgatagaggctaaggtcactgaaacaattctcatgaggctgtgtttggcacagcaagttcccatctcctcccctcgttttccgcgcgcacgcttttcaaactgctaaacggtgcgttttttgcaaaaaaaaagtttctatacgaaagttgcttaaaaaatcatattgacccatttttgaaaaaaaaagctaatacttaattaataacgtgctaatggaccgctccgttttccgtgtgtagaagattggttcctatctagcccaagcgaactcagcctgttaagcctccaattctttttggactttgttatttcatactactactaggtattatgaatgagcagctaaagagtttcaaacatttgttatttcatcaagaatactcacaaaagtattaaacctttcatttgttagaggagaaacctaaaagagcactacaaaactattcttccttgtcattcatcatagcccgaatcgatgtaggagaaaaggtaaacacatcacaaaatatttcctttcgtaagcaacggcagtccatctgacgcttgtaaaaaatcataacactacaacagcagaagcaacgaaacaggtagggattggctcacgttgatcattaagtaacaatcttgtataacaaactaacacccatagtaacaaagtagtatccttttttagcatacccacgagctatatgttcaattcaatcttgtccagcatccaactttctttccaccactaaaatctaattgagctcctaagtaactccaaaattattttctccctcagttttcagcaaaatcttaaagttaagtggaacagattctgccaaacaatcactaattcagccatcacaagcccaacacaatttttttttcagacaaggaacgctaaactcaacaacatagagaagctacagatctccgaatctacacgctcatatcgtgctacttggttgccaacctatcatcaactaaactaaattcctttgcgacatgtcaatagcaaaatgtaaagctactacaagaagccgcgatgctaagctctgaatactaaagaaaagaaggaaagcacaaaaaaaaaggaatagagatatcggatccgagcagcgggcgggtaatggctggatgaatgagctcccgcatgtcaacaagatctgggaggagagtgagcaccgacacggaccttcggggagcgcgagcagcgggcgggcgtcgcagtcgcagtcgcacgcgggacacgcccccgtggagcggccgagcgcctcgctggcgtgccagtagagctgcgggccgacgatgtaggcggcgaggccgagccccagcagcgccaccaccgcggtcaccagagccgggctggggccccacgacgaggaggaggaggttgagccgcccgccatcgccgacgccgcgcgcgcgcgcgaggatggctgctgctggtatacagttgggtgtctcggcggaggggaggcggcggcgcggggaggttaaaggagtaggagtgtggggggagtggagatggaccggacgcggtcggtggaggtgggatgggagtgtggaagtggagagtgcagacgggcccgaacacgatatgagatgggatgggatcgtgggatggtggtgggttcggcggcagccggcctggacgaacgcagttgtgagttgtgtttgaccaagtcagccaaacaggtaacagggtccaaggtttaagcaaaaagcacaccgaattccgcggaaaatgagtggttttttatgctctcaagtctcaatgtcttggttaccctcaacctattcgggactataacataagtataagttatgatttgtttgcgcaaggatggctaagaaattcttcctccggattaataatatttatcgttttggataagagtacgatcttaaaaaaaaaagtaactttaacaactatttcctattataatatacatagaaatatcaacaaatatatagttttcttgaagtatttttttagaaattatttatagtcaactattttaaagtttgactttacccttattcgaaacggctgatattatcagctcggagggagtagttggtcacaagtgtgacatgttagctctaaattcgagattgtgatgtatgagtcccaagggtaagaaagtgtggtatgatacagttgtggtagcgaaataaacacatgcctgagaaaatgtagcatgactaaaatgtgacgtagtaaaatgaagcaatcaaccagacaccctctaatcgtgcacgtgcaatagacgtatccgcataacacatcacacgagacataaatccatttaaaatttattgtgctttttcacaatataaatcacacatgaaaaggaaatttttataaaagaacgataacaacaagcagtcaaagtgagatatgttgtaactgcagcttcatggtgagatcataagctcaaagtgttgttgtgactaggggatgcaactggtatggatacttttcgtctgtttagacttttttcgattcaaatttttttatcggaaacaaaaacgaatataataataacactatcggccggtcggaatcagaaaacactctatgtgggaccaggacatatattactattatagagctagttatatgccattcttatttagaaaatatcgtgtaaatataccatgtgacatggattatatatactgctatccagttcatcgctcaattttctacacacctttactatgacaaatttcatagacaattcattcttatgtctatgctcttatgctaacatcgaggtttcgcagtctcgacgaaatctgaatggattctgttaatttcgaatattttgaggcggctcgaaatatgcatctgataacagttttatgtgaaaatagtagaaattcgttcagaattaacaaaaaatatgaatgtctctattgggctcgaaactcacttgccaatctcgaaaacctggttaacatgcgtggaacttgggagtagattttcgacacgctaaggctctctttggcacaactcctaattcaagaatttttttagctgagaatttctggcttcataaagccatggatatccacgattgcgttgataatattttagactaatgtttctattttaggtaaaatttaaaaattttaaactactataatttagtaacatataaattttaaatcaaacacaaataagatatctatacgccatagctatatggtgaatggtcctaggcttcaacgcggcttaggctgtgtttggatccaaactttcaactttttccatcacatcaacccgtcatacacataacttttcagtcacatcgtactaatttcaaccaaaacttataactttggacacagccttggaccgtttcatcgttgccagatcaccactcgtcgatctctatgcaagtggaccccctatcctcaaaacacccgtaaaaaaaaatccaaaatcaattgaggaaaaagaggatcgcgccggccgatacctccatcgtctccaaaaactccaaacccccgcttgaaacccacgacgacgaccaccaccaccaccacggatcattccgccgccgccgtcgccgccgcgcgcctcccctccagtcaacgctagaacccgccctcgacctgccatggacccatctcccggcctccagcgccggcccgcggcggccgcggccgcggcggtgaggggggaaggcgcggagcctccccgcgggcagcgcgtcctccacggggacatcgacccgccccccagggcgcggccggcggtgcagaagctggccatcgccgccatcgtggtgctcgggtgcctccagttcctccccgccacccactttcgcgaccccgccgatccccagcggaactggatccccttcgaccgctcgcgcaagccggtggtatggatacgatacgatacgatacggccgctgctgcgcttcaccccccccccccctactgcctctctcactctcgcttcatatagctctactcttttgtccattaatttttgccatgtttgagctccgggagtaccatttctggaatggtgatacaccagttacattatcatgctcaggctgttacattttcacggtgtaatggaatattttcttttaatatgcctttttcccccttatcctggaggtgaaaattgggtttgatattgaaatgcgaaatgtgtgaacaagacatttttggtacttcctccgtccccctaatataagagattttggcatttgcttgcactgtttgactattcgtcttattaaaaaatttagaattattatttattttatttgtgacttactttattatccaaagtactttaagcacaactttttgttttttatatttacacaaattttttgaataagacgagtggtcaaacagtgcaagcaaaatgtcaaaatccgttatatttggggacggagggagtagttggtggcagcgtgacttaaactgggattgctgtgtcatgctagatatctcaggagacggtattgttttggtcagagttaggggaaaagacaaatttcttgatgtactgatggttccttttgcaggatttgcccgatgaggttggaagcgttaatgtcttttcttggataagctgtctggatcttcggactcttgctgtgctgacaaattccaccatatccagctcaaggttctgtttgatttcagcatttgtaactaatgcatatttcaaataactatagtgatagcaaaaggataaactcttttgctattggatattattattcagtgttcatttgcactgttaatgatatggaactaatgacgaaatctgttttcattctcaagtttttgttttctgatgtaattgtctttgtttaacagtgatccccataacatatccttcaatttcttaatacctgaaagaggcacagataaatcgccctactacaagctaaaagcagtactgcctgattcgaatgttactgttgctaggtgagggggaaaaaaactaaaactctacttttatcctgggcattgttgcaccctgattcctgtttcgttacattacagtcaaaagaaaattgaggacaagctaaacgttgccactccagaaggaaacctcttttggtcattccccaatgaattgtcacccatcattattggaacgactcaattctcgcaaaagagatatgtctatatctcagcggactcaattgtaaaggtacttacacttctctatatgtgatcatttactcaaacctgtcattgagttctctgaaaaaattaataattgaagtattgaacctgtataaactatcatgcgagcattagtgccagggacagttccatgcaattgctgatctaattgcttgttcacctttttcaatcatttcaacttgtgatagtgaaccataattctgatttttatgtggaatacattgaatacaaatctaccaagtttcttcaaagacatcactttgcttggctagcattatcagaagttttttttataaaaaaagtcaagagtatggaactaaatctgtgattccatgactggtgcaacagttgcttcaaatagtcaattaggaaacaaaaccctgcatatgtaagtgagtagtaattgagtatattgccatggctgtgttctttgatgaaggacatagaagcttttgagcattgaaatgttgtgtatccaactcaaacatacaaaaaccatacatatgtttgggttaacttatgttaatcgtcaatctcctcccagggaaaaattgaagatcttggtcgcatcgatttaggcacttatgctattgctgctgttgaagattgtaccaagcgcattggtgactatgttagtatagatgttctgaatgccgttcagaaaacagctccgaaaaatttggtgtataccgaaccttatgacaaggatgcatgcttacttgattttgatgtgcttgtggtggagccacgcaaactacggaaggaccttattgattctatcatggtgtggttcagggctttcagtctagccaatccaaggtcagtgactcacattctgtattgggcaacatccaccattgccagatcaccatgcactcaaactcattcaaatagcgcactgtttgtctgtggactttccatttttcagggatcaaattaggttggcaataacattggccttgtatgacaattatctgaagctcccttccaattggaagcgcgcagatgctaactcagacatactgaactacaacgggccaaagaatgtttgctctgaaggtggacgtcagcttcaagaagaaggcaatggcgatgagtggcaactgtaccttgatcagaaatcccttgccgtacttagttaactgaacaatggcatttcatccaacaacctgcacggttctctgttgcttggttgttgggagctgacgaccaccgtgagaaatacgcttcttgttaacctgtcacttgctcgtgaaaggattgtgttttgatgttgtactcagtagactgatttgtttctgctaagcttaaagaatgttcgtttcagaggaatataaacttcagttcagccttgttttgcttcctcctttctcttgcatttgacatatcctgtacaacactacaacttgactacacaagtccattcgagtatccagctgctgacattcttgatggcactcttttgacctgcgcacaaggctgaatccgagacttagccgcgctcaattgttccactaacatagaaaagctgctcaagctggcataatttagtttctacattattgccattacataatttacagctagattgctagtactatggtacatgctagtatatcacagcgtacatcacaggaaatcccagactggaatggtgtactggctttgatccgtggcttggtgacccagttgaggattgctgctaagaaactgcaatgactggatgtccggaggtggggcctacacgaaaacacggcatgcgacctactattaatttttgttaagcaattttatatgatcaaaaaacaaaggttaattccactacaagaaaagtatcaaatgagatcatgggacagagtgataacaaaaggttgatttaactataacacacctacatgaaaatcttcaagggaaatatgtgtatactcaacgaacacttgtagtcttagcctagtaattgctaatggaatctgtgaaagtgaaatcccttgggaagggaacatgggtgtaagttataacaatcacctgggggatttgtggaccgctatgaaagggtggttgctgtagatgaggttgctggagaggagcaggtgctggttcctgcaactgttttggagttcaaatttgcaagttataagaagaacaaaattgacacttctcttcagccattcatcaatgtagtcaatgctccaattacctgcccaaatggtgatatgccaggaaatccctgaagagagctaagtccgaattgctgtgcaatatacggtgcctgtatatgtgaagcaacaatattcagtacatgggtcatacagagttcaactacaaactacagttatcaccgtctgcactctgttcatcaaaactggggtttaggactggagaaagcagaaagcaaatataaatgttacctgcattatatggcttgttgcaagaaattgactggttggagttctcagatgatttggaatgtcatttgatattgtaggaggatcaaccctaagcggaacttcagcctcctcaggctccggtagacctacaacattttaataagatcaatccttgatctatataaaatctagttctgaagaagcttggatgaagaacaaaccttgtctaccctttttcttcttatttgattgaagaggactttgctgctgccgacgcgtatctacatttttaattttcttactacttactctgcgagtttcactgttgctggcttcattcggaaacaaatttggctgttgaactttcagtatagtgctcaatgaagatttatcatgtaactttgcttgcaatagaagttcaacttgctctataaactgatcacattggctctccatgtatgtataagcttcaatattttcggcagcttttgctgcaattttgtagaacgttcgatacaacatgctgtatcgtttagacaacaagaacctgggatcttcatctacagcttcaaaaccatagttctccctcggagattcactctgagcatcctttctccatcttttcaaaatgtagtgtggtggaagttctttaatatttcttacctcaagaactttcagtacatggcaacatggaatacctgtgaattcaaatttcttacagctacaaacaaccatacattctgatgagtcaaatctaacaaaatggtcacggggcctgtttttgacagttacctcatactcagatattggtccaatctcaccacagcaataagccatgcaagtcaaggtcagttcaaattccaacctgaacatctcaaaaagtgtaggagtatatgcattagcagcttgccaaagcatccgcagaggtgctactctctgtgccatttgaaccccaaggtagtcagcttgttgttcagctaggcgtttgttctccaaaagtttgtcataattgttaaagaaggatgggaaatccgtttctttctttagaagatctgccagtatagcatcagtgttattatcacttcggagtgcggctgcaatatctgcacagaatgaatcacgtccataaggtaaagcccatctttctctatctgcatacaatttacctagccactcattgtcctttagattgtacttatctgagaggatttcccagcttgacaagaaatccccctcctcctcatagccatacaaccacatgctaaaatcgtctgcaaaagtttccgaggcttggaaggcatcccttaatatcttagtggcatttttatataaatgaatcagtgaaaagcgctgggtggtccttggccaaacagaagcaactgcttcactgattgctgtagattgatcgatcataactgtttttggttgcttgccactcattgcagatttgaaagtttcaaacaaccatttgaaggattcaactgattcatcataaaccaatgctgcaccaaatatgactggctgcttatgatggttaacaccaataaacaacaatagaggcctactatgatcacttgtgctatatcttgtgtcaacacacagtacatcaccaaagtagtggtaatccagaatcgacttaacatctgcccagaatacatttgtcaactggtcatcttcatccacttggatggcataaaagaaagaaggatgttcacctttcttcctctgcaaatattcataaattgcctgggtatcacctaattgcatatcttttgtgtgccttgtccttacataatttttataatcatttggtatcaaaacaactcttggtggatctggaggctgctgtaactttgctaataacttatgtgatctcagaacctggatgtccaccaaaggagtttcaagatcatgattatgatcagccacatactcagtcactacatatttgccactcacagtgattttaatagtcatgtgtgccagacaaccagttcttgtttctggccgtggcttcttgggatcagtactgacacttttagagcggaatccctctttagaacagacatatgcccgagattttgtagtatttgttgctgttttttccaaccatccttttcggacgctgaaccccacagttccagcataggtgacatagcagtcataggccttgtcttcattcaggaaaaccattccaacttttggttctcctccaggtccagcaactacttccatttctggatctggttctccttcaattatttcatcttctttactctcaccctggaccaaagaaaacaactgtatgtgttaaagcaatgaggaatcgaatataaagaagtggttcatttggaatttttttggggttcattaggaattaataatgtaaagtttaaagtataagccattgttcccttttgttacccaatcaaaaataagacggaggacacaaacaattagcttcaatgcagcattgcagagaaaaaacttttcaaataaacatacatcatttcacaagtgggtcttaccttatcttcttttttgagattttgcttttcaagacgtttagagcgcctttccgaaggttgctgcagtggttgccaattcatgaatataagaaaatacaacaagatggcataaatgaaatatctatgtggaaccaatatagaattaatgtatagtttgtgcagcagatgccaagaagtgtcacagaatacacagtttgttttgatattaaccccagagaagtgaacaattacattggtatgcaataaaagatttgtgtattgctaataattcctagttcagtaacaaacacaaactgtgcaaactacaaatgaagtgatagtgcattctttcaaaaaaaaaaaggaaatttatatgccagtttgcaagtgagtatatcaagtgcagtgagttgtaaactgagttgtgtgacctctaacttctgaggtactaactgctagataccagatgtgtactattttggctcttctcattggctaattaatcacgtactaaaatggaaaaaaaatacaaacagagcatcagcaatatccattagtaacatggaagggaagttaccgtcagtccttcgcttgacagaaatctacctccatcaccacgttttcgtctttcagccaaagcttgatgtgaggcgatctgaaaacgacaagcatatacttaccaagtgaaactagttaaccgatgtgcatgtaccaactactgttggtatatatccagacaattcaacacttgtagcacatgcttatgtgttgacatttctagcacaaatgtatatatcctcacatgcttttgttgaaatttgaaaaactatctgaaatccttaaatatgatcaaccttgcatgcatcacgtatgaaaatgtgtgtgcatgacctagcgacataaatatcttatattgcctgggcacaatggtcagcttccaatcactacaagaaaaatgacagcatatatttctatccaaagctatatattgttcctgatttccagttgtgggctacagcgctttgtcgctttcctatttggatcactatccagttgagcgactgctaatcattttgagacaacattgagttcaaaactcttgacatatatatatgctcatttgcataaataaagcatagctacctgtgcagcttctattaagtgtgtgactagtacaaaaaaataacttccttccctttctatgttaaaagacatgacgaccagtaaaatgtcacgtatcaagcttcttactttccatcttatcagtgttcagtggtgcctacatacattcaaatctaccccctcagtaatttatattcatctttgtcacagctaataactaactccaaatattttaccttggcaggccttgccgaaacaggtctgctctgtcgctttgagaggtacttactaactatcttcttcctctcctcattagtgtactgtgatgccctcaaaccgagttccctcagcacacgtgcctgcagggcattgccctcggcatctgctttcctcggccttcccctccctctcttttcctgcacttccacttgtacctcctcttccatttcctcctccccttcccctttctgctcctcaacatcatcaccatcttgcgccaccacctcgtcctccttttcggcctccaattcgacaacaggcttctcatccttctctgtaacatcctttttagtcctacccctcttagaacccctcatcttgcgcgcctcttgcccgttatttgggactgctgtcccgacacccttctccgcagagctctccacttcgatcacctctgagttatttttcacagggttgggattcctcttattattggcgcccctcttcctcttgcctgcagcaccatcctgcacctcctcctctttcaactcatccaaaccatttgccttgttcctccgattggcgtaatttcctctggagcagaggaacctctgcatgatcatgacgccattaccaaccgatcggcgattggagcccgtgcgcgccttgaaccccaccctctcgccgtatccgtagtagaaccccttggcggcgtgcacggattcgaactccatccccatcaccggcaccgccgcggccacctccccctccccctccccgcacggcgccacctccacctcgtggttgtgctccaccaccagcttcgacaccctccacttccccccgaccgcgtccttcttcaccacctccatcatcgccctgcacctctcctccacccccacccccacccccacccccgccgccgacgaaggcgctgcctcctcctcctcctcctcctcatcagcatcagcagcgtccccgccctgacggagcgaggggtccgcgtccgcggcggcggaggcggcggcgtggtcagccatgagcggggggggcgaggcgaggctagggttgggggggatttgaaatggcgcggggatttgggcggcaagcgggcggcgcggggggattatatagtgatcggagatgggaggggagatcgggtgtggggaggaggcgtcttgccttggctgcggcggccggcgagaggaggcgagagagtgtggggggagctgggtgtggatgcggggcgagaggggatccgagggagaccgagaggcatctactactccgagatgcgggtacacgggctctgtgactgacagtggtggcccacaggggggtatggcccgcgtggcagtgggggtggacttgccggtgagtgtgacgttttagataggcggcggtggggctcgtggcggcgaccggaggtgggcgacagtgtggtgccagtgggggcgcgacgcgtgtcccgaggcatagtggtgtgggtttaaaaggattaggatgccggatttgtgcgggtcccaagcgtcagtgggttggggctagtgatactgtggtacaagtggacaactggatggcaattgtccgatcaaggtttatactcatgcttatcggctaaaatttgaatttttaatcttaaattttgaattgtttcaaggtttttttcattaatttttattttttatcttttacttttatatcgctaagaacacatatataaaagttttattcacaaattattttttttacaaatatgtttcgcttattcgaaatgatggctagcctagctgggctaaatataatttcgtttatttaccggatataatttcgtttatttacaaatataattatatcaggcctttagctgcctagctgggccgtcagagaattttaacgaggaaaaggtccactttgactccctttaaaataggccgaatctaattcgtacccctccaccgaaaatcagataagacaacttccctaactattgaaaccagtgcaatttgactccctcagcggttttgaagagtggttttgctgacgtggcgctgatgtgacggtgctaacctggtcttcatcccatgtggcgcctatgtggcattaaaattaaaaattatatgagggacccacttgtcattaaaataaaaaaatattgtggagcccacctatcatcctttctctctccaacccttcttcctcctccctctctctctcccccttgtctctctcttttctttcctcttccgtggtggcggcggcaggcggcgctacccttgcagagacagcgggaaatggctcccactaccgggggcggaggcggctgggcgttcggggacatcagtaccgtccgattttcttgacccactgccatccctagttgtcgtcgcgtgcttgacgtggacggtggcgacggtggacttgatggcgatggtggtcgcggcagcggcggtcgtaggtggtgacgatgaggcgtggcgcgcagtgatgcttcccgtcactagctgtgcaccctcgatcggttagggttttgtgggtggagttggcggtggtagcgaacctcgtgccgtgtgccgccccggcctccaccctctatttatgtggcgcagggtgacaaggcccaccagccattgggctgggcgcccccgatcagggcgcaggtcaagatccccgttgtgccgttgggcccaacggggaggggatctatctaacatgaagtagcccgtcctgaaggcctgggtgaggtcggaggcggtggagacggtcgccatgatgacgccgtaggcggcgagcccagtgaccacgccgccgtccttgagccccacccacgcgccgaatgcgaggaccaccaccttgccgaaggtggtcgcaatgttcatgtcgatgacgccggtgacgtacgtgttgcagaaggcgagcaccagcgcgacgaggcaggcgacggcgacgtggtggtactttcagctcggtgtagaggcgcagtacaacaatggtggacatgaccgacaggaccacatacccggcgacggcggccacgctgggcatccggtcacggacgaacacttgcttctgccgccggtcgtcgaagctctccgccgaaaaatcggacggcactgacgtccccgaacgcctagccgcctccgcccccggcagtggaagccatttcccctctctctgcaagggtagcgccatccgccgccaccacggaagaggaaagaaaagagctacaaggaagagagagggaggaggaagaagggttggagagtgaaaggatgataggtgggctccacaatatctttttttatttgaatgacaagtgggtccctcatatattttttaattttaatgccacataggcactacatgggatgaagatcaggtcagcaccaccacatcagcaccacatcagcaaaaccacccttcaaaaccattaagggagttaaattgcactagtttcaatagttggggagttgtcttatctggtttttcaattgagggtacgaattagatacggcctatttttaaggaagttaaagtggactttttccttctaatgaaccggtgattaggccggccgtcttggctgaatcagctggcatccgtccatggcccatctgcaaatggcccaatacaagctaaaatagaggggcccgcctacaaatttaacatatgccctctaaaaaaacaatttaacatgcgtaatttctgcatctcaatagacaattgaacatttgggatttcatttctgtttcattagtctttccctgaccattccgtgtaagctgcagtgtctgaactctgaaacacttccataatcttcccatcccaggcttgcacagaagatttcaaccggaaaacacactgaacttgcagtgctgatcattctccgaaaacgcagcggttcagttcagatgttacaaaaaaacccacttgtttccagtaggcttagccaaatcatcatgccgaggcaatcgaacagcactaatctactagagacgagacgaaacaaaaaataaagcaccagaatattttatctcaaaagagcattcaacttgccatattgcatattcgggttgctgtctgaaccatccctgtcatcgtctgccgcccagcccgccccgttacatacgttgtagaaaaacgaaggaaaaattctggtaaaatcgacggaaaactaacggaaacatcaccacactgcatgaccaagaggcttcgtttgtttgaaacaaaatcatcaatttaaatcagcctttcacacagcaagtgcatggctgatcgcattctttaaccccttttccctgcttcatcctcaccttggttatcttgagaggcacgaaagcatcgaaaatacgcaaatattgtgtacgtacgtctcgatcaaccaggatgaagcttccaagtaatacctggctaaccagcgcataaatatgccgatctcgcgaggccgctgcatgcaaacctgcaacacacaagaacaggactgagttgctgatcatgcgcttctcccgtctcgttttttttttattgtttggtgagacgagggattagcgacggtttcgatcgttttgttttgttttgttttgttctacagtgagccaagtacaggtcgatccgttggtgttgggtttaggccctgtttctttcagcttgggattattataatctagattatttggactaaactgaaagaaacagacaacttattgaagtagcttattataatttggagcccagcttattataatctgataagctcatttaggtgagctttttccagattattgggtgaaaaattatccaccatgccaccccactctctctttagacttgcaaacccaataatctaggctctaataatctagaaaagaaacaactaaccgcttattctactacagattataacaatctagtttatagtaatctgactcaataatttagattataataatcccaagctgaaagaaacatggccttaatataattaagcggcttattcgtagcacttctgccgttaatttgctagtggtgatattgccgcatgcttcatcaatttaccagtgaatcatcagctctgcgcttttcagcttcttaggtcccggccgtttgaactagggcggctgatggattatggctgaaattgatttcgtgatcattatttgagggaaaaagtatgaattacccccctaactatcgcggtcgtccgaaattcccccctgaaccacaaaaccggacatttttcacccccaactatacaaaccggacgaattacccccctcgacctaaatccgcggtggttttggtctacgtggcgtacgcgtggcagtccagtcagcattctatttattaaaaaaatgtgggacccacctgtcattctcctcccactcttcctctctcctctccctcactcttcctctctctcttctctcactctctg

SEQ ID NO: 27421 - DNA, 10990 bp, Oryza sativa
  unsure (1)..(10990): unsure at all n locations
nnnnnnnnnnnnnnnnnnnnnnnnnnnnnnnnnnnnnnnnnnnnnnnnnnnnnnnnnnnnnnnnntaattaggaagtattcccgcgataataatccataatccacctacagttccaaacgggattagtgagtacgatcacaaaatgtacgatgatttgaacaataatacctatggagaactgactgaactgtgatgatacataattatgcttgcattactgctaccaatcagtactatatcgataatagtggcagccctataaaaaaagctacttccctaatcataaatagttgacgtttcgaataagttttggtcaaatttcaaccatcattaacacctcaaattcttgttttttttaaaaaagactacatgtgtagatttattttcaaaagcactatcataatattttaaaccaattagattttataaaccatttctcaaataaaactgattgttatttgatttgaaaagcactaccataatatcataagcttattaaattttataaaccatttcttatataaaattgattgttatagttttaagggtttgaccaaatctcttattctaaaaatcaaatacttataatcaggaggatacaaatttcttgagataacgtcgatcaagagggagaaaggagttatatatgaagtataattctataattctataagtttcaaaaaaaaatctataattctatatttccagtgatcgatgtatcttaacctttttctgtatactcgtgtgtttcaaagacgtgcattgatttcaggaagcgtttctgtgtttagtttgacagcgcaaacaaaatcatccatcctacaaatctgaacattaagaagcattagaaagtacgtgaacatacatgagtaccgaaagttgtgtgatgagagcatttgatgtcaacgtatttttaccgggccagcccaaggagaccgaccaatttcattaagctacaaatacatcgataataagatgtcgaaaaacagggtcccaaaagtaccaacagcacctcccgcaagtaaggccctatttaggttctaaacaaaaaaaattttcatcatgtcacatcaaatgtttagacacatgtacggagtataaaatatagataaaaaactaattaaacatattgcatgtaaattacgagacaaatcttttaaggctaattgagccataatttaacaatgtggtactacagtaaacatttgctaatgacggattaattaggtttaataatttcgtctcgcagttttcagatggaatctgtaatttgttttattattagtctacgtttaatacttcaaatgtgtgtccgtatatctgatgtgacacgccgaaaattttcatccgcgaattaaacaggtcctgagaactaacaggaactgctccaagtcgatatcattcttaaggactcacattcttaaacattctaactttttttttctaaatggtaagtaactactgaataccaacaatgcgttatattttagggtagtgatagtagaaataaagtatcactcttcctgttttatattataagcagctttgatttttaaagttaaacttatatgattttgatcaaatttatagagaaaatatagcaactctcttataatacgaagttagtttcattaaacctaatattgaatatatttttacatcgtgtttgttttttgaaaatgttggtatgtttttatataaatttagtcaaacttaaaaaatcaacttaagaaaagttaaaacgatttactccctccgtcccaaaatataagcatttatagcatacaagtcaaacatttttaactttgaccattaatagcaaacaaatgaaaaaatcaataatgcaaaattaatgttgctatatttatcattaaacaaactatcataatatgcaactctttttttatttaaaacatcttactttagtaggtattattggtcaaaataacatatcggagacagtgtcagggtctaaaaatatctttattttaggacggagggagtagtttattactcctacctatatctctcaggctgtgatccaaacttcagtccttttacatcacatcaaactgtcatacatacacaacttttcagtcacatcatctctaattttaactaaaatctaaactttacgctgaactaaacacagcctcaatgtgtaatgtttagttaatttgaactaaccaatgttaaataaaaaaacagagaaagtactaaactaacatagatgtcaacgtcgaggccgacgtggtcgtggatacccgagctatagctcccaatctcccatgcaccacccggcccacgggccaatccaaaatttccaccacgccgcgttggtgcacaacgcggtagccggtagggggcgctgcttccgccccggttgagcgccaccgagagagagccaggcacacgaaagtttcgtctccaacacgacaacccccacatttttcctcttccctccacttcgcccaatcccctcataaaagcgtgtgcagtccatcccactcagaatccatcgcccaccccgccattcgctgctgctgctgctgctgctaccaactactaccaccacaccacctccgcttcgcttcttccccaccctcccaaaacctccccaaaatccgcgcgcgatgtcacggaagcgcgagcgcccgctcgaggtcgtcgcgccgccggcgaccccgctctccccgagcaagcggctgcggcgggcggggctcgtcgttatgtggctgtgagttcccgctctcgtccctccccccgcttctggttccttccccctcccccttggaatagcgactcaccagtgccggttgcgtttggttcgcgtgggatctgtgctcttgcaggcgcaggaagccgaagccggtcggcgtggagcagatggcggcgcgcctgattcggcaggtgggttgtggtctctgcatttgggatcgtctcccaattagttttctgggtgatggttcatgttagttgattcagtttttttttctttggggggtgaagttggttttgatttaattaatttctactacttcattcgtgcaatagatgcaagtgcagatggtcaaattgtttatgcttctcatgtttctcgtcgcgcgccttggcaacgtggagaggctgcttctcgagcaaccgtatctgatccgaaggttgcttgaggagcactttggtatttttcagaggtttgcttctgtttactcgagtggaacacatacattttttttacaagcatgaaattcgagattcattgtcgggtttagatgttaccagtgaacgctgccagctcgttgtcgacaatgcatcggtaatcattatgggggcgtgacttgggggaagtggaggaggttggattgggggtatagtatagggtctcaacacgctcacaatttcttctatttatttgagaaccaagttcctccttggttgccatcattttattggatgtgtgttgggggtagtagagagaatttaggggtttttatttttgaatgatccaaaaagtgcgtgacacttttttttttggaaaaaagctatatgcttgaatctgatagcgggatggtctgtttaaatttggttggtttacctgcaaatcctagaaaagtactggaataagtggaattcctcctctgtagaaaccaactggagaaacttgcttattaattgcataattgcagtaataactgtcagaaatgaaaggcaaaacattacaaagctccactaactacttcccgagaattatctgaaacagttcttgaccatttttttcttggcacttatgattttgaacatcatagtcctgttttaatttcagattaccaggttacctacataccatctagcaaataaaccaggatagaacttctgtttttccccaagtaacagaaacaccaccaaaatatggataaagcgttgttctcttgaaattctttctttgtatctgatctcaaactttgaatgttacggatgtgatagataaatgctaccatcattaatttggtctcttattgtttcttatccaaaagatctttgatggaatccatacaagatacggttcgcaaggctgtccactcagaggccagtattttggaccttattcacgtaaaatgtgtgatctatctatacatatgctttgtcttaactccttttgatatgtcatacaacagatgaaggaaagacagacaacattactttctggaggtgcttatcagcatccaaggtatctgccatttttgtatcttctcctaaaatgttgaaaactagatgggcatttaaattcctctattaaggcactttaaaagtttcttgatccatgtcatgatcctaaaaaccaagaaaatgaagtcgtgttatgcattctaacatttctttggtgcacaaatgaacctgagtgcactgcaagttctacctatgaactgcaaacatgtccaaaaggaacataataaccaaaaggaacataggaaccaaaaccgtgcgaggagccctaccaaactggccctaaagatacataggaagaatgcttaagaatgtgctctgttgttgcgatggagtgaaagtgtactatgatatgtattccatgtacatgtattaatctctcattgtatctcaaattgtagaccaaatatatcagaaggttttccacaaactggagggagcactagaatggttaagttattttttgttgatgttgagagaccagaagacccacttttcacaggttctccagtacaatggcaaaatggagccaacgctaaagttgcaatatttgaaaatgggagtcaaatcacacagggtggtctttctaaactacaaatcgagattttaccagtccatgatgatttcttcactgagcgaggaccagcaaatttcaccaaagaggaattcaacaagcagatatacatgtgcaaagggaaagagtcagtattgaaaactgtcaatttaacaaatggtgaggccaatcttggttccttcttctttacagagagttcccatgggaaaaggttaagattggcagcaagagtaaaatatcaggatcttgcagtcagggttcaggaagcaaccagctattcttttgttgtcaaagaccgtcgtagtaaatgtgagtatccacctgttcattttaacatcagaacccttttgaccatacatgattggaaactccaatacacgatgtatgtttctcacaaaatgcagcattttctatgcctaatcatctgaagaacatgatactcgcacaagtggctaccaagataatatagacaaaatatttataatgaacatattatatatatttcattagctattctggtctcgtacatgcaatggcacttttctagtgaaacgaagtttgccacttgtcttgcacttttagaagggaacacctccaggtctgagttctgaaataaacagtatgcaatcctagtcctttgacgtctgttatacttttgttgatcattggggattttcttatgacttacaatgtcttgcgcaatggaaaaaggttcagatcgctgtaattttgtacaatagacggtaaattaacagtacgcacagcaagttgtttcactttgccaggtacacatgtggtaaatacccctagaactaattgcaaagatggacaaactgaaccaattgcatactagcaaccagcaataattgtgtacatacatcttgtcttgacacagccaaccttattgcctactttcagtaaataaaaagagcaattctccatctaaggaagaagggattcattgtttgaagaaaatttccctaaaaggaaaacgttgcaatgaccttgcgggcaaatatattactaaggtgaagcatttgatgcgctgttaccacagagatccagctggtctccaaaaggtaattatgcaattgctatgatgtttctacagttaccgtttcttcaaattacctgcaaaaagtatatactatcagtttgtcagggaacagtatattgttcatattccaactaaaaaaatgccacagaagtgaactgcgagatgctacttatcaatttttgggaaatggctgtagcttgcaaaaagatacctccgcctcctagccttcagtagaaaagtcccaagatattttataacttaaatttcataaatatgaatgttagtgctataaacaatcggcctgtacttgctattcgatatagctcctatgaaccatactctacggaagtttctgtaattaccttttctcttttcttcttctgttccttgtgcaatatttgttattagtattaggtatgctgcatgtagtttaaacaagatttaaaacacaaatcatgtgtggaacacaactacttacctttcacatgctgaagggttaaaacgtggcggtacttgccgcttgcactaacgttaacccagacattcttgtaggtgcagtacacatcagaattattataataatccaatttattaaagattaaaccaagttgatctattttacatttcatcattcaggtatactaattggaataaaatgttcagtgaacatcagttttgtttatttaccaagttaattgcttactttaccttgtaataccatgtttgctcctgaaaggaaaattgctagtaatgctatatatattcacgtgctaagaaactcacatcttcttgcaaccagcttactggcatgaagaatgaagattggaataccatgattagtcatgcaaccacgtctgatcctggggatgagatccattcttacagagttgagaaaaatactataatcttcttcaatgatttctttgctctagtcggtatgtcggttgatggctcctatgctccttaccacgccaacaatcttaatcagctacagcaggtatttattgaacaccattccgatgcaattaaaatattgacatctgtttatattcacaaaaatagtactccctccttcccaaattgatcatcatataacgtaatccaaaatatctcaaattgatcatcatataaccgcatggacacaaatttcatcggaatacaattaatgcagcatgagagaatgtgtgcatgctagggtgtaattggcatggtgttttaatcgatgcatgcattatgggagaatgtgtgcatgatgtcttgattgatgcgatttaaattatctttgatcttggtgcataaatatatatgatgatcattttgggatggagggagtactagtatgctgggcctactaacaattgcaaatattatcaacttgtacatcaagatgtaatgttggaacacatgactaacctatatgtggcattgctgaacataaacatgggagagtcatatagtcaatttgaagaccaatgcataaaacaatttgggaacattatttatgttaaatcagatatttatttgtgctatggagtatatcgttggccataagttgataaacccactcaatgatgattaaaatgtgttgttgtctgtgagtacttttgtagtgttccaccctacctatataaacgtaattccaactttgaatcctagccatttataatataatgtgatggaatgacataatggagtattttgttacagcgtaaaatgaacaagtggaaggagtctgcgtatcagaaatttgaggaactggagaagttggggtgtcttattcctgatcatgtcatgatcaatggccaacctgttcccgtgtctccaaaaaatgatgccagtcattccatacaagccaacccaacatgctttaatcaccagattgcacttgaaggtcttttatatattcattatgatccatacaaaatcctagtcatttcattttactcaagattcaagtcgttgcgtaattaggtcagggacatcgatttcaacagcagaatggattttcagcagtacacgtatttactccatacaatgttgctggaacttccacacaactaaaagagccgttgcaacagtatccttatgaacaaagtatgcatgaaggtcaatactactccctccgtttcatattgtaagactttctagcattgcccacgttcatatagatgttaatggatctagagatatatatgtgtctagattcattaagatctatatgaatgtggacaatgctagaaagtcttacattgtgaaacggatgaagtatatacctgcttaattttcactgaacaccctccaagttactataactgttcatagtttcaacttgcttcagaatctggtcgggagggtccttctatgcagcataatggaacttcttactctctgactgaggaaaacatcttgaacggtctaggctctggcttagtacaatcaactatcctatctcaaaatactgcagtagtaagtaaaaacgaaattgaaatattaggacatgatattttgtcgtgtccatctctttctaaatgaagattgaaattctttagttggtaatttctcgtttatgacttgaaatgtttctgtatataggtcccaggtgcagatccacggcacagtggatatgccagcacctctacagctgacgctgctggtacttcttgtcctgtaacaggtgtgcagctacactgaaactcttatagttcaacagtacatttgcagtgaactcgatcaactcaaaccacttttctacattatgtatttgctgggtgatgaaatgttgatgttggaatttcctcagatggagttggtccatgggactatccgattttcagtgatctgtatccaaatgtagtaagtactttgcgctgaataagttgaacatgctatgggatttacttcaaagcaatgtgctcaatctgaagcaatgttgtcagtggcttgtttggtgttttttcctttgtttgtcatgacatttgtagatgttccaggaaccgtcaggactaatctatgggcatgtggtggaggcagaccaggcctttctcccagatagccacggtatgtgtacccacggagaacatggcagtagagtatgaatactttcgtaacagaagttttggtgctgttgagtttctatttgtatgcttcttttaaactgctttgacatgttattttcaactaaatatagttccaatttcctaaagtgtgcaaaataatgtcttatattcataataaattgggtgaactcaatatgttattaacaataacagaattgcttcgcccccttttgataccagcaacctgaaacagtatattattcgttacgagaaactgctagaacaggttatacatctagatctaggactgggagggaactattactccagttcatggcactctgaatttgacacgctcttttcagcaatactacgagcatctgctttagctttcctcaaaatgaatagaagttgaattgtgcgattaccaaattgctgatgtacttactggctacttaagaattttttgacacaatactagccacttaagattaggattgaatttaatatcaacctttcgtttcgtgccatgacagtgtgtttctcatttcagaactggcaaatgccgacaaccaatttactggaggtaatgatgatagtgctccatttgactgaaatcaccgcaacaagttattgtctactctcaaccatactaaagtgttcagtacttccagtgtgattataagtgtgtagtagttcgtaaatatagtagggacatattatgtcagctattctttaatttgttccgctcacgttaaatttgctgcctgcacatttggcatagtttgtttgtactactgaatactgagatcaaatattgatattgatgcactacgcctaattcaattcaattaatctagtttgtcccggtcagatgagtttctatctactttatgctggagtacatacgattgaaaatctctctgcagctgcagcgacaacagcacgagaattgcacgaaggaattgttctcaagaatcttaagatggtaaatacacacaagagagaggtacggtatacaagacttagtttttcttaagtacaacagatcttccattcctccatgatcctatcagcttctacacccaaaccacacaaatcaccatgcacgagccctcttcctccactgccaaatcaactgcaaaacaaacaagaacacatgccacattactcttccattttcatgagacaaacaaggtcacaagcacatcatccaccatgtgatggtgcatggccatatctcacctcacctggggcttgagtagccaagcatccatgtggtgatcagtagccgatgtcagcgtcgtcgacgacgaggttgccggtgatgagctcacggtaggcggcgacgggccagatgaaccccctcgggaggagcttgacggcgagctcgacgtcgatgatgatctccctcatggccggcttcttctcgccgctgatggcgatgaggtagctcctgccgacccagccgatccagccggcgatgtagaggaagagcaagcccggggtgatgaactcgccccagtgccgctggtcgccgctgacgatgaggtgcgggaggccgtcggcgccgcagagcaggccgaacttgccgtagttctcgaagcggcgcttcgtcttctcgatggtggcgttgatggcgagcgccggcgcggagtccggcgcgtacttcttgagcgacgactggagcttcttgatggactgcttctcccgcttcgcgaacgccttggactccttgcacggcgtcagcccggcgatgtcggcggcggcggggggcggcgacgtcgccgccgaggagagcagcaccgaggacagcgccagcgccgcggagaacgtcttggccgacgccgccagcgactgcgccatctcgccggcgccgccgttgttgcccgacgcggagcacgacacggagaaccgcgcggccggggacgacggcgcgcgcgccaggcgcggcttggcggcgaaggcggtggatgcggcggcgagggcggccattgctgctgctgctgctatcggcgagagagagtatttgcgatcggagtgggtttgcgggtttgtatcgtgtgggggggggggggggg

SEQ ID NO: 27422 - DNA, 1762 bp, Oryza sativa
  unsure (1)..(1762): unsure at all n locations
agtgaggtgggagtcggggattggcgcgggggagtccagcgtgaacgtgtggggggcgcgaccgtgtggagatgcagattttgtgggggctcggtgctttcggccttgtggctgccgcggtttgaagatgattttgtttggctccggctgtgtgcctgtgtgtgctcgccatatgcacgtcgtgcctgccagagtctcgattaggattttgttcacgggggttcccatttcaacgaggggaaataaatggttctggagatgtccatttctactagagttacttcctccgatcataatatctggcgttcatgatagcatttgattatacttatttaaatactaaccgctcctttattataaggtgccaagtgatcagtagtgctagttatctcaattaggattctttatttcccggaaaaaaaaggattctttattaagctgaacaaacatcgaacaattagggcctgtttagttccccaaaattttttcccaaaaacatcacatcgaatctttggacatatgcatgaagcattaaatatagataaaaagaaaaactaattgcacagttatgggggaaatcgcgagacgaatcttttaagcctaattagtccgtgattagccataatgctacagtaacccacatgtgctaatgacggcttaattagtatcaaaagattcgtctcgcggtttccaggcgagttctaaaattagttttttcattcgtgtccgaaaaccccttccaacatctggtcaaacgtccgatatgacacccaaaaatttccttttccccaactaaacacacccttaatccactatttcacacagtagcgtagtaccacacccgttctgcgcctgcacgctacgcgaaacctgaagcccccgcgcgcataccagctgggtcgtgttattcgatctcacaaacacaagaactcaagaagtaccaataacatttcatccatggactgtacggttcgcaaggctgtctcgcgaggtttcgctctagcagcagagccgagctgccgatgggtgggtggcatctgaaatcgatgcacttcagtggcttcaaccgagcgctatctgtggatctctcagctggagtaatactggagcccatggacacttgtgcccgctccgcgtatttcctgatgccacccatttctacccgggcacactagctactggaaaatttaaccgccgtgaggcgaaaccagatggccaatataccagaggaagtggcgatgtgtgagaagaaaagaagactcgccatatatatgcaaaatctcgtttaggatttgtttactgtgttctcattccaacaagggaaagagaatagataaagctctagttatatggttgttgccaaaagatatttcgatcattattttaatgccagcctctttcgaagaagagataaagctttacaaaagacggttcaacacttgtccactgtgcaagataaatctgaacaaattttagttgaattcaaacatttagaaaactcaaaatttgctcgaaattgcaaaaacagaaattgccaaaaaaaattaaaaactaaacagattttgctaaacttaaacaaccatttgcaattttttttgatttgtataattggtgacaagttttgaattttgtaaagtatgtttaaattcaacaaatatttgtttccattagagtcttgcacatggtcgcccaagggtaaannnnnnnnnnnnnnnnnnnnnnnnnnnnnnnnnnnnnnnnnnnnnnnnnnnnnnnnnnnnnn

SEQ ID NO: 27423 - DNA, 952 bp, Oryza sativa
  unsure (1)..(952): unsure at all n locations
tggcagatgctccaacaagtatgagtttagtcatcttcttatctacctcaaaagctaactatcaacatattagatatggtaataggaaggtataaccaaaaaaganctgtacagctctccaaacaaattttgcataatggcaagtctataaaaagatgtttatggtgtctttttcatataaaaacaacatcttaaactgccattccaatttcgtcttgccaatttgtccttagttagtacaactcctttaagcaagtaccacataaagatcttaatcttaagcgacatcttaagctttcaaataatcttatttctctcaatataaccattattaatcagagctagatacattgatctaacagaaaatctaccattctgataataattccatctaaaacaatcggaggattgattcaactgaatatgtacaatagacgcacacaatttatgccaatatgcaagaatctgaccaactaaaactcttctaaaggaaacattcagtggaatagatctgataacattgacaatagtagaacttttctttctgacaatagcgtataaagatggatatttgtctttaaaagccacgtttccgagccatttatcttctcagaaccttgtttcccattattcacaatttttttttgagagtggaaagcaaagaaaaactcaaattacagcatccagattacagtcctctgataacagagaaaataaaaactccggtgctgacactatccagctagaagaagcacgcgcgttaaggctttccttagctaaacggtgcgccactttatttgccgatctcctggtccatatgagcttgaaatcctggaatgactgaattctcctcttcagttcttggattacaggcccgatttcagaccgatcaaaacttttattcatcaccaaactcacaacttcagctgagtctgtttcgaagactactctg

SEQ ID NO: 27424 - DNA, 1378 bp, Oryza sativa
gagtctccatcctgagatataaaaaggatgtacgtgtctgatattatcttgccattaactcagactcatcctttttccgttgttaacaggtctgatcagtgtgttgtcactggtggggaacatgtaattgtcattctgtgacaccaaaaatttattatttgttggtagtttggtataagcagctgtcagttaggataacagattactgtggagcatttatatattgcacatgcctaaattcctactggcttatgtgtgcacggtggtgctaggtgattcttttttacatagttttgttcttggagacataactgtccatagaggaatatcattgacaacttgcataagtgcaggtgaaaattagagcctacaaaaagattgttatggcagaatttatcgtcattgtatatatggggatatatcataaattaaagatagagagacaaataaagcaggagtaggttataacaaatgaagtttcatattcatagaaagccgatttgaggaaagtaaataaggtttggatgatagagttggttactccatacactttcgagaaagagaaaattccctgtgtacgcctaaaactttgtctaatccctatgctcttcagtatgctcattccctttatacttccaaattttagtttgcatctcttctgcaccgtttgcgttagttcgttgttaaactcttatgaaaaagtctatttttgccctatggtatgcaaacatataaatttatagtgtacaaaaatttgttgtatgagaaagagaaacttgagacattttataagagaaaatctcttatatatccagaaattttagctaatcccttctatgcttctaaattttgcttagttccttgtatacccctaaaatttgattttgatccttttcatactccttccttcagttgaccatagttgaccgtctaatttctatgaaaatgaccattttaccctttggatgaaaatagaatttatgaattacattattaaaaatgtaaaagtttgtcgcatgagtctattattattatgagtttgttgtgtgatgcattatttatcacaaaatttatttttagataatgaaataaaaaatatgtatttattatttaaaagaagtcataaaagatgaggagcatttatataaagataggactaccaatgctcacaataattttttttatgaatgctcccgataaaaaaatccattgtcttattaaaatttcaaataaatattttaatttagtacatttgttttatttagtctcattagtttcataaaaatgtacatactatgcactcaaacaaaattttcaatctttttcaagcttatattattggaaaaattggaaccatgccattataattttacaaaat

SEQ ID NO: 27425 - DNA, 968 bp, Oryza sativa
tgcaccaagccaagagaaactgaagtgattaaagggggatagtaatatcaaatagtatcatactaaaacaaatggcaggaagagaaaaaaacatcagatatattatctgataatgaaaaaggtacgtagaccaaaactacaaaacagcaaagcaactaattgtaaaattatatacaaatttctacaaagacttgtttgggcattcaaagtaaaagacttgaacatatatatcaaggaaataaataggggataccgacctgtcagacaaagaaaattttccggtacatgcattaattattatgtggatatggggattgatggtagacgacatactcatatatccagggaattaattttttgaactcctgaacctgcccaagtccgtattgagtatgacatggtttcacgtatacataagcagcggccttggggttaaacgcagatcaatggaagacacaaccttatatcgccagatgccagagctaataatatatccacctcgagcccccagataatcgtctcccgtcgagatcccattgtcgccagattagcctactaagtttccaccgtattctccaacatctcaaatcaatccatataaacaggagttaaacttttacctgtataaacctcgtgtcttcatttaattgtatgtattgtattgtttcatacgtacaaaaccaggttgccctacacatcaactataaatatagtcaggaatcaacccatcatggagcgacgaaccggtttctccgacgacgacttctatgacaaggatagagaagaggcgacgtctcgaccccggcacaactgcccctatccatggatcttggcccatcgataggatcccattgccaactttccgtagagacaagcattcgtcctagcacaaccacctatataaatgagtttccaactttttgaatccttagacgtcaaaaaagcatgaaaacaaatcgtaatctaat

SEQ ID NO: 27426 - DNA, 774 bp, Oryza sativa
tggcttccggtagacgaagcaaaagcaaagcgtttgcaactcagagccacgaagtataagatggtctcgggtcagctttaccgctccggggtacttcaacccttacttcgttgcatctctttttccgaaggtgaagaaatggcaaaggagacacaccaggggctatgtggcgcgcaccaggctgcaagaacagtggcctccaaagtatttagacaaggagtttattggcccactgtgttgaaagtctgtgttgagcaaatcaagaagtgcgaaagttgccagcgtcatggccgaagccaagccgcgccccagtatgatctgcagcccattgcgccaatatggcccttcgccagatggggactggacatcattaggcccttcccgatggggcgaaacgggtataaattcgcaattgtagctgtggaatatttctctcgatggattgaagtcgaaccccttggggcaatcacttcggcagcagtacagaagtttgtatggaaaaacattgtttgctatttcagagtgccaaaagagttcattactgacaacggtaagcagtttgactctgataagttcagagaaatgtgcgaagggcttaacctgtaaatcaggttcgcgtcagtcacgcacccgcagtggtatggggctgtcgaacgtacaaatggcaagatcctagaagcactaaagaaaagactcgagggggcagtgaaaggcaaatggccagaggaattgctatcggttctctgggcccttcggacgacccccacaagacca

SEQ ID NO: 27427 - DNA, 647 bp, Oryza sativa
tagtggtaggcccacggcgcccaagactgtcattgcaagatggtctaactactgcgggctgtcggcacgtaagaactttgggatcctccataaagatatcggcacggtcacaaaatcctagaaagagcgagcttggacagctccggagaaatggttcacatttccggctgaagcaaaggataggctcaagtggaaggcattccataagatgggtaaagcttggaagaattagaagtcgaagctcttctccgagtttgtcaacccgcccggcaatcatatgtcgttcgatgaataccctcaaataaccgagtcggtgtgggaggaattttgctctctcaaaaacacccaagagtttagggaatcaagcgagacacatcgccaactgcaacaacgaaatgagcacccacatcggttgggcaccgcagggtacatcggcaaggaggcaatatgggcccaagaagatgcagccgctgcagcagcgaatgtccctgccccgttttcagacatccctgaacaaggagctcgcaactggtcgcgggcaaggggtaaggtcaacccggacggctctgtcacatttgagaacaaaagtgatgccatcgtctatcaggaactggtgagttcactacttaacctaactaatttccatt

SEQ ID NO: 27428 - DNA, 987 bp, Oryza sativa
actgcccatgccaacttgccaacctatctggagatcttcatatttgaagccacagctttcgtacctgcagaatatgatgaattaaacaagcaacggaactggccgtcaaaacatttaccgacaccggaacttaattatatttttgatggatcagccgtacaactgtagaatggttttgtacagggacgacgccagcacaaagttgcaatacactgttcaaaatcgccaggacaatggttcaacaactcaaactccaattcttgtgatatgcatcacaaacatgccggatgagcccaatcacaatattgaagcttccgatgataacacacatcgtgttagctttcattaattgtatccgcacattgtcctcacaaacaatgatagactagcatgctcaacacgaacgtcttggatctttcgagtttttcgaccccatgtgttcacagtggcaaatttcaatgcaagctatcatgttctagctttgtgtaaccctactgccataagtaaagttcatcggccacttttcctactgcaaatgaaattcctaatgccccccatattacaacaagctcatgcagcgtgatgtacgctcaaagatgctatagggtgccaacccaagtacgcctttaagctcgtaaatttgtcattgatatcgaatgcatctcaaccaccagccaacgttttgttgtggtcgacctaacatggcatacatataccactttatttatatattcattttgatgttgttagtatggtagcactgcacaacgcgtgttggcacgtacctaaggacatctatagtttttggtttgaccagtccgatcaacaagccaaacaaaatttcagttctgtagatgcagaattaaaatctatttgtgggatccacgcaaaggaatcacccaatcaccagtccgttctccatgcatgcatgcatgacaaataatttcctattcattcgttggattacaatttagagttcgatagctg

SEQ ID NO: 27429 - DNA, 707 bp, Oryza sativa
  unsure (1)..(707): unsure at all n locations
ttctcccatcctagcgacgaacatgcttagtgctgccatgcatctggttagcttttgtacttccttgagtcttgtgggcgacttcatattctcgattgccttgatcttctcgggatttgcttctattcctctgccagagatgaggaaaccgagcagcttgcccgacggtactccgaacgtgtacttctctggattaagaatgaggcgatatcgtcgaaggttgtcggatgtttcccgcagatcgtcaatcaatgagttgcttgtcttggttttgacagcaatgtcgtcgacgtatgcctcgacattgttgccgagctggtcactaagtgcgccctggaccgtgcgctggaaagtattccttgcggttatcagtccgaatggcatcttaacatagcaaaatacctcgaacggcatgatgaatgctgtcttctcttcgtcctctttcgccatgctgatttggtgacagccagagtaagcgtcgaggaaactcaacagctcacagccggctgtcgagtccaccagttggtctattcgaggaagaggaagtgatccttgggacacgccttgttgaggtcggtgaaatcgacgcacatcctccatttcccgttggccttccgcaccatgactggattggctagccactctggatgaaatagataaagccaannnnnnnnnnnnnnnnnnnnnnnnnnnnnnnnnnnnnnagt

SEQ ID NO: 27430 - DNA, 525 bp, Oryza sativa
gacggcgccatcgccaggtaccccaacgccggcaagttcatgagggtgaaggacaggttcgatcccgacggcgtcttctccagcgagtggagcgaccaggtgctcggcgtcggcggggcgagcccggtcatcgtcggcgacggctgcgccatggaggggctctgcgtgtgctccgacgactcgcactgcgcgccggagaagggctacttctgccggccggggaaggtgttcacggcggcgagggtgtgctcgccgtcgccgcgaggcgctgcgaatggcggcgacgacgacgacgaaatatcggacgttggcgatgagtagtggcatgcgtcatgtgcgtggcaacgtcgatgtgtcagtcagtgtaagcagtgtggacgtaaagcattctcgtgttgcatgctgatcataagatcgttgcgctgaggtttgactgttgcgacaaatggatgtggggtccacttttttatggcatcttataactaagtggttattaaaaatctaaaaaaatatatattacttgaa

SEQ ID NO: 27431 - DNA, 679 bp, Oryza sativa
  unsure (1)..(679): unsure at all n locations
ccggtggtggaccgacaacggtagcatcagcagagggaacgaaagcaacgacctttcactcctctcccctcctagaaccaagcttcgggtgcatcgtctcgtcgacggcggctccttcctgcctcgaggtgctcttggcaacggcagccatgatggcatcgacgatggcgacggggggcggatctagtggcggtatggttggagaccaccggtagtggaaggagtagatggggcaccgcagtggcttccccactcccttccgcttgcctccctctcccaaatctggctgtagggggcgactagggtgtggcggcggcgatagcagccgaaggggttggtttcggcaatagctcgtccacggcagcttcagcaacctccaaggtcaccgatgatgacgacgaccagttttgatgtttatttgcatgatatttcatttgcatgtgttaatcttggatgtcaatttgaatctagatctctgaatgttgattgattttttttttccttagtgatgttgcctataaaaattaattttctcaggtgatcatcttaagtgtttgcaaacaaaaaatctattttcgtaagcggatcgcaacactgctagtcaaaatcatttattttcaatagnnnnnnnnnnnnnnnnnnnnnnnnnnnnnnnnnnnnnnnnnnnnnnnnnnnnnnn

SEQ ID NO: 27432 - DNA, 1381 bp, Oryza sativa
atggttttgagagtcgtgctcatcacaattaaggaccggttctcgagctactattgtgaaacattaaccgtgccacccacaagccagcgtgggcaccggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacaagatgttgaggctgtgtcttgtgggtacagtggtacacctctggccagagtaaaactattcgaatagccgtgcccgcggttatgggcgggttaagcaatgtttttcgtgattagtctcacacctctcacaataattatggatgttatagctggtaataatttgcttagctcctggtttggagttagttctgtacagccgggtatggttgttcaggatggttgggcctgtgcagcatgggtgtgttgattaaaatttctgattaattactccactgttttacttctcttaaatgttttgctaaatgctgcttttgcaaacgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctagacgaggattttatgcacaaattagttcggaaattattagtgaatttccgggcgtgacaggggagctgttcgactctaccccagtcttgttgtgactgggacttggggtaggagtgtagccgggggtgtcgacgcggtcttcgatcgcctcgtccgcggccttatcagccacggcctcctcctctttctcctctccttcctcctcgccgtcgcgttcttcggcgtcgtcctcgtcgttggcgtcggagtccgacgaagcaggaacccttcgcttcctaggagcaagcttcacttgtccacgcattcgctttcgcgaaggccctgcatcatcgtcagctttgtgggggtttggccgaggaggcaattcgccgtgtaaacccggttcgcccgcccagacctcttggcgtgttagcaactggctatactcgacgaccgacacgtcggcgatcat

SEQ ID NO: 27433 - DNA, 1199 bp, Oryza sativa
agacgcaacctaccatccttcctgacgccattgccgaatgctccgtggggggaggatgagactcgatgagggggctggagaggaaaggcgaagacgacacaccagcagccccatccatcatcacgcctcctcagttttccccgcgcagattcagcctcccatcccccagcgacctggcaactatggtggagctcaagaacctgtaagcggtggagaatcggcgtgcgccggtgatcgattttggggaggaggaaaggacgagcaaaggcacaagaagagacagcgagatgggtctgggctaggagacgttgttgggctgttgggctgttgttgggcttgtcctacggatgtgctgttcctcttcaaaaggctcgatggattgtcgtgggatggaaggccgcattgtctgttgtaacaatatcccctcattctatgaaatttcctaattcgggcgacgggacacgtggcgcgcgcggagagagaggagagggggcggatggaggatggcacaattttcctttttttttcttttctagtttcttttccttttttttaggttctttttctgttttttcaatttttaaataaacttttatacacgtatacaaactttatatacgtctagacatgtatatgtatgtcagggttacgggttaggtagaccctttaccgttcgatatacgttacatatcgatatggcatgcccgcgcatatatggacattctctacatacactaaggaaatccttgacggagtttgcagaaaataagagtcctactcggacaagactgggtcgtcaatgtatcgtgtagggtttgatgtctccgagttctatttggaaaccgcttgacctgcgatataaaagggaccccctgagaggacttaaggcatcgaatgtcatagccaacacaacgaccacagcctacgaagtcggagcctgcaggagccaaatcgccgggagatctagtcgaactaactcgattacaatctcgccggtgtcatcgagttccatcgttccctttaatctgtgattttccatcttataatcccatatcaactggattagggctattacctatcaaggggcctgaaccagtataatcctcgtctttttgtttgcttgatgtcgtattacgtagatccttgtaccaacgtaccccaataccctctatattcagtctacgggtatcacccgtcga

SEQ ID NO: 27434 - DNA, 719 bp, Oryza sativa
cgacagcgttcctgtcattgcaatggatgaaatagagtggcgtcaaaaagaaatattctcagcatggtgaggggaatatagaataggaaagagttggcgatggcgatggcttgtccgcaatggcggccttcgtgttcctcacagctagcggcgaatttgagatgggagagagcagcaggggtcctctcctcggtttggatggtgttggagtggagagtcagggtgggcgatgcgtctgggtggagaaacggatgggatcagcaacaccaccgcctgccacccttcgtcggctccggtgtgtcgccgctccgccaccccatctacaaaaagagagagggatttacatgtgggacccacgttggattcatttgagcaaagggcaaacttgtctttaatgattgtttctctctactattcctccgaaaataataaaataatcgcacgggtgtccagcagctaattacctttttttgtggtgccctttagcaaatacgcgatcttgcgatgtctcccagctaattacccgttttttagatgtcctgtagcaaattttgccgccaaaaaatagtcattaaaataattaagtggtgattatatcttcagaatctatgataaccactagaaaaaaaaactatggacctactatgaacagcagctgccaccctggctcaaataagccgatgttcatgccacagtggactaatcatcagctacatatc

SEQ ID NO: 27435 - DNA, 876 bp, Oryza sativa
atagattgttgcaactgttagttataacttgaatgtgtagctagtttgcaacttgaatgtggatttaagtgccattttgacatgtaaccattcatggagtgtgtactgctatatatgttgttttattcccttttgctagacctattaaattttgtggatcatgtttacatttagctgaaaaaggatggattgatagattggcaacagtgtttctagctaggtagggtagctagctagaaatagtttgtctagctagctagttagggctaatgtagttccgaggttatcaaaccatcacaaaatacaaaatgcatggggaattttggtggattggtcaatgtaatccatggaaggaaccgacctagacaccaaaattctccacgcattttgttttctgtcattctttgatgattaaggaactttgcagattatctaaacttgttgatttatatacccatttgttgaatgcattttgtagatgaataccctcatatacaaaatgcattttgtagttcctttgttgatttatgttcctctttttatcccttcatgcaaatgattgtaattgatgcatatttctgagcaaaactgaggccatatctttcatagtataccccgtattacattggatctaatgctatttagtataatggtaggaaatttataagctttttcgccaaaattagaccatgacaacgcccggcgcaaacccgcctccccaacacctgcgaggatccaggaagaagcaaacccagccacggagacagttgccgaaggtcatccctcgacaacggtggtcgaacaacccgaaattcatggtaatttataggacaaatttcaccacatgacccacataaattttagctagcaaccctt

SEQ ID NO: 27436 - DNA, 712 bp, Oryza sativa
  unsure (1)..(712): unsure at all n locations
ctnnnnnnnnnnnnnnnnnnnnnnnnnnnnnnnnnnnnntatagggagagaggaatgctgttaatattgacacattgtattgagtcttggggccggtatatataggaatacatggattggatcttaagtaaactcagatagatagagatcgaaactaatcctatcctaccataacaaactggatacaatacgatcttatccatatactctaacatcccccacaatccaaacgtgagcagcgcggacacttggactggagaagaaactagcaagaatgctcaatacggatgatagccctttgtgtagtagttgacgtagccaaagcaaagggtgcgagggagccatggtagatgaagccgtgcgtaaagttgacgtggtcgatgtagccaaaattgaggagccgatgatgtcgaggtagtcgagccgtagggcacgcatggggcgccgtagagtggtcgtgaatgcacgggagggcgtcgtggaccaaggtgcgtgaggacgcgctggagacgatgacggtgacacgatcgtgacaatcattgaggtagatgatgccgaagagccgatgtagtcgaatcgtgaaggacgagacgtcatacagggtttgccagaccccgggacaactcgggacgaacgcgcgtgctggtgttgccaataccgcgtgggcgaggtaggggaccaccatgaatcatacgccaatgtcggaggagac

SEQ ID NO: 27437 - DNA, 1464 bp, Oryza sativa
acgtcctttcttgttcattattattgccagaatgaaggtgcacacttcgcctctgatagcggggggttgatggatgagatcttgaggccagctctacctttctgtttaataaacaagatgttagcacgttttgaatagcaatgttggtattgaaatgagcttattcgccattagcaacaacctcagggtcaaaatctttcacctctcttagaagtgttgacatgctgtggcacacgtgaaaaccacattggtctccgatctgttgtgcgcatgcgaacttggtgtcatggtaaagttcgtccttgccctccttgtgcctaccacccttttccacatatgggccccaagccatatttaaggccttggtgatttcagtgaaatcataatctttggacttattggagttaaggtaggtaaccctactccacttaggtacaatgactaggagaatccaatgtcgcctgcgcagtggttatgtagcattagtactaagaaccttaacttcaaaaatagtatacacgaagggtattggcctcttactcttggttgtgtgcgcacatgatgtactccttgtcttgatgggcccataaacaccttagtgaagctctgttgtaaattaacctcgttcaccatggaaggatcaaagaacccaacctgattaccaaggcgacgactcttgatccaacacaaccttaaaacatttacgtattagaactaatttaattaggagatatagtccaatcatatcacaagtatagaaggtatgcacttacaaggtgtagcattttagaagaccagtgtccaactttcggatcctgaaaaggtcaaagaggtcatcaaagcctatagttatataggcaggcgacgataggaacggctggtggtcgtgatgtccaactatggatgactccctcattttccgcttgccattgcttagctccatgtattgcttatgtagctctcggcaagcaatacccatcatggctaacacattgtcctccaccaatggcatgcctagctcaaattgggctggcgccctcacggccttccccgctttgctcagcggcatcgacgttgcagccttgcccctttttggctccggcgccaactccccgaccttccccttgccgcgttcacgcttcttgcctttgacaagtggtggggagctatcggcctttcttgtggtctttattggagccaagctttgagctatatttgccaagtccatatcagctccaccaggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcattggggggcacgggcagcggatagcctgaacaggtgtcctttactgtat

SEQ ID NO: 27438 - DNA, 724 bp, Oryza sativa
  unsure (1)..(724): unsure at all n locations
ctgttgcaacgcgggctatagaactgcttcggaatgcatggatgaccattcgttaaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttgaaaccggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctgnnnnnnnnnnnnnnnnnnnnnnnnnnnnnnnnnnnnnnnnnnnnnnnnnnnnnnn

SEQ ID NO: 27439 - DNA, 686 bp, Oryza sativa
  unsure (1)..(686): unsure at all n locations
nnnnnnnnnnnnnnnnnnnnnnnnnnnnnnnnnnnnnnnnaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcgtttgcaaaagcagcatttagcaaaacatttaagagaagtaaaacagtggagtaattaatcagaaattttaatcaacacacccatgctgcacaggcccaaccatcctgaacaaccatacccggctgtacagaactaactccaaaccaggagctaagcaaattattaccagctataacatccataattattgtgagaggtgtgagactaatcacgaaaaacattgctcaacccgcccataaccgtgggcacggctattcgaatagttttactctggccagaggtgtaccactgtacccacaagacacagcctcaacatcatgtctaccatgcgtcgcgatactgaaag

SEQ ID NO: 27440 - DNA, 3362 bp, Oryza sativa
  unsure (1)..(3362): unsure at all n locations
ctgttttgtaccatcaacgattatccggcccttggcaacctttctggccaaactgtgaaagggaaatgggcgtgttcggagtgtatggaggaaacaagaagcaaatggttgaagcattcacacaagacggtctatatgggtcacaggagatttctcccaaggtatcacccgtataggaatatgagaaagaatttcaatggacacagagatacagccggacccccggcagagctaacagggatagaggtgcacaacttagtgatgggaataaccaacgagtttggaaaaaagaggaaagttggaaagacaaaagagaagagcacatcgaaggaaaaaacagaggagcatgtggaaaaaacaaaagacaaaagagaggagcatgtggaaaaagaagtcaatattttggagactaccatactagatggattttgaagttcgccactgcataggtttgatgcatgtcgagaagaatgtatgcgagagtttaatgggattactgcttaacccaggtactacaaaggatggtctcaatgcctgacgagatttggaagaaatgggtgttcgctcggcactacatcccataaccacggaatccggcagggtttaccttcctccagcctgctacactctctcgaaagaagagaagattgatttgctaacatgtttgagtggtataaaggttccatctggttactcattgagaatcagtaggctcgtttcactacaagatcttaagttggtaggaatgaagtcgcatgattgccacgttctctaatatgttcgcaatgatcaatagtatattgctgatgaaatagtcaaataaaaaaattaagtgaagcacccactagaagtgaaataaaataattaaattagtataaccattggaaataaaataaaaaattagtaaaataatgaagtgcaattactactgttagtgaaataaaataattaagtataacaaaaatatatagtgtatgtggaaatatgttaaggaaaataaaagaactaagtgaaataaaataaaataaaattgctgtaggcaaactcacctatgacgggctctaactgtggggccgtcacaggtgaactcacctgtgacggcccatagtttgggcccgtcacaggtgagtttgactagggttgacctagggttggacatcttctagatatcgatccagatccggcacccactctcactcactctctcaaccaccgcctcgcctctctctctctcaatccagatccgccgccctcctttccaccaccgcctcgacctattcaccggcaccctctccgccatctccggcgtcctccccaccgacaccataaactctccaccgccctcctcgacgtcgtcctcttaaccgatgcctcgacctctccaccgccgccgtccatctnccgacgcctctctgacttcatctccgccctctccaccgccgctgccctctctctacggccactgggacctcctctcagtcgccacaccaggaccgtcgtcgccgccaccgggatctcctctccgtctcctcctcagcgccgccgtgccaagaagcctgccgccgcgccaccgtgccgagaagccatgcgctgtgctcctccactgatcgtcgtctcctctccaggtaccgctctctctctgatgccgatgaatgaataaatgatgcaatggaatggatgaatgaatgatgaactttggatgaatgatgaactttggatgaacgatgaacgatgacttttggatgaatagattgttgcaactgttagttataacttgaatgtgtagctagtttgcaacttgaatgtggatttaagtgccattttgacatgtaaccattcatggagtgtgtactgctatatatgttgttttattcccttttgctagacctattaaattttgtggatcatgtttacatttagctgaaaaaggatggattgatagattggcaacagtgtttctagctaggtagggtagctagctagaaatagtttgtctagctagctagttagggctaatgtagttccgaggttatcaaaccatcacaaaatacaaaatgcatggggaattttggtggattggtcaatgtaatccatggaaggaaccgacctagacaccaaaattctccacgcattttgttttctgtcattctttgatgattaaggaactttgcagattatctaaacttgttgatttatatacccatttgttgaatgcattttgtagatgaataccctcatatacaaaatgcattttgtagttcctttgttgatttatgttcctctttttatcccttcatgcaaatgattgtaattgatgcatatttctgagcaaaactgaggccatatctttcatagtataccccgtattacattggatctaatgctatttagtataatggtaggaaatttataagctttttcgccaaaattagaccatgacaacgcccggcgcaaacccgcctccccaacacctgcgaggatccaggaagaagcaaacccagccacggagacagttgccgaaggtcatccctcgacaacggtggtcgaacaacccgaaattcatggtaatttataggacaaattttcaccacatgaccacataaattttagctagcaccccttagcaaatgttgccttctgtttgtgctgcagaattgccgcaggaacaacataaatcgatgttgggcgggacaagtgcaagtaggtcgagtagaaatccccggtcacaaaatatatggccgaccacagtgcaagttataagagaggttgacgctagtggtaggcccacggcgcccaagactgtcattggaagatggtctaactactgcgggctggcggcacgtgagaactttgggatcctccataaagatatcggcaaggtcacaaaagccgagaaagagcgagcttggacagcaacggagaaatggttcacatttccggctgaagcaaaggataggctcaagtggaaggcattccataagatgggtaaagcttggaagaattagaagtcgaagctcttcaccgagtttgtcaacccgcccggcaatcatatgtcgttcgatgaataccctcaaataaccgaggcggtgtgggaggaattttgctctctcaaaaacacccaagagtttagggaatcaagcgagacacatcgccaactgcaacaacgaaatgagcacccacatcggttgggcaccgcagggtacatcggcaaggaggcaatatgggcccaagaagatgcagccgctgcagcagcgaatgtccctgccccgttttcagacatccctgaacaaggagctcgcaactggtcgcgggcaaggggtaaggtcaacccggacggctctgtcacatttgagaacaaaagt

SEQ ID NO: 27441 - DNA, 1960 bp, Oryza sativa
  unsure (1)..(1960): unsure at all n locations
nnnnnnnnnnnnnnnnnnnnnnnnnnnnnnnnnnnnnnnnnnnnnnnnnnnnnnnnnnnnncatatgtcgttcgatgaataccctcaaataaccgaggcggtgtgggaggaattttgctctctcaaaaacacccaagagtttagggaatcaagcgagacacatcgccaactgcaacaacgaaatgagcacccacatcggttgggcaccgcagggtacatcggcaaggaggcaatatgggcccaagaagatgcagccgctgcagcagcgaatgtccctgccccgttttcagacatccctgaacaaggagctcgcaactggtcgcgggcaaggggtaaggtcaacccggacggctctgtcacatttgagaacaaaagtgatgccatcgtctatcaggaactggtgagttcactacttaacctaactaatttccattcgtataaagtagaagtttatataaacgactcctttttttctagttgggcttggctgctgaacaagcttcacaaagcgaggttgagtccgcgccgaagaggcgcgaagatgacatcctcacaaaggcgctcggaaccaaagaacatcctagccgaactaggggaattggtagcgatgtgccctggaagcatggactcccgcagtacagctcccaatacaggaaacggaaagtctccaaggaagagaggggcgctcgtttgaaggccgaatttaaggttgaggtcatccaagaactagaagctagcatgaacgctatggtggaagaaagggttaacaaggtcctcgccgacatgaatataccccgaggcacaacacctgctgtgcatccaactccttgtgcacaacacgacgcgagtccgtcacagcataggagtagttgtgcatccacagaggtgccggcccctggtctcccggtcgcaccactagctgcagtggaccacatagaggtaattgatgttatccaatccatatctaataaaaaaatctttacacgttccaatattaaattcaaactttcacatatgcagggcatagcacagtgtgtcctactggcgagggtccacccaactttcgctcccgaagtcgctaagggcatggctttcaagccctcggttacagacaaggtccacggcgcagacctgctagctaggtatgccaaggtgtccatcgatacagtaaaggacacctggtcaggctatccgctgcccgtgccccccaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcctggtggagctgatatggacttggcaaatatagctcaaagcttggctccaataaagaccacaagaaaggccgatagctccccaccacttgtcaaaggcaagaagcgtgaacgcggcaaggggaaggtcggggagttggcgccggagccaaaaaggggcaaggctgcaacgtcgatgccgctgagcaaagcggggaaggccgtgagggcgccagcccaatttgagctaggcatgccattggtggaggacaatgtgttagccatgatgggtattgcttgccgagagctacataagcaatacatggagctaagcaatggcaagcggaaaatgagggagtcatccatagttggacatcacgaccaccagccgttcctatcgtcgcctgcctatataactataggctttgatgacctctttgaccttttcaggatccgaaagttggacactggtcttctaaaatgctacaccttgtaagtgcataccttctatacttgtgatatgattggactatatctcctnnnnnnnnnnnnnnnnnnnnnnnnnnnnnnnnnnnnnnnnnnnnnnnnnnnnnnngcgt

SEQ ID NO: 27442 - DNA, 2531 bp, Oryza sativa
  unsure (1)..(2531): unsure at all n locations
nnnnnnnnnnnnnnnnnnnnnnnnnnnnnnnnnnnnnnnnnnnnnacgggtatatgggcccatcaggactatgatttcatgatgtgcgctcacaaccgggagtatgaggcctgtaccctatgcgtataccattattgaagttaaggttcttagtactaatgctacataaccactgcgcaggcgacattggattctcctagtcattgtacctaagtggagtagggttacctaccttaactccaataagtccaaagattatgatttcactgaaatcaccaagggcttaaatatggcttggggcccatatgtggaaaagggtggtaggcacaaggagggcaaggacgaactttaccatgacaccaagttcgcatgcgcacaacagatcggagaccaatgtggttttcacgtgtgccacagcatgtcaacacttctaagagaggtgaaagattttgaccctgaggttgttgctaatggcgaataagctcatttcaataccaacattgctattcaaaacgtgctaacatcttgtttattaaacagaaaggtagagctggcctcaagatctcatccatcaaccccccgctatcagaggcgaagtgtgcaccttcattctggcaataataatgaacaagaaaggacgttttcacgtcaaatagactcatgaacttggctagataatttattgtgatgtaaaaaagatgttttcataatttcttgtgatgtaaaaaaatttgtttttatggagtgcaatgtaatttactttcatatgtgcaatatttatggtagtttactaaagtgtcatcaaatttgatcaactgctatttatgttgtactattcatctattttctcctttttttttccttattgacaggttgtggaggttcacaacgaacagaatacaagaaattttggtaatcatttgaggactttcatggggtatgaattgtttcatagggtatgaattgtgtgctataataaattaaattgttgcatatgtgatgttgcaaattgttgctttgtgatggatctgtgatatgtgatgcatctgttatgttgggcagttggggaatatatgatatggagggggaggggtgactggcacctgtgatgtttctgtttttcagagggcatggctagcaattcctgaggctagccaatatttagcatttatttttttttctgtcagtgatggtttggaagaaaaatccatcacaggtaacctcacctgtgatggactcgcaaacgtcggaccgtcacaggtgacccacctgtgacgggcctttattttcgggcccgtcacaggtgggtcaccctgtgatggctactatataccggagatcatcacctctgacgggcctttatttaggggcccgtcagagatgagacacctgtgatgagtcctaacttgccctaggctagctgagaccaacacctctgacggccttctattaacttgcccgtcagaggtggatgtcaccactgacggccggccacccgtcaaaggtgactggactcaccagtgaccactgatcactgaccaagcccaaagccgtcaaaggtgagggtttgggcccgtaacaggtgaccttgaccagtgtagtgatattataagagcattcctcatattcatacagatgttaatgaatctagactttctagcgacatgtgtttagattcattaacatctatatgtatgtgggcaatgctaaagtcttataatatgattcgaacgaagtacgcacgtggtaaaaaaggtaaatccacattttactgagattctaatcaaaacagtttttgctagttgctctacatttagttcggcgtagattttgctccttaattccaaactaagcaccttaaagtcaacgcactatttatacaattgtctatgagtaagactacagactataacataagaaaacacaatgttcaaaacataatttatttacataatatgataatccagcctacctcctattttcagtaggttaagctattcgtgtcggtatgtagtacacgtaatctttacatcagcccctgagaccattatagtcgaaaaaataatcttcttccgaacgcttcacaaaaagccgagtgctccaggccgagtttagttccaaactttttcttcaaacttccaacttttccatcacatcaaaactttcctatgcatataaacttccaacttttccatcacatcattccaatttcaatcacacttccaattttgacgtgaactaaacacaccctcaatatatatgacatagtctcccgagtgcttttatcgactagatgcacctaattgggtgtagcccctaactatgtggttagttaaaaaaactaaacatataatcaaagagtaaataattcaaccaaccgagtggatttaatgacatataatcaagagataataaaaaaaataccattgacaatcgtccaagtcccagaaataccatcgacaaatgtgagttccaagaaatgccagacaagtgtgagttccaacaaatgccagacaagtgtgagttccaag

SEQ ID NO: 27443 - DNA, 15592 bp, Oryza sativa
ccaaaaataccatcgccgtcaaggtttcgtccattttgcgccattaaaacacactgttcatcatatagaacttaacagcacggaatggacggaaacctaacggcgatggtatttttgagacaaagtcgtttgtacgatggcatttcttgaaactcacacttgtcgatggcatttctgggatttgaacgcttgtcaatgatatttcttggattatctctataatcaaagagtaaataattcaaccaaccaagtggatttaatgaaaaataatggcatatgtggtgcataatcctagttgataatacacaaaacaaatttaaaacgcttgaaaactacaaaaaaaaaaccataaacagcatgaagccaaaggtattgctcataagaaaagagcacacatatgtggctattataaaaacaatggcagccaactgcattataaaatatatgctaaacagttcttattctctactattataaaatttgaagatgtttttgccagtagtttggtacatcatccgtgtatgagtcagtttttaagtttgttcgcttttgaaaatacatatctatattagagttggattataagtttgttcgcttttggaaatactttttaagaaatctttttaaaaaaactcgcatgctaatttgacatgattttctagaaaaatatatattcaagcgaattctcacagtgaatttcacagtgagtaataataagattaaatagcattcacccgttgtaacacacgggcacttttttctagttaacttcaatatagaaaagttatagtataagctgtaaagttcactgtttgcctcctctttgaagtgcattataccaacctttataaaaaaaattgtgtaattactaaaaagaggatttgaaaggtattggacacgtatccactcacatagtgcaaaaactaatatgcttaaaccctaaaggacacgtagtaggccacacctgaaaaatgggttttaaattgccaatgggcctcaacccaaagatagccatttaacgatagccttaaaataatcgcagcgccgtccgtcgtcgtcctcgccagttcatcttctaaaatttcccctttcgtactcatattaaccgccgccgccgccgccatcctcaaatccagagcaagaaaagaaacctaatccaagttcccactcatttcacctttgacaaaggagagagaaatcactttcgatcatagggtagtttcatatgtcaatgagattaccttgaaggaagtggtgaaagaaggcgtgatcccggcaaaagaaatcatcggatggcgtccagcccatggtgaggagttcccgactccaaacaccatcgagattgtggtatttacccctttgttctctagtagcttctgtcttccgacatctaaattcttccgtggtcttgtttacttttatgggagtaagatatatcatcttaaccctaattttatcaatcactttgccatctttgttcgtctctgcgaagtatttcttggaatccatcctcatttcatcctcttccgtggaatgttttacctgaaagcccagtcgactaaagaaaacccttgcatcatcggcagctcttgttatcaactacgtggagctctccgcaaacgcaaagactatttttcccttcttcgaaaacttgcaagaaaggctggcattcctgtatggctaccttaaccaccgcggctttcgtctcgcacaattaacatgtgtccagagatgggcctagcgagcaactcaaaagctagctcgagctgcctcgttctgtctaacaagccaatcccatcgcacagcttgcgagcgattctaaacaagcctagccgaatgagctaacgagccagttatttttccagccccagcctcagccttactctccatggttcgatcgtgtcattgcttatcctgaaccataataatgttctgatagttttctgctcattcccaacgaattgggcgtgccaaagagcactgtattacagctttagcatttgcataatatgccaagatctgtggtgttgtagaggaggagaataacaatatctacgcgtgacacccatccactactatagaaaagaccattggttccggttgggaacaggccgtaataggcgtcagatttctcaactggcacccggtatacggtgctgatgacttcgtcaacaataccggttatagaacttccaaatgaaactaaacagcagtaaaggatgatgtcgacggggggctacagcattgccacgacgaaagcatccaaaagcctctattaacgatgtgcacatcgcttgacacactgactttaccttctcgggaacgacacaattcgaggttttctgatgagtcgtagattctgcttaggcatcaccggactcaaaaacatttgacatggagcactccatcaaatctgaggagcacaaattgcaatcctgtcgccaagagttaaacaggcggtctgcgttcaacccgaacggagtgctcaacattgttactgctacaagtaaatttagaagaagtccccacaatccagccaatttcaaacatggtcatatttggatggaaacaaacttctgcattgttacatccagccggaacataatagaggaattttttttaagagaagcataatagaggaatttgaggagatgacctgcaagtgtccccgacgactcatatctctgcatgcctggcctcaagcatcaatctagcatatcctgcaagaagcaagccttggaatctacaccgtaaaccaacgctagcactccaagtataccagcatattaagttgtgatccaaattcatttgtacataataaaggctagcttatgccggagcgaagcgtagggtttgtgcatttggggatgcccgggcccatcgttatcctttagggtttcaccttcatatataccttttgtaagccgttgttcagctgtaacctcatcctaatatagtgaagatattttgatggctggcacccgtggtgttttttcttctgctttggagggttttccatgttaaatctcgtgtcttctgtcattgatctattattatttatcgtttatttgcgtatcgttttctaacacctttgtgttgcaggaggagaagaacaatgaacacgtgacaccattcactgcataggattcaggccgtgttaattaaatttcaacttttttctacaaacttctaacttttccgtcacatcaaatgtttggacgcatgtatggagcatcaaatgtgaacgaaataaaccaattgcacagtacgactgtaaattgcgagacgaatcttttgagcctaattacgccatgattggacaatatgatgctacagtaaacatttactaattaggcttaaataaattcatctaacagtttatagacgaaatctataatttgttttattattagtctatatttaatacttcaaatgtttgtacatatattaacatacgatgtaaacacagaagaaaagggagtatactgcatggtggataggaggcgatacctgaccgaaatttgtcaactcgactgtcaaataaacagtatatctttgacgtttcttatacgcgtgagattctttatttcggccgccaggcgagccgatctgcttctctactagtactactggtgctacattcttactgaaggtgtgtttaggctgtgtttagtcccacgctaaaattagaagttcaactaaaattaaaaatttaaagaaaaaagttaaaagtttatatgtgtagaaaaattttgatgtgatagaaaagttgaaagtttgaagaaaaagttaggaactaaacaaggccttagttcacgtcaaaatggaagtttgattaaaattaaaacgatgtgacgaaaaagttggaagtttatgtgtgtagaaaagttttgatgtgatgaaaaatttgaaagtttgaagaaaaagttgggaactataccaggcctgagcgagtaatgctacattagtactattctctcgaatctatttatctattaaaatactttctcgtttctaaatatttaacaccattgactttttaagcacatatttgatcgttcgtcttattaaaaataataattacttaatttttttaataagacgaaccgtcagacatatttaaaaaagtcaacggcgttaaatatttagaaagggaggaagtattaagttaactgggagatgatattgattggatccagagaaattgatgctccaaacgttcattctcagtgttagtaaagtaatgaatttaatggatggcgtgatagtttcagctatatatggaccttatcaagattgatttgcacagtacaagattttggatatatataattatctcaataatagtatatgctataaggagcgagagagatattcacaagcattggttgatggtaacgtctaacagaatgctgccttgtattggcaaggtacattcttttcttttttaattaatcatccgtatgttcaatttgatttgcatatacgtatatgctttaattggagctcatcctaatatttctattccgggattgcctcggtatataagaatcaagtttcaacatcacaatatctatcaagtgcttattactctcttcatctatctcttcatctatttttgataggcatatttctaaatctgtaaaaaaaaaattgataggcatatttttaatccaaccacctgtcctcccaatgactttctcgaatttaatgcgtgactcttcattctttcacgtaagattggctacatggatatcgaaaaatgtaaatatcaatgaatcgcttatttacgaggaataactagtagcatgtttaaatggatgatatgtagaatttcttatccttgatcattgtattacgatgaaatatgactatgaaaaataaatgatcattgtattaagatggaatatgactatgaaaaataaatagagggagtactaattaacttgcttccataacccgaataaatgtcatcacataacaactgtgtcagagcatctttaatggcccacaacaaaaaccatataaatcacgccacataccccatcaaataaaaacttttaagttactcgggggacaacatccacttatttattatacatgctaaaatgaatataaaagaattgaaaagatatattatttgtacttcgtaatattccacttaaaaaatatgcaagtttttttaacttgagcttctaataaaaacaacatattgtaccatatataaatatttatatatacaagttatagtttaatttattttttaattgaaattaaatctcgtagtgatatatttcaagtaatatatatttttttagatttttaataaccacttagttataagatgccataaaaaagtggaccccacatccatttgtcgcaacagtcaaacctcagcgcaacgatcttatgatcagcatgcaacacgagaatgctttacgtccacactgcttacactgactgacacatcgacgttgccacgcacatgacgcatgccactactcatcgccaacgtccgatatttcgtcgtcgtcgtcgccgccattcgcagcgcctcgcggcgacggcgagcacaccctcgccgccgtgaacaccttccccggccggcagaagtagcccttctccggcgcgcagtgcgagtcgtcggagcacacgcagagcccctccatggcgcagccgtcgccgacgatgaccgggctcgccccgccgacgccgagcacctggtcgctccactcgctggagaagacgccgtcgggatcgaacctgtccttcaccctcatgaacttgccggcgttggggtacctggcgatggcgccgtcgaaggcgtagttgcggttcttgccccagtgcggcacgccgccgtgcttgcgcagcgccatctgctcgacctcgtcgaacacgtcggcgtgcgcgcgcggcgcgccgcgggcgtagctccggtagtaggtgacgtcgaagtccaccgagtcctccgccttgccgaggtacgccgacgacgccgcgacgtagcgcatcagcaggcccatcttggagtcgatctggcagaacgccgccgggttgaggtcgcggagccgcgcgacgtcggcgacgaacgccggcgcgcgcgacagcgcgatgctgaagccggagttgtagaagaggtgtccccggaggcggccgttccagaggcaggtggaggtggggatgtgcccgtcgtcctccatggcgcccgtgcacaagctcgacgcctggatgcggtgctggtagcccaccaccgggtaccccgtgaaggcctcgccgtcgttggtgagcccgtagttgaggtgctcgagcgtcgccggcatcacgcgcgacgccgcgcaccgggcggcgtcgctccctgatctctcctccagccactcctccgcgagcctgctggcgacgaggggtagcgtcggcgtcggccggaacgccgggtagtcgctgcggccgtcgccgggcgtcgcgacgtcgacgcggtcgtcctcgcggtacacggccacgcgccgccgcggcagccacgccacgtcgccgaactcgtggaggcggccccacgcggcgaccgtgtcggcgacgtccgagtcgttgcgggtcacgaacgccaccgaccgcttgaacagcggctgcagctcgagggtgacctgggagatggcgccgaggacgccgagggagaccttggccgcgtcgaggtccgggtcgccggcggcgagctccctcaccgccgcgaacccctcgctcgccggtgccggcgtcacgatcctcatccccaccacgtactcgtgcacggcgctccccttcccccacagcgagctcccgtgcgcgcccgtggcgagcacgccgccgatcgtgaggcccgaccagtacggcgagtgcggcagcgcgagccccgccgcggcggcctccctgatcaggtcacgcatcaccatgccgctctccaccgtcatcagccgccgcgccgcgtcgacgcgcaccgcgcggtccagccaccgcgtgctgatgacggtgccgtcctcgccgccggggcacgccagccgcgggaagctgttggagtacctggtggcgaccttcaccttccgccccgccgccaccgccgccgccacggccgcgacgagctcctcctcggtgcgcgggtacgtgacgttggcggcgcggcagatggcgcggtcggagaaggagccgtagatgttcgtcagcgtgcagccggacgtcccgttggcggcgcagaccaccggccccggcggcggacggtcgccggcgaggtgggagacgatccacagggcgagaatcacgaggaggccggtcagagcttggaggagaatgacaaggagacgtctcaccattgttgcttaacttggtggaagctctgagtttgacctggaaagtttgccgggtagctgcagcttaaatcagcaagcttcagcttgcccacttcatttctgtcggtggaagcatcagaattcagaagttcaccagatggagtactattaatattcagaagttcaccagatggagaggaacttatttccgtcttgaggccagaaccttctgcttgaaacatttaataaacggagaagcgttactttgtacgcaaatcgtacacacaaaatcgtacgaaaatcgtacacacaaaattgtgaataatcgggaggaatccctttttcaccggttctgggactgcccatttgctaggtggatttggcagaaattggaagagcatcgaggtgaggacattccacaaccgccagctgaatgcagaaacaataaaatcttatctgtttggctactggatcaactatcaatacagacacaagaaatctcttcagtgctgttagttacaatctacattatgtggtcagcacggaatgatgcacggaatcaacagatcccaggtaacccagacaggatggtggagagaattttgttcctcctggaagagtgggcaagtttgtttgaaaaatctgatcatactgttcctagtccgacaatgcactggaggttgccggaatcaggatggattaagctgaattcggatgggggatttgctgcagacgaacagatgggaagtgggggagtgatagcgagaaatgatcggggtgagtttatgggtgcgagcaggattttcttcagggaagtgttaagcgcaacgcatgctgaagcattggcttgcctcgaagcgacgcgggtgggtgcaagacttgcagcaaccagagtagtcttcgaaacagactcagctgaagttgtgagtttggtgatgaataaaagttttgatcggtctgaaatcgggcctgtaatccaagaactgaagaggagaattcagtcattccaggatttcaagctcatatggaccaggagatcggcaaataaagtggcgcaccgtttagctaaggaaagccttaacgcgcgtgcttcttctagctggatagtgtcagcaccggagtttttattttctctgttatcagaggactgtaatctggatgctgtaatttgagtttttctttgctttccactctcaaaaaaaaattgtgaataatgggaaacaaggttctgagaagataaatggctcggaaacgtggcttttaaagacaaatatccatctttatacgctattgtcagaaagaaaagttctactattgtcaatgttatcagatctattccactgaatgtttcctttagaagagttttagttggtcagattcttgcatattggcataaattgtgtgcgtctattgtacatattcagttgaatcaatcctccgattgttttagatggaattattatcagaatggtagattttctgttagatcaatgtatctagctctgattaataatggttatattgagagaaataagattatttgaaagcttaagatgtcgcttaagattaagatctttatgtggtacttgcttaaaggagttgtactaactaaggacaaattggcaagacgaaattggaatggcagtttaagatgttgtttttatatgaaaaagacaccattaaacatctttttatagactgccattatgcaaaatttgtttggagagctgtacagttctcttttggtttataccttcctattaccatatctaatatgtttgatagttagcttttgaggtagataagaagatgactaaactcatacttgtaggagcatctgccatatgttgggctctgtggttgagtaggaatgatatggttttcgacaaatcaccatctatatcatatatgcaggtaattttcagggcaacttattggctccggttttgggcacagctgcaaaagtgtgaagatgatggagagcttatgaaagttgcatgtcataggcttgagacgacggttatgcaactttttacaaactatggatggagatttacaaacagacttcaataaatgtgttctccttatctttgtttggtctttttattttattggatgtgtttaatttcgtttgaactacatcttttgttagagtgatactttgtaataattggctgtagctctgatgagcaaaggccgggatgtttattccattatctaaaaaaatgtatagcggtcctctcaatgctagacacttaattacactcgctcacttattatattgctggagtccaaaatactcgctgatgtatccctctgcatttagagtttgtttggttcttggccacgttttgccaaacctaagcttaggcatgcaacaagtgcttaggttggtgtttgcttttctactaaccataggcttgccttaacttgataggcatgtttctgcttgctcgctgtgtcttgttttgccaaatctgtggcgttctttttctctgccacaagtgcggcaactagcttaccttaggcgtggcaattttagtcccaaaccaaacaggcccttagtccgtccccctaggctcctagctatctctcctaatcctatatgtgcactttgtcatttctcgtgtttgcatgagcgattggtgttttgagttgatgttttatttatttctctatcaatgagataaggaaaatcttttatctatgtttggaaacagtagcatgtactacggaattgtctattcatcacttgagggaatatccattcatttttttaaggtctatgtgctacaccatatacgagttatatgactaggtctatgtttcgcaagaatattatattgcttaatgcctcaatggcgcatagtgcagtggtcctgtacctttcaccatctgttgaaaaacatgaaaattaatactaaaagaccagcttaagttggcctggtttcaaaaatatatacaaccaggcttgtctcaatgtaatatatatgtttacccactcagtatgggtgggcgttcagtctggaccggaattcttcattcccggttattcggtcattcagaactttggtctttcgaaacagaaaattgaggtaggcaacaaaaaatatggttgggagtgatagttcggttaaccggatagtctgtccggccttcggtttccaccgaactaactgaagcgatggtgatggcaatggcgcccacggcagcgatgacggatgggaggatgctagtggcagcggtgaccctaccctccctctctcatatccggtggtggaccgacaacggtagcatcagcagagggaacgaaagcaacgacccttcactcctctcccctcctagaaccaagcttcgggtgcatcgtctcgtcgacggcggctccttcctgcctcgaggtgctcttggcaacggcagccatgatggcatcgacgatggcgacggggggcggatctagtggcggtatggttggagaccaccggtagtggaaggagtagatggggcaccgcagtggcttccccactcccttccgcttgcctccctctcccaaatctggctgtagggggcgactagggtgtggcggcggcgatagcagccgaaggggttggtttcggcaatagctcgtccacggcagcttcagcaacctccaaggtcaccgatgatgacgacgaccagttttgatgtttatttgcatgatatttcatttgcatgtgttaatcttggatgtcaatttgaatctagatctctgaatgttgattgattttttttttccttagtgatgttgcctataaaaattaattttctcaggtgatcatcttaagtgtttgcaaacaaaaaatctattttcgtaagcggatcgcaacactgctagtcaaaatcatttattttcaatagcctttaggtaattagcggctaacaatgccgtcactaaaagccgctatcactaaaaatcagttttgaccgccgagaaaacactttatgaagtgtacaaccatttactctccccgtcctaaaatataggaaccttgtactgaatgtgatacatcttagtacaacgaatctggccagagaccctgtccagatttgttgtgctagggagtgtcccatttagtacagggttgctatattttgggacagagggagtagaaaaccagtcgcatgtttatctgaaccaagctccatacattgagggcggaatatatataatcgattgggagctttctattaagtcaattagatcaatcacaatcgcagggttgagtagattaatttatttgattattctatactatagaagacaaattataatcatttttgttgtcgaaatgataactgcatacgtcgaaagacgtggttactcaacagtggttggaaggaaacgaagtgtattgaatcttgaatttcttctttttttctggatccccccattacatggccctaggggactatttatagcccaattacaggttcttactactagggtttaggttgtacaggggaatttacatgattactcttacaaaagggacatttacaggggtacataatgttataggggctcatgggcccctgatgggccgtctggcgatcgccggccctatagcccctaggcttgatgggccggaaaggcttcttcggccctcgcgggggcgaacttgccatggcaaagtcgtcttccttcggcagatagtcttcgccttgcacctttcgcttgagacgcctctggtctggcaaggcactcgtacgactcttcgcctcacgccgttcttgctccatagccttcgccacgggtttcagcagatgtggtcgaagggtctcatgccatccgccaacaagcccctcatgggcaagggtgagattggagcttcggccgagaccgtgcaaaccatgtggtatggtatgcggcgccccctttcgaccgatgctcctgccgaaacctacattattcctgcgaatgaagtttgttacttgtgcggctattattattttgccgcgcttcgcctcctgcgattggtggttatatattttcttttcccgggccgaacggaacagtattgggctttcccttcgtgggctttttattgtgccgctcggtcggtgggaatttaccgtttcgcctacccttgcgacacgtggcgctttattactggtgggtaggcgaacggtcgcccaggtgagctatatattcccactgctctttccttttcttccacagcatctctcaacccctcaagcgtttcgcccattctctttcttcgccaccgcaaacgcaccgttcgccatggcccctcgcaagccaaaccctgcttcggcgaaagggccggatctcggccgaatcgatgacgacagcaccgcctttttgggggtctctcttgtggacgacgtcgagctggcgaagctggtcagctttggggcgttggtcgaggggcaggctttctccccagggaaagccgtggtgccgaaacctatcgacaatcggacggtggtattcgccgtcttttttgaggcagggctacggtttccctgcaacgtgttgttgccggagatccttcgcctcttccaggtggaacttccgcagctgagcccgttggcgcttgtttggatcgctatcttcgactaggcgtgccggatttccaggtttcagcctaacgccgagctcttcggcgccatatttttcgccaccgtgaactcgaagacggtgcgtcccagctggaacgaagaagacagtgttcgggagcgtgaactttaacgttcgtcccgagcggtccgatctctggccggtaaacgctgccatgtcgaagtgggactgccattggatggctaggtggttctatcacaccatccccttcgaggctggcactgactcggcgaatgcccaccgttgccgacgtagggcgatcgcgcctaaccggaaacccaagatcaccgtggacggcgctatggaggcgcggttcgttctgctgcggaaggtttgctcccgccttagctgccgtgacttattggaggaattctgtatgcttcgcatctttcccctctcccagtcatggcaagtcagagttgatcaaggcgaagaggttgacggtttgccgaacctggttcttcctgaggggacgaacagtaagactgttctcgtgctatacactgttgtgctttgttatcttgccttatctgactgttaacatagctacacactttacttttgcagcgttgaccctcgaccaggctgaaaacgaggcccgcaggatgatcggcgacgtgtcggtcatcgagtaaagccagttgctaacacgacaagcggctgggcgggcgaaccgggtttacaacggcgaattgcctcctcgggcaaacccccacaaagctgatgacgatgcagggccttcgcgaaagcgaatgcgcggacacgtgaagcttgcccctaggaagcgaagggttcctgcttcgtcggactccgacgctgacgacgaggacgacgccgaagaacgcgacggcgaggaggaaggagaggaggaagaggaggaggccgtggccgataaggccacgaacgacgcgatcgaagaccgcgtcgacacccccggctacactcctaccccaagtccctatcacaacgagaccggggtggagtcgaacagctccccccttcgacggaaggatttggaaggggcgaaggccctagttgcgttctcctcgggcaaggcggcgaagggaggtccggtgcggaaggtctctaaaaagaaaggactcgtcgacatcgcccgcgttttcagcgactacgaatcttctgacgggactccaacttcgcccgttggccgcagtttggacctttcgactgctcccctcgctctgctcggcgttgctggggcaggcggtaacgccgccgccggggcttcagcctccgccgaacggatcgtgtcggctgcggcgagggttttcgggagccctctgcgtgagctagctatttcgccgctagtcaaggcgaaggggaagtgtgcggccgccgaagcatctgcctcggagtattcccttgcggcgcccaacttcgcccctggtgatttcgagactcgggcggaccttattccctttgtggagggggtgagcaaccttgtcttgcccgccggcaccccgagcttgttcaccgaacttaatgagttcgacgaggggtgttccgccattaaaagcctggcggttcgggtatgccttttctttcgtcttcgttttcctcttcgtccccttttttttcgtctgacaattaaccttttgttcttttcgcccgctcctatctttcatctaggttcttgtggctcactgttcgacgaagcgaactgtacgggcccgctttgatggttttaagagccgtcttcgggccaaggatgacgaaataagctgcaagaacctggaggaggaggccctggccaacaccctcaaggaggcgaaaactgaagtccaacgccttcagtctgagctggatacggggaaagaggctagggccgaggttgatcgcctcaaggccgaactggagaaggagaaggcccattcggcggtgctgaatgactactacaaccttactgagccgaagatggaggctcttcgcctgaaggctagtagggctgaagcgagcgccgcggaggagttgcagcggttttcacaggagatggcgaagaccaccgaatctgcgagaacggcttgccaaacgctccgcctcgcccttaccgacatgggcgcgaaagtgcggggggtccctgctgaggatgcatcagccttcgacttctccgagtggacctagcaggctggcggatcggtttcggactgcgccagcatgtacggcgattgctgtgcgcgtgtatcggcggccttcaccttaggcccatttgcaacagttcggttgtgagcacgtcgccgaatccctacctatgtgaagggggactgggagattagggcgcaaaacatttcgcctgctcttcgcgcgtggcgaaaacagttctggcagaaagacggccggtccgctgccaaggtgcgccttctggagcaactagcgaaggcggaggcggcagatcggtgcgaagaagagggcgcagtgggcgaagaggttggaggcgatgcccgggatcacccagaggtgtgaggccctccgccctttctttagagttttgtagttttccaccctcttttgcgtttgcctggagaggcgaatgatgtacattcggcaggctaccaccaatccttaaaaaaggcttttttgtacatttggaatatatgacacaatcttaactactttttgatga

SEQ ID NO: 27444 - DNA, 1610 bp, Oryza sativa
  unsure (1)..(1610): unsure at all n locations
cgaagatgtaatttacttgtaaggtgaattgtatcgtgttgtgaaacttctattcttcgattattttttttgaagttaataaagacgtgttttatttccttttcgctattgtttgcatcgtcacattttgtgcttttgttaggtcagaacatgccggtccctttgcatatattagcgaaataggtgtactgacttttcagcttttcatcgttcgttttcgatctatagcgttctgtgtcgagagaaacgcttttgcttttatgctgatcggacgtaacgtcattcggctatttattttccgagacaagctgttgcggtttcaacgttcggcgagcgatgcttcggccgattcgtttagcctccctggcctttttcgctgatcaggcgtttgccttggggtttttccacaaattatcaatcacacgagaaataaaaagaaggcggaggacacagagattttatactggttcgggcctccatggtggataatagccctacatccagtttttttttctttttcctctctttcttctttttttttcttgccgaaaggctttcatagtgccgaagggcttacatagtgccgaagggcttacacgacagtatgcacatttttacaagttggcgatttgggtgccacccattctagtgggcttacgtagtgccgaagggcttacatgactgtatgtacatttttacaagttggcatttgggtgccacccattctaggcatagaagcgcttgagagaggcggcgttctaggaatggtcgaactcctcgccttcgagtgttgctaggcgaaaagatcctatcctggacttgtgtttgatgaggtatggtccttcccactttgattcaagcttaccaaccgctacgcggttcgccttcttccttaggacaagatggctagacatcagctctgtgggtcgaacttttttgttataagttgtcaaagtgcttgtggcgtacttgtgcatgtgctcgagcgcttcgaccctcttcgctcctagagaacataacccttggtgagttagcccctagctctgctggggtcattgcctcatcgccataaaaaagcataaacgggctaaacttggttggtcttgtgggggtcgtccgaagggcccagagaaccgatagcaattcctctggccatttgcctttcactgccccctcgagtcttttctttagtgcttctaggatcttgccatttgtacgttcgaccgccccatttgactgcgggtgcgtgactgacgcgaacctgatttacaggttaagcccttcgcacatttctctgaacttatcagagtcaaactgcttaccgttgtcagtaatgaactcttttggcactctgaaatagcaaacaatgtttttccatacaaacttctgtactgctgccgaagtgattgccccaaggggttcgacttcaatccatcgagagaaatattccacagctacaattgcgaatttatacccgtttcgccccatcgggaagggcctaatgatgtccagtccccatctggcgaagggccatattggcgcaatgggctgcagatcatactggggcgcggnnnnnnnnnnnnnnnnnnnnnnnnnnnnnnnnnnnnnnn

SEQ ID NO: 27445 - DNA, 1350 bp, Oryza sativa
  unsure (1)..(1350): unsure at all n locations
nnnnnnnnnnnnnnnnnnnnnnnnnnnnnnnnnnnnnnnnnnnnnnnnnnnnnnnnnctggtcaatttttgttgagcataaaagagggcaaccaagcagttttacaccaacggggttattagggagcaccgcagcacagcacttgagcaacgttggaggcttggagcacccaaggaacagctactgcaacagctggaaacactgcaaacagcgaactacagatacatcttggttatcaactcctgaagaaaaggcaatgtgtaaagccacagcagaaattccaagtgcctcacattcctgacaagaatttctcatggttaactgatacgatttcctctcctctcctctcccattcttacactacttaaaaagccattctttgtgacaccactcttttattttctagcggttttattaaacacacgcttgtaaaaatatattgggggtattttggtcacgaatcactagtgaaaatcgacatcacttcataggcccgcttgtaaagatagggttacttttacaagcgggtggcttaaatgacagccagcaaaaatcttatttgtgctgacggctgattaagagcaccgcttgaaaaaaaatattatggtattaaaagagagactccgaggcgcatctcttttttttttgtcctgtcaccactcccccttttacctctcattcctccctctctctttctactccctccagtgggccacgaccacggcagccgccgagtgctctcagcgatggccaagacggcgacgaccacgcagtgtgcgggcagcagcaaggttggtgggtggtgcacaggcaatgccgaggctggtcagtggcagatccggtggtgggaggcacatgggcagtgggtccagcgataaagaggattgcgggcagcggatctggcggcgggaagggccgaggctggtgaacagcggatccgtctgtgggaggagagtggtgtgggcggtggcaaggttggtgggtagcagatctggctgcaggaggcgcatgggcagcagatcttgtgacgaagaggcttgtgggtggcgggaaggcttgaaggcgtggattcggcagcccagtggagcacggataatggccaagaggccaaaacagggttacgggcacggtggggtgtcctagagggggttcaggtccaccgccagccagccacggcctccctcgccgaatctatccttcctcatccctccctcgatgacggcaaattggctccattcctcaccgacagcaacttggtgatagcataggccaccaacgacgcgtgcgaggactgtaattggggatttggaacaatgatttgcgatttgggaatttgtgattttctgtcgg

SEQ ID NO: 27446 - DNA, 1674 bp, Oryza sativa
  unsure (1)..(1674): unsure at all n locations
ccataattattgtgagaggtgtgagactaatcacgaaaaacattgcttaacccgcccataaccgcgggcacggctattcgaatagttttactctggccagaggtgtaccactgtacccacaagacacagcctcaacatcttgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaaagccgtgcccacgctggcttgtggttggcacggttaatgtttcacaatagtagctcgcgaaccggtccttaattgtcatgagcacgactcttaaaaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacccaaggtatcaaagaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaaaacttattaaaaccaaattaacagttcatataaagtaaacaaacatgtagatcataattttagatgaattatgagacttgacgggcctcattctgacttcatatgaatttattatgaatttacaagattaaatctaattaaagcccacttaaaaagaattaaataaatttaattctatttatggataactttaatatgtagatctttattttataaaacttttgcaacttgaaccacattaaactgagttacaaagaattagttatgaattttcaaagattaaatcggattaaagcatttatatagattttaattgaattatgacgcaataatgaattatttttgaaaaggaaaaggaggattattgcgtcagcgggtcgggttcacggtggaccgggtgcacggctgcggtctatggatcgggcggccgagatctaccctatccacaaagaacggccgagatctaaacggtctacgatcggtctaaggcagacggcaacgatgacgtcagcgatgacgtcatcaccggcgatggcttgggcggcgtatgctcgccggcgaatgacggcgcgacgacgcaaacggaggacaccaatgggtagagggcgacgcggcgaactcaccgagctcttggacgacgacaaacgacgacggatgacgaccgcggcgaggttgaagcggcggcggtcttcgggtcgnnnnnnnnnnnnnnnnnnnnnnnnnnnnnnnnnnnnnnnnnnnnnnnnnnnnnnnnnn

SEQ ID NO: 27447 - DNA, 809 bp, Oryza sativa
  unsure (1)..(809): unsure at all n locations
nnnnnnnnnnnnnnnnnnnnnnnnnnnnnnnnnnnnnnnnnncagcgagctgtacggtattcgttgaatatacatgttgcaatctgtttaagaactaattatcgattactgattttgactgaaataatgacacagctgttgatcttaacctattgatgagccgtgctaataatccggtaaccaggtcagtcgacagatcacagaacccttatctatgttttttctctaaatataaactagcaaataatatttaattttccatatttcctgtcggtatgtacgttcgtatgcactgcatgtagtctgcagcttaccttttcttctaccaaaactacagtagcatatgacattgttcaagctgttgatgatgcgaaggaagcgtccaaagtcaaggtcaggataatcagactttgttatggcataaatcgtaaccgacatgataattattaacaaaagaggtcggtataaatattcccctcacaaataatgttcatatttataggcattccgagagagctctcatgtttactataacgataactatctaaagatctggtagtttattaggtcgatcgtattaccaatgccctttgatcaatcaagaatttgtatgaaaaccaatattaattggacacttcgaggatgctcgcacattagacaaaaagatcttacttaccaccgttgattaggtggatcgcattactatgatcttcgatctattatgattcatgtaaattaaaatatgacatgaaaagtagcatgggatataaatttgttaatttaattgcaatgttttaaatgcatactta

SEQ ID NO: 27448 - DNA, 809 bp, Oryza sativa
ggttggtccacggtgcccggcccaatgacaagaaatgcgccggtggcactcggttgctcgttttagagtcggcgatgacacgccagcgttcctgtcattccaatggatgaaatagagtggcgtcaaaaagaaatattctcagcatggtgaggggaatatagaataggaaagagttggcgatggcgatggcttgtccgcaatggcggccttcgtgttcctcacagctagcggcgaatttaagatgggagaaagcagcaggggtcctctcctcggtttgaatggtgttggagtgaaaagtcagggtgggcaatgcgtctgggtggagaaacggatgggatcagcaacaccaccgcctgccacccttcgtcggctccggtgtgtcgccgctccgccaccccatctacaaaaagagagagggatttacatgtgggacccacgttggattcatttgagcaaagggcaaacttgtctttaatgattgtttctctctactattcctccgaaaataataaaataatcgcacgggtgtccagcagctaattacctttttttgtggtgccctttagcaaatacgcgatcttgcgatgtctcccagctaattacccgttttttagatgtcctgtagcaaattttgccgtccaaaaaatagtcattaaaataattaagtgttgattatatcttcagaatctatgataacaactagaaaaaaaaactatggacctactatgaacagcagctgcccaccctggctcaaattaagccgatgttcatgccacagtggactaagggtaccgagctcggattcgccc

SEQ ID NO: 27449 - DNA, 609 bp, Oryza sativa
  unsure (1)..(609): unsure at all n locations
nnnnnnnnnnnnnnnnnnnnnnnnnnnnnnnnnnnnnnnnaacatatatacacgtataaaaagatatacaaactttgtatatgtacattatcgacgggtgatacccgtagactggatatagagaatattggggtacgttggtacaaggatctacgtaatacgacatcaagcaaacaaaaagacgagcattatactggttcaggccccttgataggtaatagccctaatccagttgatatgggattatatgatggaaaatcataggttacaaagggaacgatggaactcgatgacaccggcgagattgtaatcgagttggttcgactagatctcccggcgatttggctcctgcaggcttcgacttcgtaggctgtggtcgttgtgttggctatgagattcgatgccttaagtcctcccagggggtcccttttatatcgcaggtcaagcggtttccaagtagaactcggagacatcagaccctatacgatacattgacgacccagtcttgtccgagtaggactcttattttctgcaaactccgtgaagaatttccttagtatatgcagagaatgttcatatatgcgcgggcatgccatatcgatatgtaac

SEQ ID NO: 27450 - DNA, 658 bp, Oryza sativa
  unsure (1)..(658): unsure at all n locations
nnnnnnnnnnnnnnnnnnnnnnnnnnnnnnnnnnnnnnnnnaaaaaaaattagagtgctaaaacggaaaatagaaggtaactcagatatttgggtaaaactttaagaggcccatttgcaaaaatatatatttccctgtggccgcctaagaggcttttctggaaaaaagccctatttttacatatagcttcttaagatacatctataaaagattttcatatatggtgcgagtcaatttttacagacacgaccagttataatccgtgtccaacctattgtttttttaggaaaatcattcgtgcaatagtgaatgcttccctgtactagttgcattaaccctgacattgccatgacgatcgcgaaggtagccatcggcagcgtctcgcaacaacgagcagaccctcgcctcggtgaacaccttccccggccggcagaagtagcccagctccggcgcgcagtgcgagtcgtcggagcacacgcagagcccctccatggcgcagccgtcgccgacgatggccgggctcgccccgccgacgccgagcacccggtcgctccactcgctggagaagacgccctcggggtcgaacctgtccttcacccttaagaactcggcggcgttcgggtacctggcgatggcgccgtcgaacgcggcgttccgg

SEQ ID NO: 27451 - DNA, 773 bp, Oryza sativa
ccatttaagcttggcttacactcgtaagattaccgaattcatgaggttcgccatgatgttaggattgtgcgtcgcatagcttaatccatttcaacaagatttattagtgttacagaaactagatggtctatagtacacatttatgctttcagtaaaagctggggcttttgtgcagaaacaagatagtctatgctccctgcaatctaaacactacagattgaaattttctgaccgttagaaatgttcaattgcacatcatgcgagcaactgatttgtttgcaatgtgcatgtgtcgccatttatgaacagactaaattctgacgcggttgttctctttgaccataaatctgttctgtgaacaagaaatatgaattggttgatgagctcattaaatctctgtagattccagctcaggatcggaggacccatcggctgtggttcagaagtgggctcgacctgctttgggatggaaagaaaataaggcggattacgggagtgtgcgacttgaattattgatttagccttgcagatagagagttggatccgctttccattggtcatctagtctaataggcaaccctcgcctcagtgaggaacttttgtccgagcattcttgttctacaattaatcggagtgaggaaacttaaaatactgtactatgaaaaagagtaatagtcgacagtgaataaatgagatgggcacatcaggttacacgcctgccccggctagctaagaggtcttttgcttatgaaataaaggtagcaaaacaaaca

SEQ ID NO: 27452 - DNA, 738 bp, Oryza sativa
  unsure (1)..(738): unsure at all n locations
agtattgtttttttcatcgcaaaagcattacttacaattgacccattcataaattctcttcgtataataatacataaagacaaaaggcatatacatgtcgattctcccctttcaaaatatttcaacaataaatactgtcaaagttgattacttggttctttgatcaaagttttgatcaagcttagttagatgagtatgtttatacttccaaataagtcttacgcaagattacaaagttcgatgtctttaattaatcgtactgctaattgttccctagttacctaatttcaagcacagttaccgagtttatctcagtagttcgttggaaacaacagttgctttctaatttgatcacaggtacaaaattacctatatgaccatctaactttttacttaatacctggcccatatttttagtaccttcatgtaactatcttttgttatatatcgttggattaccagctatcaacggctataatgtctcccaagcatcttagaaagcctctcacctgtagttcaaccatcggcccatttgggtgtccaaacagaatatctaaaactcccaaagtctctcattccaattaggcgtgatcatctccccaactgaagcaaacaatttcaccttgatctcctcacccattgtcaatcctgggatgttacaacataacatatggctcgnnnnnnnnnnnnnnnnnnnnnnnnnnnnnnnnnnnnnnnnnnnnnnnnnnnnnnnnnnnn

SEQ ID NO: 27453 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnnttgtatggtgtaccccggcttttcctgggacggggattaatacactagcgttcgggaaaaggcaattttcccggtcgcgacagcgtttgggtgggttcgcgtattctgctgcgagaacttctgcttgagccttccttttcccactcttgcgatttttcttcttgcttgactcaggtgcgtccgtggctggtttcttttctcccccggtcttcggcttgtcgttcttgcgtctcaacgcatcgtcaacgtgggcacatcgctcaacaatttcgaataatctccgagtagttcttatgcgtcttgtcgccaactcctgggtagtatagtgatctcggacaccggacttgaaggcgcgaattacagaagcatcggtgatttcggggattgtatttctgcactcgttaaagcgccaaacatattccctcaaggattcacccgagttctgtgtcaacgcatgtagatcgtcttcgatcgcgtggcgcttgtaagttccttagaaattggcgacgaactgctgccacaggtttgcccacgaagaaatcgagtagggcgggagatgcatcagccatgagcgtgcagagccttttaatgcagttggcaaataatttgccaacgcgttgtcgtccgcttccgcagcgtagagtactgtggagtagacttgaaggaattcttcttggtcagtac

SEQ ID NO: 27454 - DNA, 790 bp, Oryza sativa
  unsure (1)..(790): unsure at all n locations
nnnnnnnnnnnnnnnnnnnnnnnnnnnnnnnnnnnnnnnnnnnnnnnnnnnnnnntttcgccacgggtttcggcagatttggtcgaagggcctcatgccatccgccaacaagccccttacgggtaagggtgagattggagcttcggccgagaccgtgcaaagtatgtggtatggtatgcggcgccccctttcaaccgatgctcctcccgaaacctacattattcctgcgaatgaagtttgctacttgtgcgcctattattattttgccgcgcttcgcctcctgcgattggtggttatatattttcttttcccgggccgaacggaacagtattggactttcccttcgtggggtttttactgtgccgctcggttggtgggaatttaccgtttcgcctaccattgcgacacgtggcgctttattactggtgggtaggcgaacggtcgcccgggtgagctatatattcccactgctctttccttttcaccgccacacttgccattttaccgtgtgcgctcttttcctccgtttctttcttccacagcatctctcgacccctcaagcatttcgcccattccacgcaccattcgccatggcccctcgcaagccaaaccctgcttcggcgaaagggccggatcccagccgagtcgatgatgacagcaccggctttttgggggtctctcttgtggacgacgtcgagctggcgaagcttgtcagctctgggggcgtggtcgaggggcaggctttcgccccaggggaaagccgtggtgccgaaacctatcgacaatcgga

SEQ ID NO: 27455 - DNA, 883 bp, Oryza sativa
  unsure (1)..(883): unsure at all n locations
nnnnnnnnnnnnnnnnnnnnnnnnnnnnnnnnnnnnnnnnnnnnnnnnnnnnnnnatggcgaaactcccaggcccggctgaatcggtggcaaccaattaggcgcaccttgacttgtattcccctccgggtgggccgatggggttgtgcttgaaatgcagtggggttagttgagttgctgaaggaaagcttggagttgcgcctgcagagccgaagccccttccgccactgtttgtggcgcttggccaggtggttgatggtgtacttgggcagcgactggttgagcttgcagttgcatgtgacgggccggatgcactgctgcggccgattgctgcccggtgaagtacactggcacctgtgcggcttgtggcggaatgggctgggtcgtcacttgcggatggacttgaggtgtgacataacctgccgaatactgaaggattggagccgacgtggccttggtccgccttgccgcctcgtatgcttgttgttgttcttgcatttggcgaagcatgtcttggagccatgtcatgttctgtcgcatggcttccatgtcggcttcggcttgtgtttcggggtcagggctgacttgggcctgcacaacggcgagcgcagttggggctgctgccggctgcgatggagtggcttggggcaccaccagttggcttgtcgaaaggatctccgccctaatctggagtgcccttgccgccgcagccgccttcgccacgtcggccacgttcggcccctgcaccggacctcccttcgccgccttgcccgaggagaatgcaactagggccttcgccccttccaaatccttctgtcgaaggggggatgtcacatcctgatttttgtttcaggatttataaattatttaataaattattatta

SEQ ID NO: 27456 - DNA, 599 bp, Oryza sativa
  unsure (1)..(599): unsure at all n locations
gggataactcatctttaatggttcaaaaaaaaatcccttttaagatatgactatcagggatgacccatcatcgatacaaggttatctttctcgggtcgtagttgtaatatgtcacggatgacccataacgggtcacaatcatatcccatcacggatgatatatcgaccatgatggtgtaataagatgtcccgtgcatgagtgcatatcctcaagggcatgagaagaaactttcacaatagaaattgtaaccgcatctccttaagggcaagtggctcgtgcctgagtgcatcgctagggtttcgtgacaaaaagtaccgcataagtgtttcttgccatgaacaaaaatactgcaaactgaaattttgacgaaactgagattatgaacaaaattttaaaaactaacaaagataaagacaaataagacaaacactgagaaagtacaaaatttaaaattcctaaacaatgtttgttgaaaaccaaaccaaaacgtaccaaactaaatcatgtttagtagctaatgaaactatgaaattcacannnnnnnnnnnnnnnnnnnnnnnnnnnnnnnnnnnnnnnnnnnnnnnnnnnnnnnnnnnnn

SEQ ID NO: 27457 - DNA, 638 bp, Oryza sativa
gccccacgaagtcgggaggcgacgccccatggcctatctggtgatcttgggcctgttcgcggcccgcctgccgatgtcctcagctggggggagctccaagtcgggatggggcacctcctcgaagctggcgctcgcgggataagtcgcgatattgccgaggcgaggacagtggcggcgtcggcctgtactcagctcgaaggcgtcggcctgcgcattgacgaagccctgaagcaggaatgccgtcgatcgagccgatatgctggagggcatgtgttggcttgcatatgagatcatcatccgcaattgcacctcgagtttctccatgaagggttcgctcgttctcggaggactccggcggagatagaccacctggcgaagtcgatggcgccgctggcggaaaaagttttccagtctatggactggcgttggccttcttggtagtctttgtaccctgtgatagatatcttagaaaaaatgtatatgggtttggacttgtgtaaagttggtaagaaagattttgcgaaatagaaaagaaatctatcctgatgaaatcttttactctggatataatcgggaagaatgttttctcagttcacgactttggtcagtcgttgagtcgtacacttttcctagcccca

SEQ ID NO: 27458 - DNA, 761 bp, Oryza sativa
  unsure (1)..(761): unsure at all n locations
gcnnnnnnnnnnnnnnnnnnnnnnnnnnnnnnnnnnnnnnnnnnnnnnnnnnnnnnnaacaagagctgccgatgatgcaagggttttctttagtcgactgggctttcaggtaaaacattccacggaagaggatgaaatgaggatggattccaagaaatacttcgcagagacgaacaaagatggcaaagtgattgataaaattagggttaagatgatatatcttactcccataaaagtaaacaagaccacggaagaatttagatgtcggaagacagaagctactagagaacaaaggggtaaataccacaatctcgatggtgtttggagtcgggaactcctcaccatgggctggacgccatccgatgatttcttttgccgggatcacgccttctttcaccacttccttcaaggtaatctcattgacatatgaaactaccctatgatcgaaagtgatttctctctcctttgtcaaaggtgaaatgagtgggaacttggattaggtttcttttcttgctctggatttgaggatggcggcggcggcggcggttaatatgagtacgaaaggggaaattttagaagatgaactgcgaggacgacgacggacggcgctgcgattattttaaggctatcgttaaatggctatctttgggttgaggcccattggcaattaaaacccatttttcagggggcctactacgtgcctttaggggttaagcatataagttttggactatgtgagtggatacgtgggcaataccttt

SEQ ID NO: 27459 - DNA, 951 bp, Oryza sativa
  unsure (1)..(951): unsure at all n locations
nnnnnnnnnnnnnnnnnnnnnnnnnnnnnnnnnnnnnnnnnnnnnnnnnnnnnnnttttttgaggcagggctacggtttccctgcaacgtgttgttgccggagatccttcgcctcttccaggtggaacttccgcagctgagcccgttggcgcttgtttggatcgctatcttcgactaggcgtgccggatttccaggtttcagcctaacgccgagctcttcggcgccatatttttcgccaccgtgaactcgaagacggtgcgtcccagctggaacgaagaagacagtgttcgggagcgtgaactttaacgttcgtcccgagcggtccgatctctggccggtaaacgctgccatgtcgaagtgggactgccattggatggctaggtggttctatcacaccatccccttcgaggctggcactgactcggcgaatgcccaccgttgccgacgtagggcgatcgcgcctaaccggaaacccaagatcaccgtggacggcgctatggaggcgcggttcgttctgctgcggaaggtttgctcccgccttagctgccgtgacttattggaggaattctgtatgcttcgcatctttcccctctcccagtcatggcaagtcagagttgatcaaggcgaagaggttgacggtttgccgaacctggttcttcctgaggggacgaacagtaagactgttctcgtgctatacactgttgtgctttgttatcttgccttatctgactgttaacatagctacacactttacttttgcagcgttgaccctcgaccaggctgaaaacgaggcccgcaggatgatcggcgacgtgtcggtcatcgagtatagccagttgctaacacgacaagaggctgggcgggcgaaccgggtttacaacggcgaatnnnnnnnnnnnnnnnnnnnnnnnnnnnnnnnnnnnnnnnnnnnnnnnnnnnnnnnnnnnnnn

SEQ ID NO: 27460 - DNA, 707 bp, Oryza sativa
tatagggcgaattcgagctcggtaccccagcattattcatcgccagcgtcgccgtatctttctcgactacacttcgctcttctccggcaattgcgtgctgctccggcaattctccctcttctctgttctcgtgccgcgactatctcgcaggccttctctgctagtctcctccgacattggcgtatgattcatggtggtcccctacctcgcccacgcggtattggcaacaccagcacgcgcgttcgtcccgagttgtcccggggtctggcaaaccctgtatgacgtctcgtccttcacgattcgactacatcggctcttcggcatcatctacctcaatgattgtcacgatcgtgtcaccgtcatcgtctccagcgcgtcctcacgcaccttggtccacgacgccctcccgtgcatccacgaccactctacggcgccccatgcgtgccctacggctcgactacctcgacatcatcggctcctcaattttggctacatcgaccacgtcaactttacgcacggcttcatctaccatggctccctcgcaccctttgctttggctacgtcaactactacacaaagggctatcatccgtattgagcattcttgctagtttcttctccagtccaaatgtccgcgctgctcacgtttggattgggggggatgttagaatatatggataagatcgaattgtatccagtttgttatgg

SEQ ID NO: 27461 - DNA, 1214 bp, Oryza sativa
gcagtttcacgtggggagccaccactttgatcagactcggcccgcagattcaccggtggctggtgtctaagccaattttgagcggccatgacagtgtattcctcttaactccaaatcttaggaactgtgatgtggcgtcgagcctgcccatatttctcaggaataagataattactctatccggactgataatacatgtcgttttagataagggtgagattaaactttagaatctttgattataaatcatttctaaaatatttgcctttcatatatgatggctacatgcaaagattagttttaaaaatatggtgactatatgcatagattagttttataaagtacattaataaaatcatatatttgttaacacttctgtgcatattataatacaaaataatgtctaagttatttttttcagagaccatactcttgttcaaaacaacaactattataacccggaggaccattaattctggctgctgtcgttgagctgtggcaactgctggagaaggctgcaaactcatcgtgagtaatactcgctgcttctttgattaagttgtgctgtgatgcagtgctcataatactctgtttcatgttataatatattttggaattgtccaaaggtgaactaagtttatataaaattagttttactagccgccaacccgtgcattgcacgggctattattattaatattataaatattacagttttatttgtattctaatctcttaattcacaacaaggtctcaatatagtttttttggtttttttaatttaattgagaaattatgagttattaagtatgaagagagtctcagttatatttttttccctatttgattgatatttttgtaatcggtaacaaatgaatagtgagttgtgcttggtaattggcgtggtgtctcaaattattaaaatttggttgacgataaaatttcttactgatggctttctgcacgtatttgcacgcgctattaatatattgttcatatcaatctctgtatatttttttcatcacatagaaaaatgcacagacgcacacaactctttctcacgctcgcgagccagcggtaaattccttatctcattaaaattcttttaaaaacgtaaatgcatgtacttaatcaaataaaaatagattaaaatataaccggataaaaatgggttcaaacctggttttcttgtaagttcatcttaatgcattgac

SEQ ID NO: 27462 - DNA, 1413 bp, Oryza sativa
  unsure (1)..(1413): unsure at all n locations
gtttaccctgaaaggggttaataagcctcagtcagtttacctaaaaaaattgctggataccatggatgagcctggtacaaatgatattaagaagaaattaatatgaccatgatctagagtcgagcacggcaagagtggtaacaacagcccatgattcatctgcgctatcatagttttattatcagccaatttacatcgatttgaagtcttttttataataaactacaacacttctacatggtcagattgaagtaattatcgacaagaatgagatttgctccggtctttaaaaaaaaaatacctcaaggttacggtacctcacggtaccaaattatttccgatcgattggaactaaaatacccatacccatcctggaacggagcaaatcttgacaagaatatttgaacggcatgatttgatttgatttatgttcgaggcattgcctcgatcgggagcacatacttggatgggtgacgtttctggtctttccccttgaaggactgcgtcctcatctcgctttgaagtgaagacattagccagagcagagaatggaagacaggtcaacatcactaacacctaacaaatcatgtcagttaaccttcaattgtaaacaatggctaacttgctgttagcgtcatggaacaattgatattcctgctgtctctcactccgatggacaacaataatgtcctctgcaaccgaagcaagttctcttccctgtcctcacccatttacattcaaacaggctgatttgctgtgcagctcaagttcaatttggcgtgctgacacgcgcgttacttatatacgcaatatgtacggaactcagttataaacagtaccatccacccatggagtgattctccaagggaattcatatcaagcaatgcacacatttcgggagatagctctttcatgtcagtattaagaaatcactcccataatctgtcgtgataataatgacatttttggactcccataacttcttgcaatatgttcaaagacatagtacatctcaacattttttttttttacgaaagagccaaaatctgttgaagcaacttaaaaagatgaaccctaactgcattcttacacatagacgtagactcaacaatcaatccaacaacaggaatagcacaaatcaaatataaacaaaacaataatttcactacaacgcaaagaatctattatatactaaaagtccattaagcttcctcaaaacgctctcaagccgctacgtggcgctctaataaattagagaaaattctaaaaaatatgagaaaaaagtaaaacatctatcactcgattttcactgaaatcggtgggtccaatgttataacccgttagattaagtttatctcaagaccactcctctgnnnnnnnnnnnnnnnnnnnnnnnnnnnnnnnnnnnnnnag

SEQ ID NO: 27463 - DNA, 594 bp, Oryza sativa
  unsure (1)..(594): unsure at all n locations
nnnnnnnnnnnnnnnnnnnnnnnnnnnnnnnnnnnnnnnnnnnnnnnnnnnnnnnnnnnnnnnnnnnnnggaggtggggatgtgcccgtctttctccatggcgcccgtgcacaagctcgacgcctggatgcggtgctggtagcccaccaccgggtaccccgtgaaggcctcgccgtcgttggtgagcccgtagttgaggtgctcgagcgtcgccggcatcacgcgcgacgccgcgcaccgggcggggtcgctccctgatctctactccagccactcctccgcgagcctgctggcgacgaggggtagcgtcggcgtctgccggaacgccgggtagtcgctgcggtcgtcgccgggcgtcgcgacgtcgacgcggtcgtcctcgcggtacacgggcacgcgccgtcgtggcagccacgccacgtcgccgaactcgtggaggcggccccacgcggcgaccgtgtcggcgacgtccgagtcgttgcgggtcacgaacgccaccgaccgcttgaacagcggctgcagctcgagggtgacctgggagatggcgccgaggactccgagggagaccttgggcgcgtctaggtacgggtcgcc

SEQ ID NO: 27464 - DNA, 672 bp, Oryza sativa
ttctgctcatcctttcttacacatgtcatatgacacatgaatataccctaccacaaccatacattttgtttctatattgctaacaaaacaaagtgtgtttgtggttggtgcagtatttatgggctgcatgagtagccatagcataaatagaatataacttctctcaaggaaattcatacaaacgagagagtactaacgagccatatgttatgttgtaacatcccaggattgacaatgggtgaggagatcaaggtgaaattgtttgcttcagttggggagatgatcacgcctaattggaatgagagactttgggagttttagatattctgtttggacacccaaatgggccgatggttgaactacaggtgagaggctttctaagatgcttgggagacattatagccgttgatagctggtaatccaacgatatataacaaaagatagttacatgaaggtactaaaaatatgggccaggtattaagtaaaaagttagatggtcatataggtaattttgtacctgtgatcaaattagaaagcaactgttgtttccaacgaactactgagataaactcggtaactgtgcttgaaattaggtaactagggaacaattagcagtacgattaattaaagacatcgaactttgtaatcttgcgtaagacttatttggaagta

SEQ ID NO: 27465 - DNA, 744 bp, Oryza sativa
  unsure (1)..(744): unsure at all n locations
nnnnnnnnnnnnnnnnnnnnnnnnnnnnnnnnnnnnnnnnnnaatggtcagggttaatgcaactagtacagggaagcattcactattgcacgaatgattttcctaaaaaaacaataggttggacacggattataactggtcgtgtctgtaaaaattgactcgcaccatatatgaaaatcttttatagatgtatcttaagaagctatatgtaaaaatagggcttttttccagaaaagcctcttaggcggccacagggaaatatatatttttgcaaatgggcctcttaaagttttacccaaatatctgagttaccttctcttttccgttttagcactctaattttttttcaattcatccttatctactctcttctactttctctcctactcctctctttctcatatccgtctctctctctctctcaaactgctctctcctctctctctctagcgggtacgtggcggtgggcaccctacgcatcaaaagcggtgaggggtgacggctgcaacggcagtcctccctgcttggatcccatgaatctgctagcggtggcaggaggaggagcacggcggctgcggcagcggccctccctcgcccagatccggtggtgggaggagcttggcggtggcggccggctgcagcggccgatgactggcaggtgttttgcgatttttcctcagatttttgtattcgcgtacagacgatgtaagtacccatataaaaaaatagcaatttttgtatacc

SEQ ID NO: 27466 - DNA, 693 bp, Oryza sativa
ctattgttattaccttgttcaccctagattaaacaaaacctcaactagtggacactctactcatggttccactagtatgaacttaggtagatgcttcgctggttaattaggcaacattaggtggtttttacaactttagacttgggaaattctcatatcatttggacactgtggaattgttggattatgatggaattggacatacacctctcttcctctttcaaaacccctaaaacctgttttcggtggggtttgggtgcatgccagttatgggaagtagcaccccggccactataaggactaaagctcgggcctctgttgcaaagcactaccgtacttacacatgtctaatgggtaaggcttagtttgtggctcagtctagtcataaacaaaagtacacggattggagatggatgaagtcgggcttcgatggacattctccagggcaaatgaaggctacacgagctgcggcccggtagtcgagatgtcatacggcggagggtttggtgcccaatgctaggggctcagttctacctgcctgtcccgggtattcccggccgtaggtagggattgggtcggtactcttgtctaaggctaggatggggtggaaactatgtcacgtctttcgtacgtataccgtggtggtatgtggcacgtggcaacacgtgagggagaggtgtcttgtgggtaaaa

SEQ ID NO: 27467 - DNA, 1736 bp, Oryza sativa
ttccaattttctggctatgcaataaaccgctcaggaggagccagaattcagcgatgggagtacactatttactgtggctaattacctaattccccacttgtctccatcacttgaatcatcactgatgcatgcaggactggtaattcctggtttgccggccaatcaattttgcaagactggtatcgagtcctcaccgacggcggtgattgccgatgaccacacgcctgaatcctctaggattccggcgtttaccaataaagtacttgtttatctgggccaaattaacagaagattaaaaggtgttgtggtcacggccaatgccaagcaaatcaagcaagttgaacaaactgtgaaatgtgtagtattacctgtgcggcagcagaataagaaccaaatttcctgatgcctcctattccacacatcatatgcactgctaaaataatttctttttgatgtcatatgaaaacttgaatatcgtggagtgtgtagtgctctttccgtcgtaagatgagcctgcactatttacgcaatggaaaggtaaccacaaccataatggacaatggttgtgcaccaacagcccagcaacctttctattaaatcacagtacatggtagtactatctttcagttactgcgtactctctcaattgcacattataaaacaatttttcatgtcatctctcgtcgagattcacacatgtaattcacatacatagatccatgcattaattaatctattaaaaaaccaaaatgtcttataatgtaatcatagatagtagctaaaaagtacacattacatatattcaagccaattctctcaataaaacgaccaagaattaatataattcgcagaaactcttgatggctttcttttcacattgtcgcacaatttacactattagccgttaacccttgcattacataatcaatcataaaaatgttacaaatgagattttgcaattattaaataatgaaagagatcttctatggtgcttggaaggcatgacagccattgattacatacaatctgacatataacaaaaggtacgtagagaaaggtactaaatatgtgggctaggtattaacttaatacattaagtaaaaggttatatcagtaattttggatgcataatcatctgatgccgttgtgagagccgatacagatacagatcgagagaacatacatgagcgatctgcagcttggatggctcaatgggaagataattatctgtcatggaggctgttgatcaggatgttcagtaaatttgattgaaggcaaggattgctccttgatcaactgtcgtacataatgaatggttacaacaaattgtggaaagaggacgggaaggtcactgcttcctgtgtctatggattaatcgaagataatagtatgatcttttcaataatcccactttagatgagaatcagtacaggaaagaaagatatggaacaaaatatagggacggacggaaaactcagtagagttctagaggtcacagctaataataattactatactacccatgtttacgtttttctattcctaaactaccctttaaggaatgaacggtagatagtttatacgagaggaggtacttggaatacctttcaagaaccgtgaaaggcctcataatgaaaatagtatacttgggatactgaactgaggacagtacggtatttattaatttcgatattcaggtactcatcaggtacaactcaatactactcctattaatt

SEQ ID NO: 27468 - DNA, 722 bp, Oryza sativa
  unsure (1)..(722): unsure at all n locations
nnnnnnnnnnnnnnnnnnnnnnnnnnnnnnnnnnnnnnnnnnnnnnnnnnnnnnnttcggcaaaccgtcaacctcttcgccttgatcaactctgacttgccatgactgggagaggggaaagatgcgaagcatacagaattcctccaataagtcacggcagctaaggcgggagcaaaccttccgcagcagaacgaaccgcgcctccatgaaaaaggcaagcgagtacgcgtggtcgagaaagatgcggaggcgactgctccagaatcggattcagcatatccagactctgaccttcgtgtctcacacattttcggaagttctacaacgtaatcctcaaagcgagaatacaagaaagtggaacgagaagtctgttcgacatggcagggggctgcacccaagatgaagtggtctgaacagaagatagaattttcggaagaagaccatcccatgactgccgttatcccaggacgttattcgatcgtggtcgaacccactattcggaacatcaaggtcgcgcaggttctcatcgacggtggcagctcaatcaaccttttcttcgccagcaccttggacgtgatgggaatccaacgaagcgagttgacacccaccgatcaaccctttcatggaatcactccccagtcctcgtccaaaccattgggcaaaattacgttgcatgtgattttgccccaagcaaaccaacttccgacggagccagatcacct

SEQ ID NO: 27469 - DNA, 743 bp, Oryza sativa
  unsure (1)..(743): unsure at all n locations
nnnnnnnnnnnnnnnnnnnnnnnnnnnnnnnnnnnnnnnnnnnnnnnnnnnnnnnnnnnnnnnnnnnnnntctccatgacgcaaagacaagatatccacagatccaaaagctactctacgcagtaataatgacatcaagaaagctacgccactactttcaagcccacagagtcacaattgtctcctccttccctctcggtgaagtcgtgagaaacaaagacgttgtcggccgcattgcgaaatgggtagtcgagctaagccagtttgatgtccactttgtaccacgaacagccatcaagtcccaggtactcgccgacttcgtagccgattggactatgcctaacaacaaatcagacaatcaaatcgacaacgaaacatggacaatggcgctcgatggtggactcaacagctaaggagcaggggcaagattcatcttgacatcctctccgaagatcaattcaagcacgcaatccacctcaacttcagggcgaccaataatacagccgagtacgaaggactactcgccgggataagagctgcagccacacttggggtcaaacgactgatcgtgaaaggggactccgaactagtcacgaaccaggtgcacaaagattataaatgctctaaccccgagctatccaagtacctcgcagaagtcaggaagctggagaaaagcttcgatcggatcgaggtccgacacgtctatcgtaaggacaacatcgagccagatgatctagcacgac

SEQ ID NO: 27470 - DNA, 620 bp, Oryza sativa
  unsure (1)..(620): unsure at all n locations
nnnnnnnnnnnnnnnnnnnnnnnnnnnnnnnnnnnnnnnnnnnnnnnnnnnnnnnnnnnnnntatgctccctgcaatctaaacactacagattgaaattttctgaccgttagaaatgttcaattgcacatcatgcgagcaactgatttgtttgcaatgtgcatgtgtcgccatttatgaacagactaaattctgacgcggttgttctctttgaccataaatctgttctgtgaacaagaaatatgaattggttgatgagctcattaaatctctgtagattccagctcaggatcggaggacccatcggctgtggttcagaagtgggctcgacctgctttgggatggaaagaaaataaggcggattacgggagtgtgcgacttgaattattgatttagccttgcagatagagagttggatccgctttccattggtcatctagtctaataggcaaccctcgcctcagtgaggaacttttgtccgagcattcttgttctacaattaatcggagtgaggaaacttaaaatactgtactatgaaaaagagtaatagtcgacagtgaataaatgagatgggcacatcaggttacacgcctgccccggctagctaagaggtcttttgct

SEQ ID NO: 27471 - DNA, 1935 bp, Oryza sativa
aacggcttgccaaacgctccgcctcgcccttaccgacatgggcgcgaaagtgcggggggtccctgctgaggatgcatcagccttcgacttctccgagtggacctagcaggctggcggatcggtttcggactgcgccagcatgtacggcgattgctgtgcgcgtgtatcggcggccttcaccttaggcccatttgcaacagttcggttgtgagcacgtcgccgaatccctacctatgtgaagggggactgggagattagggcgcaaaacatttcgcctgctcttcgcgcgtggcgaaaacagttctggcagaaagacggccggtccgctgccaaggtgcgccttctggagcaactagcgaaggcggaggcggcagatcggtgcgaagaagagggcgcagtgggcgaagaggttggaggcgatgcccgggatcacccagaggtgtgaggccctccgccctttctttagagttttgtagttttccaccctcttttgcgtttgcctggagaggcgaatgatgtacattcggcaggctaccaccaatccttaaaaaaggcttttttgtacatttggaatatatgacacaatcttaactactttttgatgatcaaagtctttggcatattattatttcgctcatctcacattatgccatacctcccccttcttccgcctattcttactatgtaagctgtgttttgctttttctgcactatccatcagggggttcgccgaaagtcgtgcatccggcccccttccgggagctggcgaagtcaaaacgagaaatttgtggcagtgaagggtctgccgaaggtgcgatgtccatttcggccggtttatcgcgaaatggagataaacggtcgcagctataaggttttcaagtttgccgactagctgcgggcgcaccccgagcgaaccttagaagattacgattttgttcattcaagacgtttggaggatatggctcgcttttggcgaaaccatcagaagactaaacgtcaggaaacgatctttcagcgtcgttacagtttagtctgtgtttcgccccctactcctcttaaggttgtgtatgatattagtagtgatgacgaacctagttcgcctgatcatgccttagggagggatagtgattatggggacgaagatgtaatttacttgtaaggtgaattgtatcgtgttgtgaaacttctattcttcgattattttttttgaagttaataaagacgtgttttatttccttttcgctattgtttgcatcgtcacattttgtgcttttgttaggtcagaacatgccggtccctttgcatatattagcgaaataggtgtactgacttttcagcttttcatcgttcgttttcgatctatagcgttctgtgtcgagagaaacgcttttgcttttatgctgatcggacgtaacgtcattcggctatttattttccgagacaagctgttgcggtttcaacgttcggcgagcgatgcttcggccgattcgtttagcctccctggcctttttcgctgatcaggcgtttgccttggggtttttccacaaattatcaatcacacgagaaataaaaagaaggcggaggacacagagattttatactggttcgggccttcatggtggataatagccctacatccagtttttttttctttttcctctctttcttctttttttttcttgccgaaaggctttcatagtgccgaagggcttacatagtgccgaagggcttacacgacagtatgcacatttttacaagttggcgatttgggtgccacccattctagtgggctaacgtagtgcccaagggcttacatgactgtatgtacatttttacaagttggcatttgggtgccacccattttaggcatataagcgcttgagagaagcggcgttctagaaatggtcgtgctcctcgccttagagtgttgctagg

SEQ ID NO: 27472 - DNA, 3268 bp, Oryza sativa
  unsure (1)..(3268): unsure at all n locations
nnnnnnnnnnnnnnnnnnnnnnnnnnnnnnnnnnnnnnnnnnnnnnnnnnnnnnntgattgccccaaggggttcgacttcaatccatcgagagaaatattccacagctacaattgcgaatttatacccgtttcgccccatcgggaagggcctaatgatgtccagtccccatctggcgaagggccatattggcgcaatgggctgcagatcatactggggcgcggcttggcttcggccatgacgctggcaactttcgcacttcttgatttgctcaacacagactttcaacacagtgggccaataaactccttgtctaaatactttggaggccactgttcttgcagcctggtgcgcgccacatagcccctggtgtgtctcctttgccatttcttcaccttcggaaaaagagatgcaacgaagtaagggttgaagtaccccggagcggtaaagctgacccgagaccatcttatacttcgtggctctgagttgcaaacgcttcgcttctgcttcgtctaccggaagccagccagtttgaaggtgtttcacaaatggggtttgccagtcatatgagtcttcgcccagtttctcctggtcgattaccatgacttccgagctgtccatgggcacacttggagcatgtaggacttcgaaaaagatgccaggcgaatgtgggccaccacaagcagcggatttcgccaaggcgtctgcttcctcgttctggtctctaggcaagtgttcgaccgttatgccggtgaagcatttttgcatggaccgaacaacctccagatacctcttcattccctcttcttttgcctcgaaggatttgtcaacatggcctgctaccaatttggagtcagtttgaattagcaggcgctggactccctgtgctttcgcctttcttaggcccaggagaacggcttcgtattctcctgcattgttggttgtgtcgaactgcagtcttgctgcgtaccgaatcggcacaccattcggcgaacataggactgccgcaatgcctgctcccctgtgcgaccacgagccgtcagagcacatcacccagaattgttcggtgggctcagggtcgggggcaagtaccggtgtccattcagctacgaagtcggctagcacttgagacttgatagcagagcgtgcaacaaaatgtaagtcgaacggggatagctctgtcgcccacttgctgagccggccagtgacttccttgcctcggagtatttcgctcaaggggtactgtgatgggactatgactttgtgggcctggaagtagtgcttaagcttgcgcgaagccatcactagggcgtaagcgagcttttccatttcaatgtaccttgtcttcgctccatgcagtgcttcggagacgaagtagaccggtttttgtccgaacccttttcgcctcccgccctgtttaccgcactttgctgcgggtacggtgtggcgaaggccaaaatcgcagcttgtgcgtgaggttgggccatggcattcgactgcccggctccaactggacgtacttgctgagccgccatggatgggtcaaaaattggctgcgaccacgtcgtggcagcttggattggtgcttggtttgttccgaagcttggagttcgttgccgaacggttggtgcctgagcagcattgacgaagtcaaactgcagtccttgattccatggcgaaactcccaggcccggctgaatcggtggcaaccaattaggcgcaccttgacttgtattcccctccgggtgggccgatggggttgtgcttgaaatgcagtggggttagttgagttgctgaaggaaagcttggagttgcgcctgcagagccgaagccccttccgccactgtttgtggcgcttggccaggtggttgatggtgtacttgggcagcgactggttgagcttgcagttgcatgtgacgggccggatgcactgctgcggccgattgctgcccggtgaagtacactggcacctgtgcggcttgtggcggaatgggctgggtcgtcacttgcggatggacttgaggtgtgacataacctgccgaatactgaaggattggagccgacgtggccttggtccgccttgccgcctcgtatgcttgttggtgttcttgcatttggcgaagcatgtcttggagccatgtcatgttctgtcgcatggcttccatgtcggcttcggcttgtgtttcggggtcagggctgacttgggcctgcacaacggcgagcgcagttggggctgctgccggctgcgatggagtggcttggggcaccaccagttggcttgtcgaaaggatctccgccctaatctggagtgcccttgccgccgcagccgccttcgccacgtcggccacgttcggcccctgcaccggacctcccttcgccgccttgcccgaggagaatgcaactagggccttcgccccttccaaatccttctgtcgaaggggggatgtcacatcctgatttttgtttcaggatttataaattatttaataaattattattagaatttatattaaatgttctttaattttcatgtgaagttaaatgtgggaaataaaatttcctaaatataaagcatggatggatttaatttttattaaattctccatggttaattatactctctggaatattctcggatttttcggagctcaattcctaaatgatacaaagaacagttcagtaattagttaatcaattaatgatctaattataattgttaagagcttttcttgtttaaaaatccttaaattgttgtttaaaaggaattattagaattgatcttaaaagcctaaaagagaagatctaattttaatttgctaaatctcaatataaaattgggctagacaaaattttgttaaatacttctcttgaatctttagttcctagatttttctgggatttatttgagccaagaaagtatttttaataaatggaattgcatttcatgaataatttaaattgaaaaaggtttttaaaagtctcttttggctttgggccgaaagccggcccaaaacctctctctttctctctccctccccggccgagtcggcccagtccgccgcgcccctccctcctctctctcagccgctgacaggcgggacccacctgtcggggtcgtcgtcctcctcgagccacccggccgaaccctagccaagccgcgccgccgccgctgcccttccaaattccgtcgcccctctctatttccggtcaaattgattgagggcaaatgatccttgagatctcctcttccttttctcttttggaaacat

SEQ ID NO: 27473 - DNA, 2097 bp, Oryza sativa
  unsure (1)..(2097): unsure at all n locations
nnnnnnnnnnnnnnnnnnnnnnnnnnnnnnnnnnnnnnnntctttggaaaccggaggatttgagttggattcggattcatctctctcctctaaccctagactttccttctcgccgccggtcgccgtgggcctccgtcgccgcctcctagccactataaaagcacccccgagctctcctctatccgccgccacctttgccttagcccaccgtcgcgtctagcgccgcctccgcgtagccctagccgtcgccgtcgttgccgtcggttcagccgcgccgcgccgccgttgcagccgccgtcgtcggtcgccgtcgccaccatcgggatcacgaggtcgtcgccgtccccctccaccgcttcgccgccgctgtagcacgccggagcaccgccgtcaccgtcgacccgaagaccgccgccgcttcaacctcgccgccgtcgtcatccgtcgtcgtttgtcgtcgtccaagagctcggtgagttcgccgcgtcgccctctacccgttggtgtcctctgtttgcgtcgtcgcgccgtcgttcgccggcgagcatgcgccgcccaagccgtcgccggtgatgacgtcatcgctgacgtcatcgttgccgtctgccttataccgatcgtagaccgtttagatctcggccgttctttgtggatagggtagatctcggccgcccgatccatagaccgcagccgtgcacccggtccaccgtgaacccgacccgctgacgcaataatcctccttttccttttcaaaaataattcattattgcgtcataattcaattaaaatctatataaatgctttaatccgatttaatctttgaaaattcataactaattctttgtaactcagtttaatgtggttcaagttgcaaaagttttataaaataaagatctacatattaaagttatccataaatagaattaaatttatttaattctttttaagtgggctttaattagatttaatcttgtaaaattcataataaattcatatgaagtcagaatgaggccgttcaagtctcataattcatctaaaattatgatctacatgtttgtttactttatatgtattgtttatttggtttttattatcctttttcctcgttttgcgtgttagcttgtcgttcccatcgttttgaaggttcgcgagtgcgtcagaagtgttcaagaagattaattgaagaccgaatattgcaaggcaagtcacacatatcctaaacacaatcctttgagcatgttgatcctatatttaaattctttatttatttcaactgtgcatttattttcgaatgtcactgggtggtgtgaatctattcttttgttatggcctgtttgcattgattactttattccttgataccttgtgttattataacttgactagttgagctttatatattggttcagctagatattagatatgattgcttagccatgcttagaaacattagcacattattgggataacttatgactcattattacttaatgatggtttaaagatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacaagatgttgaggctgtgtcttgtgggtacagtggtacacctctggccagagtaaaactattcgaatagccgtgcccgcggttatgggcgggttaagcaatgtttttcgtgattagtctcacacctctcacaataattatggatgttatacctagtaataatttgnnnnnnnnnnnnnnnnnnnnnnnnnnnnnnnnnnnnnnnnn

SEQ ID NO: 27474 - DNA, 3472 bp, Oryza sativa
  unsure (1)..(3472): unsure at all n locations
nnnnnnnnnnnnnnnnnnnnnnnnnnnnnnnnnnnnnntattattatgatggatttgtatattaaattgtcagtttgtgtacctcggctgattcctagacgaggattttatgcacaaattagttcggaaattattagtgaatttccgggcgtgacaggggagctgttcgactctaccccagtcttgttgtgactgggacttggggtaggagtgtagccgggggtgtcgacgcggtcttcgatcgcctcgtccgcggccttatcagccacggcctcctcctctttctcctctccttcctcctcgccgtcgcgttcttcggcgtcgtcctcgtcgttggcgtcggagtccgacgaagcaggaacccttcgcttcctaggagcaagcttcacttgtccacgcattcgctttcgcgaaggccctgcatcatcgtcagctttgtgggggtttgcccgaggaggcaattcgccgttgtaaacccggttcgcccgcccagcctcttgtcgtgttagcaactggctatactcgacgaccgacacgtcgccgatcatcctgcgggcctcgttttcagcctggtcgagggtcaacgctgcaaaagtaaagtgtgtagctatgttaacagttagacaaggcaagataacaaagcacagcagtgtatagcacgagaacagtcttactgttcatcccctcaggaagaaccaggttcggcaaaccgtcaacctcttcgccttgatcaactctgacttgccatgactgggagagcggaaagatgcgaagcatacagaattcctccaccatgtcacagcagctaaggcgggagcaaaccttgcgcagcagaacgaaccgcgcctccatagcaccgtccacggtgatcttgggttttcggttaggcgcgatcgccctacgccggcaacggagggctttcgccgagtcagtgccaaccttgaaggggatggtgtgatagaaccacctagccatccaatggcggtcccacttcgatatggcagcgttcaccggccagagatcggaccgctcgggacgaacgttaaagttcaagctcccgaacactatcttcttcgttccagccgagataatcaccgtctttgagttcacggtggcgaaaaatatggcgccgaagagctcggcgttaggctcaaacctggaagtccggcacgcccagtcgaagatagcgattcgaacaagcgccgacgggctcagctgtggaagttccacctggaagaggcgaaggatctccggcaacaacacgttgcagggaaaccgtagccctgcctcaaaaaagacggcgaataccaccgtccgattgtcgataggtttcggcaccacggctttccctggggcgaaagcctgcccctcgaccaacgccccagagctgaccagcttcgccagctcgacgtcgtccacaagagagacccccaaaaaggcggtgctgtcatcatcgactcggctgggatccggccctttcgccgaagcagggtttggcttgcgaggggccatggcgaatggtgcgtggaatgggcgaaatgcttgaggggtcgagagatgctgtggaagaaagaaacggaggaaaagagcgcacacggtaaaatggcaagtgtggcggtgaaaaggaaagagcagtgggaatatatagctcacccgggcgaccgttcgcctacccaccagtaataaagcgccacgtgtcgcaatggtaggcgaaacggtaaattcccaccaaccgagcggcacagtaaaaaccccacgaagggaaagtccaatactgttccgttcggcccgggaaaagaaaatatataaccaccaatcgcaggaggcgaagcgcggcaaaataataataggcgcacaagtagcaaacttcattcgcaggaataatgtaggtttcgggaggagcatcggttgaaagggggcgccgcataccataccacatactttgcacggtctcggccgaagctccaatctcacccttacccgtaaggggcttgttggcggatggcatgaggcccttcgaccaaatctgccgaaacccgtggcgaaagctatggagcaagaacggcgtgaggcgaagagtcgtacgagtgccttgccaggccagaggcgtctcaggcgaagggtgcaaggcgaagactatctgccgaaggaagacgacttcgccatggcaagttcgcccccgcgagggccgaagaagcctttccggcccatcaagcctaggggctatagggccggcgatcgccagacggcccatcaggggcccatgagcccttataacattatgtacccctgtaaatgtcccttttgtaagtgtaatcatgtaaattctcctgtacaacctaaaccctagtagtaagaacctgtaatggggctataaatagtcccctagggccatgtaatgggggaatccagaaaaaaaggaagaaattcaagattcaatacacttcgtttccttccaaccactgttgagtaaccacgtctttcgacgtatgcagttgtcatttcgacaacatccgtaaaaaagataaaatattaatatcaaaagtagatcaaaagtagatgaagggagtatctctctaagtgaaagttggaatgtgccacatcatgcaatgaatattggccatcggattcagaaaacgacaaactagccagagggagatggtcatacacgtcggctcagatgaatggttaaaatgaaactgaaaagatgcaactagacgagtcagggaaaaaaatcacttctctcctcgtgcactttccgccattgccgccggcgactagtcgacccctcctcctcctcctcctcctcatcgccacagacgcaacctaccatccttcctgacgccattgccgaatgctccgtggggggaggatgagactcgatgagggggctggagaggagaggcgaagacgacacaccagcagccccatccatcatcacgcctcctcagttttccccgcgcagattcagcctcccatcccccagcgacctggcaactatggtggagctcaagaacctgtaagcggtggagaatcggcgtgcgccggtgatcgattttggggaggaggaaaggacgagcaaaggcacaagaagagacagcgagatgggtctgggctaggagacgttgttgggctgttgggctgttgttgggcttgtcctacggatgtgctgttcctcttcaaaaggctcgatggattgtcgtgggatggaaggccgcattgtctgttgtaacaatatcccctcattctatgaaatttcctaattcgggcgacgggacacgtggcgcgcgcggagagagaggagagggggcggatggaggatggcacaattttcctttttttttcttttctagtttcttttccttttttttaggttctttttctgttttttcaatttttaaataaacttttatacacgtatacaaactttatnnnnnnnnnnnnnnnnnnnnnnnnnnnnnnnnnnnnnnnn

SEQ ID NO: 27475 - DNA, 10751 bp, Oryza sativa
  unsure (1)..(10751): unsure at all n locations
nnnnnnnnnnnnnnnnnnnnnnnnnnnnnnnnnnnnnnnnnnnnnnnnnnnnnnntttttttttcttttctagtttcttttccttttttttaggttctttttctgttttttcaatttttaaataaacttttatacacgtatacaaactttatatacgtctagacatgtatatgtatgtcagggttacgggttaggtagaccctttaccgttcgatatacgttacatatcgatatggcatgcccgcgcatatatggacattctctacatacactaaggaaatccttgacggagtttgcagaaaataagagtcctactcggacaagactgggtcgtcaatgtatcgtgtagggtttgatgtctccgagttctatttggaaaccgcttgacctgcgatataaaagggaccccctgagaggacttaaggcatcgaatgtcatagccaacacaacgaccacagcctacgaagtcggagcctgcaggagccaaatcgccgggagatctagtcgaactaactcgattacaatctcgccggtgtcatcgagttccatcgttccctttaatctgtgattttccatcttataatcccatatcaactggattagggctattacctatcaaggggcctgaaccagtataatcctcgtctttttgtttgcttgatgtcgtattacgtagatccttgtaccaacgtaccccaataccctctatatccagtctacgggtatcacccgtcgacagtggcgcgccaggtaggagaacttggtgctcaaggttctactactatgtcatccagcttcgtcgacaacagcgtcagcaccaacctcaagtcggtgaaatcttattcccggtttacgccacgatgccgatctcagctggtccatcaatgaccggaaacgagaacacagtagctacaacccaggacgactccgtgtcgaaagatcctcccgccgaagcggagaacggaacgttgacaacatccgagctcgagaaggattctaatgcggccgaaccttgtctttccgacaagaaccacgagccgacgagaataacttccgacgcgacaaggtcctagtgccctatccacaaaaccaggaaacacactttgcaagcatgctgggtttttctcaacgtccgcgccgaaattcgtgcctgcaaagagcgtggaattcagcgtatttctccaactcgtcatgtctattgtcttattcacaagacaaagaatcacaacctctcaagctgcaaggtctttctcagcaccacaaagacgtcatctcctaaggtccagcagtcaggcatatcccttagagatgaagacaaggaacaaggaacgctggtctcagatcggttcgttggcgttatcgacatcgattcccacgtaccatcagttctacatctactcgaggactacggctcatcaccaatgagtacgtcaagcgagctattagctatcaacgggaccagcaagtcagcacacgctaatgcggaagcggaaaatcaagtgactacaccggcccaacacatcaggacccttaacacaatactgagggagactccttacgatcccgttctgaacgatgatctcgcgcggtggcaggaacggctacgggaatcagtaaccaacctcagccacgcgtttgaagaggccgctgctgctacgcaccaggaacagccaccaactggcggcgtcaatggcaaaaatcccgaacagcgggagtcaccccctcgagctacccctccacctcgcggcaccggcgatctctgtgaccacctcaatggtcgccgagaggcacgacgcacacgagacgatgggaatcgctcccgacatcgcgtctcttcacgacatcgcgataatgaagaccgagaccgtactaatcgccacaatcgccacgatcatgatgattgcgagaggcggacgcaaggcgatactggtcgaggatgccgctataacgacgaggacgacagagatcggcgccgggacaacaacggagggcgacgacaggattctcgagaacccagccgacgacctcgtaatcccacaccggaaccaagcgatccatcgtcatcgtcatcttcttcttcatcctcatcgtcagacagacatccacgaaggacacatgatcgctgacaacccactgcccccagcactgggtgtagagctttcggtcgttccctgcgtgatgtccgatggcctgagagattccgacccagagcaatagagaagtacgatgggagtactgacccagaagaattccttcaagtctactccacagtactctacgctgccggagcggacgacaacgcgttggcaaattatttgccaactgcattaaaaggctctgcacgctcatggctgatgcatctcccgccctactcgatttcttcgtgggcaaacctgtggcagcagttcgtcgccaatttctaaggaacttacaagcgccacgcgatcgaagacgatctacatgcgttgacacagaactcgggtgaatccttgagggaatatgtttggcgctttaacgagtgcagaaatacaatccccgaaatcaccgatgcttctgtaattcgcgccttcaagtccggtgtccgagatcactatactacccaggagttggcgacaagacgcataagaactactcggagattattcgaaattgttgagcgatgtgcccacgttgacgatgcgttgagacgcaagaacgacaagccgaagaccgggggagaaaagaaaccagccacggacgcacctgagtcaagcaagaagaaaaatcgcaagagtgggaaaaggaaggctcaagcagaagttctcgcagcagaatacgcgaacccacccaaacgctgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacctctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagtttccaacccatcctagccttagacaagagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgaagcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccatcataatccaacaattccacagtgtccaaatgatatgagaatttcccaagtctaaagttgtaaaaaccacctaatgttgcctaattaaccagcgaagcatctacctaagttcatactagtggaaccatgagtagagtgtccactagttgaggttttgtttaatctagggtgaacaaggtaataacaataacaataacaataataatatggtcgtaacaaagataaataggcatggctaaataaaacagtgacaacgcgggaatttaaataaagcgataatgcaataatttaaatcaacataattttataaaatgggattcaatatgatcaagatgatgtgtcttgccttgctcgctttcccaaacgacggcttcaacttccacgaagagcggatcttccgaagctgcggcgtctacacgaccaacggaaaaagaaaaagacttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaaaaacggattattgcgtcagccgagggaggggacgcgcggaccgggtccacggggagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggagcggagcggcggcggcggctaaccgaagcacggcggcgacggcggagagaaggtgctacggcgcgagcacgattccgacggcgagagtgagcggcgagcggcggaaacgaaagagcggagctcggggagggtttaaatagcgccgggggaaggaaagagcggccggagagggaggaatcgcgcgcggaagattcggctccattgattgcgccggcgacgattacgggcttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcagcggcgcgcgcgcgcgcggggagccgatgggccgcggaggagaggagagagagggagggagagttgggccgagccggcccaagagaggaaggggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagtccagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccggtgctaggtacttctgctatgcgatgcgagggtcaaccactctaactataagttatgcttcccaagagaaccaatttatcccacttgacatactttgacgtctccccaaatagtcttactgctggacttcttattgtctgatcgtgatcctgccagatctgaagcttcgttgttagaggtgatcttaatctgacctctgtagactatcttcgaacatatcacttggttcataactgggaatagctcccacaaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttacttaatgacaaggtgactgttgcggggcaattacaatcaggggtcttccgtgagcgatgcagagcatgcttctgtttatcaatcacctttcggcctacttctttcatgctagagagcatctttgccaatcccttttatcaatcttctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcctgctatctgtatctataccactagggtttaattgccgatggtcatctttagtgcttcctcgagatggggagcatccaaattgttcttctgccacatcacctttgaccttgttctgataccaggtaaactaattaccaaccatcgactattatgttctcaaatattgatgtctcctggatctccttatctgttggcaggtatatccgatcttatcaacgtagaggcatgacgagtacccttcggggtttcctccaacaatccttatcttgatctgtaaaaggcgtatccgaactcctatcctcaactactgtctcgttggctttttaacccaacacagtttaattggttttcttttccatcaacaggttggttattaactcgaggttggaacacagttcctctgaaatgagaccctaggtctcctatgtcagtaaacaattatacacatgatcacatatccgcatctttcaaacgaatcctcatggaacttgtctgtattacacatttctccctcattacatgaatacgaggcactgccttaaacgaaaagggacggtgcttaacatcggtacattgtatcctcaacatgaatcatctctaaacatagcaagctccctgtttacagacatgattatatttatgaatttcatgattgctgcaaactttcgattacaccatgataagtagcggactgaaaaccacaaacatggctgctcattttgattctggagagatatagctggcattgttctagtgactgcatccttgattggttctgtgatgatgtgataggactgcataatgctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagtttttggagtaatgcccttctccactgcagttgtgacaaacaataactttcttacactcgggttcttcatcttgtacttgatttctcagctgctgtattggagcttctaaaggtacaacgcagatactggcatctgtcttgtcagctggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttgaaaccggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctggtggaggccattctgtgctggtaatgatcatcttacgaacttcaccttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacctgaggttgcatctgactcgggttcaaaattggcatccgcccctgctgtagtatctctataagcaatttgttctggttaatcaggtgttggaccactgccgcacaactggtgtcttgtgcttcattcactcgggagcttgaggtaccaatgtcctgactcctgaccttattgcctttctcattgtcagccatctgttgcaaaggtttggagagggagagagggaaaacgaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagccggcttcactgcttcctccacttcactcgcagatcctgcagtcttctggaacttcggcaaacaactgacgatgtcctcttcttcactgacctgaccatctagtactagttgaaaatccgaagaaggaagaacggagtaaaccttttgcaaaaagcattgggggaaggagaaaagaggaactttcgcaaataatttttatttataaaatatgtccttaggttttatccacttggcttttcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacctctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctaaagctacacagtgttattaaacaaggccgggaacccttaa

SEQ ID NO: 27476 - DNA, 19779 bp, Oryza sativa
  unsure (1)..(19779): unsure at all n locations
acaggtgggtcccacctgtcagcgagagtggcgggcgggcccgcctgtcatcggcgcgcgcgcgcgcgggaaaccgatgggccgcggaggagagaagaaagagggagggagagttgggccgagccggcccaagagaggaaggggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaacgcccagacccacaaggtacgacgcaaagaaagcatggtgccccatacacaagacggacagacattctttggaagattgccttgtttttaaaaagtcgttcgagaagcacatggcattggaaaaaggcaagcgagtacgcgtggtcgagaaagatgcggaggcgactgctccagaatcggattcagcatatccagactctgaccttcgtgtctcacacattttcggaagttctacaacgtaatcctcaaagcgagaatacaagaaagtggaacgagaagtctgttcgacatggcagggggctgcacccaagatgaagtggtctgaacagaagatagaattttcggaagaagaccatcccatgactgccgttatcccaggacgttatccgatcgtggtcgaacccactattcggaacatcaaggtcgcgcaggttctcatcgacggtggcagctcaatcaaccttctcttcgccagcaccttggacgtgatgggaatcccacgaagcgagttgacacccaccgatcaacccttccatggaatcactccccagtcctcgtccaaaccattgggcaaaattacgttgcatgtgactttcggccaagcaaacaacttccgaacggagcagatcacctttgatgtcgctgaattcgatacagcgtataacgccatcatcggttgaactgcacttgcgaagttcatggccgcatctcactatgcgtatcaagtgctcaagataccgggaccgaaaggaacaatcactattcaaaggaacgccaagctagcggtacaatgcgacaagcggagcctcgacatggtcgaacaaacgcccagcccaccagccacaactgagcctcccaagaaagtgagcaagacaaataagacgccgaaaccagacagcgcgatcatgatcgtttcgctctctagtgccaaccccaacaagaccgtcaagatcggggcatcactaagcgagaaataggaactcgcgctcatcatcttcctccgcgacgtgttcgcttggttgccgtccgacatgccgggggtccctagggagttgattgagcacaaactcatggtgcgacccgatgccaagccagtaaagtaaaaactgcggagatttgcaccagaccgaaaacaagccatatgagaagagctcgacaaacttctcaaagttggctttatcagagaagtatttcatccagagtggctagccaatccagtcatggtgcggaaggccaacgggaaatggaggatgtgcgtcgatttcaccgacctcaacaaggcgtgtcccaaggatcacttcctcttcctcgaatagaccaactggtggactcgacagccggctgtgagctgttgagtttcctcgacgcttactctggctgtcaccaaatcagcatggcgaaagaggacgaagagaagacagcattcatcatgccgttcgaggtattttgctatgttaagatgccattcggactgataaccgcaaggaatactttccagcgcacggtccagggcgcacttagtgaccagctcggcaacaatgtcgaggcatacgtcgacgacattgctgtcaaaaccaagacaagcaactcattgattgacgatctgcgggaaacatccgacaacctccgacgatatcgcctcattcttaatccagagaagtacacgttcggagtaccgtcgggcaagctgctcggtttcctcatctctggcagaggaatagaagcaaatcccgagaagatcaaggcaatcgagaatatgaagtcgcccacaagactcaaggaagtacaaaagctaaccagatgcatggcagcactaagcaggttcgtcgctaggatgggagaacgaggacaacccttcttcgctctgctgaagaagcaagacaaaattgtatggacacaggaagccgaagaggcattcgttgcactcaagcgctacctaacaaacccccctgtacttgttgctccccaacctaatgaagaattattcctctatattgccgccacgccatattccattagcaccgtcattgttgttgagagagagaaagtacaacgaccagtctactacgtcagcgaagctctccatgacgcaaagacaagatatccacagatccaaaagctactctacgcagtaataatgacatcaagaaagctacgccactactttcaagcccacagagtcacaattgtctcctccttccctctcggtgaagtcgtgagaaacaaagacgttgtcggccgcattgcgaaatgggtagtcgagctaagccagtttgatgtccactttgtaccacgaacagccatcaagtcccaggtactcgccgacttcgtagccgattggactatgcctaacaacaaatcagacaatcaaatcgacaacgaaacatggacaatggcgctcgatggtggactcaacagctaaggagcaggggcaagattcatcttgacatcctctccgaagatcaattcaagcacgcaatccacctcaacttcagggcgaccaataatacagccgagtacgaaggactactcgccgggataagagctgcagccacacttggggtcaaacgactgatcgtgaaaggggactccgaactagtcacgaaccaggtgcacaaagattataaatgctctaaccccgagctatccaagtacctcgcagaagtcaggaagctggagaaaaggttcgatcggatcgaggtccgacacgtctatcgcaaggacaacatcgagccagatgatctagcacgacgcgcgtctagacgagaaccacttgagcccggcacttttctagacgtcctgacaaagccatcagtaaaagaggtcagcggcgaagttaacccagacgcccccggcatcagctcggaggccacagaggcagaacgcgtcattgccgaaatcgaaaccacagacgactagcgcaccccactgatcaaattgatcaacagcgaagagttgcccgaggacgacacagaggccgagaaaataactcgtaaagcaaaaatctattgcatgatcagcaacgatctatacaagaaagcgccaaacggggtacttctcaaatgcgtctcgtccgacgaccgcagacacctcctccttgatatacatgaaggcatctgtgggtcacatgccgccagtcgcacattggtcgggaaagcttttcgacaagggtttttctggccaaccgccctcaaagatgcatgcgacatggtccagtggtgtgaagcctgtcaattccacagcaagcacacaaggctacctgcacaagcgctccagactatccctcttacttggccgttctcgtgctgggggctagatatactcgggccattcccacgaagacagggcggctaaaggttcctattcgtggcgattgacaaattcaccaaatggatcgaagtggtacccatgggggaaatcaaggccgacaacgccattaaattcatcagagggatattttgcagatacggattaccgcaccgcatcataaccgacaacggctcccaattcatcaacgccaatttccaggattactgtatcgggctgggagtcaagatatgcttcgcctcagtttctcatcctcaaagcaacggacaagtcgagagggcaaacggcatagtactacaagggatcaagacccgagtctacgacaggctcatgtcacatgacaagaaatgggtcgaagaactcccatcagtactatggaccgtacgcaccacaccgacgacgtctaacaaggagacacccttcttcctcgtgtacggctccgaggccatgctccccagcgagctacgacatcagagtacacgagcacaaaactattccgacgagtatcaggaggagcagtgaaacgacgatgtgaatctactcgaggaacatcgcgaatgagttgctgtccgagcagagggctaccaacaggccctctgccgttaccacgagaagcgcatccgagcatgcatactttcgatcggcgattacgtcctccaacgggttcaaagccaagcagggcgaaacaagctctcacccaaatcggaaggaccatacacgatcacacaagtcttgcggccaggcgcattcaaaattgcagacggtgacggtcgcgagttagcaaactcttggaacattgaccaactacgtaaattctatgtatgagtcaatagtatccatgcctgtaagacaccttacagcatcaataaagcctattttcaggcgcagattacaatcaaagtgttcctgcccgatgaccccttacccagatgacacctagcgttgaaacctatccttatgtccctttacgccgtcttgacaaggcctccgaagaacctaagagaacttcggctggggacgcccagagccgataaggccttgtcggatcctgtagagacgaaagaccatgtaagacctggtcgtgtaagagttctcgccgtgcgtattaaccaagccgcgtaatcggaaattaactttccaacttcacggctgggggctaggatcagtgcttgttcaaccgaggcaggtcataggtccaagagccttgtcccccgagaagaattcttcgacgaaaaggctggggctagggagagtgtacgactcaaacgactgaccaaagtcgtgaactgagaaaacactcttacacactatatccagagtaagaagaattcatcaggatagatttcttttctatttcgcaaaatacttcttacaactttacacaagtccaaaaccatattacattttttctaagatatctatcacagggtacaaagactaccaagaaggccaacgccagtccatagactggaaaaccttttccgccagcggcgccatcgacttcgccaggtggtctatctccgccggagtcctccgagaacgagcgaacccttcatggagaaactcgaggtgcaattgcggatgatgatctcatatgcaagccaacacatgccctccagcatatcggctcgatcgacggcattcctgcttcagggcttcgtcaatgcgcaggccgacgccttcgagctgagtacaggccgacgccgccactgtcctcgcctcggcaatatcgcgacttatcccgcgagcgccagcttcgaggaggtgccccatcccgacttggagctccccccagctgaggacatcggcaggcgggccgcgaacaggcccaagatcaccagataggccatggggcgtcgcctcccgacttcgtggggcaaccacgacgtcagtggaggcagctgtaggagacgcactggaggtctcaccagacccatcctgcgccgccttcgcccgcgcccacctacaaaagatcatcacatgcgattatcaagactagtcgccagatctccaaccaaaggaatgaactcaatcttcatctacttacttctcgcctagcgtaaccaacttctgtcgtcgtggaggtggcggagacacgtccgaggcctaagtaaaccaaggatgatttgaggaacgacttttctgattacaaggtcaatggctcaagaaacttaccgtgggggaggacgccttccagcgactgccgagtacggaggtgaacttccttcccctcctcggggggcggctcccgctagtcgcggcagcagcagcagcggccgcgttggatgcctcctgtgcgacaccctctttcagcgatgccaccgcctggtggtccacgagcggtccgatgacatcggtcagagggagaacctgcaccgcatgaagtcgttatctgatccaggagcaagaatagaggggtcgccgaatacactcacgttgattgcggcttcacgatcggccacctccttctcacaaagggggatggggatgtcacttgccgttgtggggccactgatcatcagttggccgacgcggcgctccaccgtttcgctgttcaagcctgcaagtcaaggaccggaattcggtaagccaggaggagcacacatataaggaggtcaaatcaaatgcaagaaaaataccccgaggagaaacccgggtcgtgtcctccggcccagaatagtcaaaggctggatgggctcgagcctggagcggctggattcgcctaccaacgaagtcggcagcgatttcatacccgacaaacttcgtgctcggaggtcgtcgatggcctcgacgaaggaccgaagggcaggggtcaaggtaggctttgtggtccaagatgaaatcttgtctggttgttcctcgggaacaacaaagacaggatccgaattctctatctaaagatagaaccacctcgcccgccatttgctacgagaagaagggcactggaagtggatatagcgcgacttcaggccatcccgaagtcagaatccgatgcatccagacacccggttggattccgtccaacgcaactcatagtaaaagcggaagagatcaagaaagggctctaccccaatgtaggcctcacaaagatgtgcaaaaatactgaggaaggcaatggaattagggttcaaatggagcaaagaaaggccatagaagttcaaaaccaagagaagaaattcagaaggcggagggagaaaactacaaagaatatagtcctcgatcgcaaccatgcgacccaggacaggctggggttcagtacctccaacttctctctccatgcctccacgaccgggaagggcgccatcttcctggagcttcttcagcgacgcgttggtggaggtggacttgccgagatccattgtcgactggagatcgccggagaaaggacggagagtaacgagctagggttttttgcgggagcggagaagacgagaggcatttggaggctggaaagtttctccacaataggcggacttcaaaatgaatccccaaaactcccttaaatagacgcacttccgatggtgcgaattccaaggaaatgagagagatggccgccggaaatttctgggtccgttacgcgcggcagtttttcagacttcagtttaaactcactcatgaccattgggcttcacacgatgttctcgactatgtcctgtctctacggttcccacaccaagaacggcatcagcctcgacatcagaagtcgcgattggttacacgagctcatttaagcagaagtcgggggctactgtcagggttacgggttaggtataccctttacccttcgatatacgttacatatcgatatggcatgcccgcgcatatatggacattctctgcatatactaaggaaatccttcacggagtttgcagaaaataagagtcctactcggacaagactgggtcgtcaatgtatcgtatagggtctgatgtctccgagttctacttggaaaccgcttgacctgcgatataaaagggaccccctgggaggacttaaggcatcgaatctcatagccaacacaacgaccacagcctacgaagtcgaagcctgcaggagccaaatcgccgggagatctagtcgaaccaactcgattacaatctcgccggtgtcatcgagttccatcgttccctttgtaacctatgattttccatcatataatcccatatcaactggattagggctattacctatcaaggggcctgaaccagtataatgctcgtctttttgtttgcttgatgtcgtattacgtagatccttgtaccaacgtaccccaatattctctatatccagtctacgggtatcacccgtcgataatgtacatatacaaagtttgtatatctttttatacgtgtatatatgttttatacagcaaaagtgtatgcgcatacatgtaaaaaattgatttacgtatatatacaaagtttacacacatattatattatatatatatatatatatacacacacaggtacaatgggcatcaaaataaccaggatattgttgtgaatttggctctggtcgcacgccccgtgtgggcaggcacggatcaatcaccctctactagggtatatggatgagatagtattgtatccggtttgttatggtagaataggattagtttccaaatctacctaacggcttgtttagtaactcgagggaaggggattgggagtttacacaagggaattgctgatgagattaagatgagaatttgatttttaatcccaatatcttgtttggtagatgtgatggaaattgatagagagtttagttggagattaggtcattaataaaaacagatggctgagatttgcttagacaaagtaaagaaggaattccctcccaattacctgcctctacccaggtattaaaaaggagagagttcctccctcaattccccattcctatcgcaccaaaattgtcatgtctcccaaccaaacaaaacacttaatagcctcatctctttaaactcccaatccctcctaaaaactccctccaaccaaacgggccgtaagatccaatccatgtattacaatatataccggtccctgatgcttaatacaatgtatcaatatttacagtatttctctctccctatactattcaacatagtatcagagcaggcgacctagagccgccgctgccccgggagagttccgatctcccgtgggtggacacctgttttttttcctatcttagtcgtcgtcttcgtgttctacttcttcatcgcgtggtggtcttcgcgtcgtcgcaaaaacagcaacagcaccagctacctccacgagtccacctcggtcaccgggggtcatctccttgctggctccatctcccacggtcgtcgtcgatctgatctgctcctccccgccggccgctaacttggtgttctgccgtcggcgcccacactggagctccttcccgccggcactgcagggcagccaccgccacgccgggtttccgcgaccgccactccaggggacccgttgatccacccaccaccgccgggagagcccctccacatccggtgcgccgctccggctgtcctcgccagtcgtcacggatctggcgcccaccaggctcgccactgcggccgctgcctctcggggtgttcgtcgtcatcccaggccgccggctggactcctactccctctgttttccacacgattggaaccgcctccgcaagcccgccgtacgcaccgaggtcgtcatcgaagcacgctccggttccagcacgccagggcacgcccggagcgaaagccgaggtcgtcgaccactgctccgctagccttgccatcgatctcctgctgcccatctctctctctctcttatctgtctacacgtgcgtggatggataggattttgagaacaggcaaaactggtatcttcccgattttgctgcttaccaaaattatgatctgttagcagtttcacatgtcctaaaacgcgatgtatctgttttccaattgttgtacgactaaaagctctttcaaaattcgcaaaatctaattagctaattagcttgtactagttgtgaagtcatgtaagggtggtttgtacgttggctgtgtttttgattctgcaacctagaccagaagctgcggctcggtacgtgactgtttcaacgagctgaggcctaagtcctgcaaagaggggagagcgggagattggacatcggctcggctctaatcatgagcttgattgcagtaggggattggacacgcgtcattagttcacgtggtgtcgcacgggcgggggtcgtgcggcactgccacagataattttttttccatgaaacagaggattggagttgacctatttgctggactgctactggtgttgctgctgctgttgtaccttttcttttttctcctgatcagagatcgggtttgcgttgctcatcacctcatcgacatttgcgcgtctctgacattagcatcgactctgcttcaattttatcatttcgcctcgcgcatctttggcttgatcacccgttcaagcacttggctacagttacttttgcaaccgatcatcatcgagcacgtgtctacgccatcaagctcgcgtcgtcccctcggaccggagtgcttctatccatggtccacctccactagttgttgcagtgctgagaggcgcccccctcaacatagcttcatcacaggtggactcttcgccactgcatcgacatggagctgcaactgtgttgttctctcggaccgcagctttgccactttcgtcgtctctatcgccacctacgcatcgacacccacgtcatccgcactgatcatcgtcagccacgcgggtcttcttcatctacttcgagcatcgccgccgcgtctccaagcctgtcactgttgccgctctaggtcgatggtccagctacctctacatagctaccaatgtcgccgtctaggccattggtcccgctacattgccttctacttcgtccagcattattcatcgccagcgtcgccgtatctttctcgactacacttcgctcttctccggcaattgcgtgctgctccggcaattctccctcttctctgttctcgtgccgcgactatctcgcaggccttctctgctagtctcctccgacattggcgtatgattcatggtggtcccctacctcgcccacgcggtattggcaacaccagcacgcgcgttcgtcccgagttgtcccggggtctggcaaaccctgtatgacgtctcgtccttcacgattcgactacatcggctcttcggcatcatctacctcaatgattgtcacgatcgtgtcaccgtcatcgtctccagcgcgtcctcacgcaccttggtccacgacgccctcccgtgcatccacgaccactctacggcgccccatgcgtgccctacggctcgactacctcgacatcatcggctcctcaattttggctacatcgaccacgtcaactttacgcacggcttcatctaccatggctccctcgcaccctttgctttggctacgtcaactactacacaaagggctatcatccgtattgagcattcttgctagtttcttctccagtccaagtgtccgcgctgctcacgtttggattgtgggggatgttagagtatatggataagatcgtattgtatccagtttgttatggtaggataggattagtttcgatctctatctatctgagtttacttaagatccaatccatgtattcctatatataccggccccaagactcaatacaatgtgtcaatatttacagcattcctctctccctatactacccaacaccctcattctatacatacatctttggtttctatagtaccctcaactagtctttgcaattagatccaacggctttaattcacatgcaaacattctcctacatatataaaagtgcacaatccgtgtgctctcctttgattggttgagattaaaaacataacaacagtaatatactatcaatgaattactcatgtaacggcgaaaaatacgagtgagccaaattcacaacaatatccaagttattttgaagcccatttctctatctctactattataaaaattgaagatgtttttgccggtatttggtatgccatccgtacatgagtcgatttttaagttcgttcgcatttgaaaatacatatctgtatttaagtaggtttttaagtttactcgcttttaaaaatacagaaggagtcgtataagaaatttctttaaaaaaaactcggatgctaacttgagacttctaaccgcagctcatgattttcttaaaaaaaatttatccaagcgaattcctacaataaatttcaccttaactaaactatataacaataataaaaattaaaatagcctttaagacgttgtgaattgctatgtagcagcctgctgaattttatggttgtgtcatccgaatttgaggtcgtcggatatcatcaagatcgagagcagtctcgtcggcgtcgacgtggccatgatgtggtcgacggcagcgaacggagactcgcaccgcacaaaaaaactacggcagcagctgacgagggtgcaatgtcttctggcgtgattgacgtggtacagtagaggcaaggcatggaggggtctccttggccgttgctttttatgtgactatggcacctatgttagtagatctggtgttgttttctattgcattcggctagatcaaagtttattttttctaatttgtcctatttgctgcgtggaatggagatgcaatctatcaagctatatacattcttgaggaatgtatgtgatctaaatctgtatgtaaatgaattcatcaaggattgtttttatcttttccacatgctaatttcttgacttaggctcagttagatctacatggtcatgcgatttcctatgctttgttagaaactaatagtatttaagcatatactttttttctccaaattcagtagatcttagttttgtttacactgaagttgactacttgtttttcattctatctgctatgtgaagaatactatattttctgagaaaagttttgggtataagtccttacattttcaattaattatatctatgttttatttagaatacaagagctataatttgtggcaagggctaagactcagtagaagatggagaagctaaatttcacatcacaatacatcaataaccggcagtcgattggcaatgtgagtataactattttgcaacctttttttgttagataaaaattagttttgtagattttcttagttttgtacgttttggttttgtaaattttgtagtttagttatctactaaacatgttttattagttttgttgttaatttcatagtttcattagctactaaacatgatttagtttggtacgttttggtttggttttcaacaaacattgtttaggaattttaaattttgtactttctcagtgtttgtcttatttgtctttatctttgttagtttttaaaattttgttcataatctcagtttcgtcaaaatttcagtttgcagtatttttgttcatggcaagaaacacttatgcggtactttttgtcacgaaaccctagcgatgcactcaggcacgagccacttgcccttaaggagatgcggttacaatttctattgtgaaagtttcttctcatgcccttgaggatatgcactcatgcacgggacatcttattacaccatcatggtcgatatatcatccgtgatgggatatgattgtgacccgttatgggtcatccgtgacatattacaactacgacccgagaaagataaccttgtatcgatgatgggtcatccctgatagtcatatcttaaaagggatttttttttgaaccattaaagatgagttatcccatacgagtcgcattagcccgacacggttggctcgtcaaggatgcccaatctgtactagtgacagatttcagatctggccttttttcacgttgctatgttgttgcctatgtttattgtcgttatggaggtataagagaacaagagagttagcatcatgagtgaaatgactaaaaaaaaccttttctgttgttaatgtgctctgatcggtgttttcgtcgcttgtgtgagtgaattatagttgtctctacgtgacataaaatgtttattatttgttacaagatttcttacttttaccaagggggtttaaactgtcggccacctgtaaaaactgtcggccatatacattcctgagtgtatacggtttgtcacctcccctcagccatatgtggtcggtaattgatcagattgccgacagtaccctcagcaacaatgtagccgtgggtttatgtacggcttttttttatcagagaccacgtatagttctttctcgccgacaacatttcccgagcatataccgtcggttattcattgagtgacagtataatataccatcggtcttattctcaccgagaggtttgttttctcgtcaaattgtgagaaccctcggctatttagtgaccgatggtctgcaagccttcggcaatggtatttgccataggtttttatagaccaccatccattcgtcaccctcacaaatagtattgtggagaggttatttaggttacttggaaaagtaatccaaccctcagtaattggagttttttcaaaaaaaaaataacatgcaaatttaaattttacccattttgaactaatcttgtaaatgtaacatactccatagtcacatcaacacaaaatccataaacagatccacaggaagttcaaccacagatatataatcaaattgttcaaaaatatttatcatccatcaccatagcaaaactacgtaattcatgacatgtcttgcatgaaagactttatttgaaagtttgaaacaagtctgtaacatttaaaataagatagattgagattaattctctaaactgcaagggtagtccatcttttacataagaaaaagtaagcttcatgaagttcatggtctccatgttcgcttttagataagccataaatcaatatcttcatagtcgctttcagacattccatactccccatcagcgtcatcactattgccctcttctttaggaatctcatttcctccctcttgataaaaatcattgccctcatctttaccaatctcatttcctccctcttgatcaaaagcactctgtggacaaggattgtatcttaaacattaggtactgcactttatgtagataatgttatgtactgcactagggctgagttctttcccccactttcccaactcacatatctctttttccacgcgtacgtttttcaaactgataaacggtgctttaaaaaaaattctatacgaaagttgctttaaaaaatcaaattaatccatttttgaaaaaaatactaatacttaattaatcacgcgctaatggaccgctccgttttccgtgtggaggagttgggttcccaacccaaaggagcgaacacagcctaaagcaaagttcgctatcacaaggatattttgaaataaacttatttccaacctggtcatgttgatattcagcctcttgatgatctggagcagacccaacatttgaagttgagggaccctacaattttgaagcaacatctatatattatgctacaagtatttagaaacacaagacaatgacatcataaaaatgaaacagaagccaagatgaacaaacctcttttagttgctctcatgtatactatcgatatcttgtcattattcaaatatagttagttactaaaacaggaacggaagactattacatattatggagagagtgaactaaccaactcaagagcatattgtttcataagggtattgtcacatcctgatttttgtttcaggatttataaattatttaataaattattattagaatttatattaaatgttctttaattttcaagtgaagttaaatgtgggaaataaaatttcctaaatataaagcatggatggatttaatttttattaaattctccatggttaattatactctctggaatattctcggatttttcggagctcaattcctaaatgatacaaaaaacagttcagtaattagttaatcaattaatgatctaattataattgttaaaagcttttcttgtttaaaaatccttaaattgttgtttaaaaggaattattagaaatgatcttaaaagcctaaaagagaagatctaattttaatttgctaaatctcaatataaaattggggtagataaaattttgttaaatacttctcttgaatctttagttcctagatttttctgggatttatttgagccaagaaagtatttttaataaatggaattgcatttcttgaataatttaaattgaaaaaggtttttaaaagtctcttttggctttgggccgaaagccggcccaaaacctctctatttctctctccctccccggcccagtcggcccagtccgccgcgtccctccctcctctctctcagccgctgacaggcgggacccacctgtcggggtcgtcgtcctcctcgagccacccggccgaaccctagccaagccgcgccgccgccgctgcccttccaaattccgtcgcccctctctatttccggtcaaattgattgagggcaaatgatccttgagatctcctcttccttttctcttttggaaacatcggctaattttctttggaaaccggtggatttgagttggattcggattcatctctctcctctaaccctagactttccttctcgccgccggtcgccgtgggcctccgtcgccgcctcctagccactataaaagcacccccgagctctcctctatccgccgccacatttgccttagcccgccgtcgcgtctagcgccgcctccacgtagccctagccgtcgccgtcgttgccgtcggttcagccgcgccgcgccgccgttgcagccgccgtcgtcggtcaccgtcgccaccatcgggatcacgaggtcgtcgccgtccccgtccaccgctttgccgccgctgtagcacgccggagcaccgccgtcatcgtcgacccgaagaccgccgccgcttcaacctcgccgcggtcgtcatccgtcgtcgtttgtcgtcgtccaagagctcggtgagttcgccgcgtcgccctctacccattggtgtcctctgtttgcgtcgtcgcgccgtcgttcgccggcgagcatgcgccgcccaagccatcgccggtgatgacgtcatcgctgacgtcatcgttgccgtctgccttataccgatcgtagaccgtttagatctcggccgatctttgtggatagggtagatctcggccgcctgatccgtagactgcagccgtgcacccggtccaccgtgaacccgacccgctgacgcaataatcctccttttccttttcaaaaataattcattattgcgtcataattcaattaaaatctatataaatgctttaatccgatttaatctttgaaaattcataactaattctttgtaacttagtttaatgtggttcaagttgcaaaagttttataaaataaagatctacatattaaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtactgtttatttggtttttattagtttttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattctttgataccttgggttattataacttgactagttgagctttatatattggttcagctagatattagatatgattgcttagccatgcttagaaacattagcacattattgggataacttatgactcattattacttaatgatggtttaaagatagttcacgatggtcaatcgtgattggttaattaattacttgccaactaaaacttgataatggttttgagagtcgtgctcatgacaattaaggaccggttcgcgagctactattgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccacggttatgggcgggttgagcaatgtttttcgtgattagtctcacacctctcacaataattatggatgttatagctggtaataatttgcttagctcctggtttggagttagttctgtacagccgggtatggttgttcaggatggttgggcctgtgcagcatgggtgtgtagtgttgattaaaatttctgattaattactccactgttttacttctcttaaatgttttgctaaatgctgcttttgcaaacgagcctatattatgccatcctttggtatccttgtgcacttgcatatttgctgtgtggcttgttgagtatgtcatatgctcattcttgcaataatcaatcaacctcagttgaagaaaaaggatacagaaggagaagacgtttggcttataccccagttgagctgcctgtgggagtggagctgaagccatcgctagaccgttattccgctgctgttttcttttcttttgtaagtgtgtaacgttattattatgatggattgtatattaaattgtcagtttgtgtacctcggctgattcctggacgaggattttatgcacaaataagttcggaaattactagtgaatttccgggcgtgacaggtatcatagcccagtccactttttgcagccaatgcccacaaagttacaaaatcaagggcaaatagcagctatgtctaagtccaaacttaagctatcaaattatgattagaggttcaacattacagaggacttggttctcataattaagcagcagtctttaaaaagtgaattgacagagcttaggcaagcttcttctgctctctggttgcatagctgttcattttttccttgtttcatcctgtgtatgtgctgccaagcagcagcaagtccttgttgcctaccttttttatgttgctacattacaaataaattagtatatgcaacgattttatataggaacaagccctatgaattgctacaaattaacaagcaccaggtacagtttcgtagcaaccaagcctcgcgacccgccgcattggtatactgtatcacctccagctaacctgtttctccccccatttaaagatttcttcctaaattcaggtttactccagtgctcacaaagtagacgccaaccctcttgagtaattgaaaaatcctttggtttagcagaaatcaaagcttgcacagtaggccaatggttaccatgcatcctcatcaacatcctctattggtacattgccttttttatataacatattggtagctattttcttctgttcgaacagcacctgtggcacttccttcttgataatatacctttttaaatttcagattgcattgcatcatgcttacaaagaggaaaatattaataaaatatggcaacattttgaactaagatgtttgtgctgctgaatttttttttgcacaattttaatactattgaataatgttctcttcattttgaagtatatgcatnnnnnnnnnnnnnnnnnnnnnnnnnnnnnnnnnnnnnnnnnnnnnnnnnnnnnnn

SEQ ID NO: 27477 - DNA, 52549 bp, Oryza sativa
  unsure (1)..(52549): unsure at all n locations
nnnnnnnnnnnnnnnnnnnnnnnnnnnnnnnnnnnnnnnnnnnnnnnnnnnnnnnnnnnnnnnnntttcagattgcattgcatcatgcttacaaagaggaaaatattaataaaatatggcaacattttgaactaagatgtttgtgctgctgaatttttttttgcacaattttaatactattgaataatgttctcttcattttgaagtatatgcatgccatttcataaacttatccggtcaaagttataaactcttttaatgcaaacatacatgagcatagttttatcatgtgaaaaatactcccacaccattacatttataaagaaatgagataataattaatttataagattgggacacaaccaaaatggtgccatgaagcggtacatacagcggtggggggccgagaagaacgaaataaaaaaggaaaaaaatggctatgagaatgactcgcacggagaggatatatgagaaagtggagaaacatactgtctttgatgcgaagcacaagatgtcctatagatgaaaacattaaaaataaagatgacaactatgtgcttaatatggtagagagtagagagtccattaatttattgcgcccatgtgtccgtgatcatatctactttaatttgatctaaaataaagattaaagaaaacaagttactataaggacgtttgttttttagttatagcctatgcagtacagagtattttaccttttttttcatgcaaatatagttctctttgtcacatattattgccgaaggtaccattgtgaaccatcggtaaagttgtgtcctctcagtattttttccatgtagccgtgtcactctatcttggccttcggaaacatataaccattttcgagaggtatattaaaccactctgttactaatatatcccgtcggtcactaataattgtttccgagaattatattaaacccctcggttactaatataccccgtcggccactaataatcatttccgagagttatattaaacctctcggttactaatatactccatcgggccactaataatcatttccgagagtcattttaaacgtctcggttactaatatgccccgtcggcgacttataaccatttctgagtggtttcttatataactctcactcacttaaatatcccgtcagccacatgccaaatagtcaagtgttctcttaataacccttaataaccctcactaaaatttcaaatggtcggccacataaatctttctgaccgtttgtagaatttttttcttagacgcttggcaaatctttggattctagtagtggttggtagcttcatggtataagcagctgtcaatttgagcaataaattatggaatatcactggtacaaaacatttgtgcttgtttcttccaaaaaatcgcccgacttgtgacatgacgtgcgacatgccatcgtcatggatgcctttcttcctataaaaaacgaatctaggaccgaatgtaatatgttctagtactatgaatctggacataaggacatgccacatttgatagttggttttttgtgggacggaaggaataaattagattacgatttgttttcatgcttttttgacgtctaaggattcaaaaagttggaaactcatttatataggtggttgtgctaggacgaatgcttgtctctacggaaagttggcaatgggatcctatcgatgggccaagatccatggataggggcagttgtgccggggtcgagacgtcgcctcttctctatccttgtcatagaagtcgtcgtcggagaaaccggttcgtcgctccatgatgggttgattcctgactatatttatagttgatgtgtagggcaacctggttttgtacgtatgaaacaatacaatacatacaattaaatgaagacacgaggtttatacaggtaaaagtttaactcctgtttatatggattgatttgagatgttggagaatacggtggaaacttagtaggctaatctggcgacaatgggatctcgacgggagacgattatctgggggctcgaggtggatatattattagctctggcatctggcgatataaggttgtgtcttccattgatctgcgtttaaccccaaggccgctgcttatgtatacgtgaaaccatgtcatactcaatacggacttgggcaggttcaggagttcaaaaaattaattccctggatatatgagtatgtcgtctaccatcaatccccatatccacataataattaatgcatgtaccggaaaattttctttgtctgacaggtcggtatcccctatttatttccttgatatatatgttcaagtcttttactttgaatgcccaaacaagtctttgtagaaatttgtatataattttacaattagttgctttgctgttttgtagttttggtctacgtaccttttccattatcagataatatatctgatgtttttttctcttcctgccatttgttttagtatgatactatttgatattactatccccctctaatcacttcagttttccttggcttgttgcaaatttcaatctcttttctactagcaatcttccttccagacatctaactgaagctaaaggtactcaatttccaagtcattgtttgagtaaattctctgtgtacccctgaaaactcactcaatcccttttatacccctaaaattaatccgatcccttctatacccctgaaatttcaacttgatcctttccatacccctaccattatattttacttcatttcactagctactacatttggttgcaaatgtcttttttgcccttgatgttttaagttttaataataggtaaattggaaccatgccattgtacttttgcaaagtttgagatatgccatcggtatctcaatgacatgtaggacccacatgagtcaatggcatgtgggtcaggatgccatatctcaaattttgtaaaattataatggcatggttccaatttttccaataatataagcttgaaaaagattgaaaattttgtttgagtgcatagtatgtacatttttatgaaactaatgagactaaataaaacaaatgtactaaattaaaatatttatttgaaattttaataagacaatggatttttttatcgggagcattcataaaaaaaattattgtgagcattggtagtcctatctttatataaatgctcctcatcttttatgacttcttttaaataataaatacatattttttatttcattatctaaaaataaattttgtgataaataatgcatcacacaacaaactcataataataatagactcatgcgacaaacttttacatttttaataatgtaattcataaattctattttcatccaaagggtaaaatggtcattttcatagaaattagacggtcaactatggtcaactgaaggaaggagtatgaaaaggatcaaaatcaaattttaggggtatacaaggaactaagcaaaatttagaagcatagaagggattagctaaaatttctggatatataagagattttctcttataaaatgtctcaagtttctctttctcatacaacaaatttttgtacactataaatttatatgtttgcataccatagggcaaaaatagactttttcataagagtttaacaacgaactaacgcaaacggtgcagaagagatgcaaactaaaatttggaagtataaagggaatgagcatactgaagagcatagggattagacaaagttttaggcgtacacagggaattttctctttctcgaaagtgtatggagtaaccaactctatcatccaaaccttatttactttcctcaaatcggctttctatgaatatgaaacttcatttgttataacctactcctgctttatttgtctctctatctttaatttatgatatatccccatatatacaatgacgataaattctgccataacaatctttttgtaggctctaattttcacctgcacttatgcaagttgtcaatgatattcctctatggacagttatgtctccaagaacaaaactatgtaaaaaagaatcacctagcaccaccgtgcacacataagccagtaggaatttaggcatgtgcaatatataaatgctccacagtaatctgttatcctaactgacagctgcttataccaaactaccaacaaataataaatttttggtgtcacagaatgacaattacatgttccccaccagtgacaacacactgatcagacctgttaacaacggaaaaaggatgagtctgagttaatggcaagataatatcagacacgtacatcctttttatatctcaggatggagactcaattaacggctaattaaaacgacaaaagcattatccccgatggtttcacaactactgtagtatataaatattcataccgcatgtcaatcttcttactctagcattcctcgtcctgccctctaaaaacaaaagaaagaaagaagagaaaaatgagtaataagttacacaatagtagtagacattcatttctactggcttggcattcctccaacctcgcgattttacacgaagcaatcagaataatcccgagatatatcgtcgccattgtcgtggaaattctgcgaggcctcctcgtgatcctcctcctgggcttcgtcctccacctcgccggcggcgaccgccacccgccgccggggccgatcgcctgcgcgcgcggcggaacatccggcggctgcacggtcacgaacatctacggctccttccccgaccgcgccgcctgccgcgcggccggcgtcgcgtacccgcgcaccgaggaggagctcgtggcggccgtggcggcggcggcggcggcggggcggaaggcgaaggccgccaccaggtactccaacagcttcccgcggctggcgtgccccggcggcgtcgagggcgagggcggcgtcgccatcagcacgcggtggctgaaccgcacggtgcgcgtcgacgcggcgaggcggctgatgacggtggagggcggcatggtgctgcgtgacctgattagggaggccgccgcggcggggctcgcgctgccgcactcgccgtactggtcgggcgtcacggtcggcggcgcgctggcgacgggcgcgcacgggagctcgctgtgggggaaggggagcgccgtgcacgagtacgtggtcgggatgaggatcgtgacgccggcggcggcgagcgaggggttcgctgtggtgagggagctcgccgccgacgaccctgacctcgacgcggccaaggtctccctcggcgtcctcggcattatctctcaggtacacgtgttgccatgtactatatgcacgtgcttcagaaatgtccacgtcaacatgctcaggccaaactgcgtgcatgcatgcatggcagatgtggattttcattcctggatgggatatcccctcgttatttgcatgtcatataaatagttatttgcatgttatctaaatagttattaaaaagattaaaatatatatatatatattaatacgaaatatatcacttcacaaatatgcaagatcaaattcaacttctataagttacaacaaaaataacaaattaaactgaaaaaagttatcgcacattagtaactatatttgttatttttgctacaacttgtaaaaattgaatttaaacttacatgttagtgtgtgatatgtttcatattaatctatgttgccaatttttttatatattttttgatgactatttaagtgacatgtacgaaacaagagtatatcccctcaaagcatgaattcactttcccatgcatggcccctactctggtgttcttttgttttcagagagaagaaacattatgctttcgatatttttttttcttagctaggtgctgggaataattgtattttatgattttttttaaatgtcctaacgtattatatattttttaattacatggcaaacgtgcacacacaccactacgcacgcaataccacactcattccccatgaatgtgacgtccaacacatgctttaagaaaaccaatggtatattctatcacactaaaagtctttttcaaataccaactatatatgtgtaatattcatatatacaagtattaaatcctggtgggtggatatgatcgataacatcatcacaccactcgtgcttcctgggaagaagctataatttgggtgggcgctaatagtaaccatcattatatcacggtcatgcatgggagcacacttagagcaaggttaatagtatagccaaccaaatcatctatagctaatctaatagctcatttatacaatagttaaatataaaaatatactacaccattaatatccggtcccacctattatacacacataacgtcttggagtccgtgttgcagccggttacaaatctatagtccgttttcttctctcttttaccttttcttctcgatacgtggttatagttggcttgtagtttgctattgtacccgctcttagagcaagtataatagtgagctataagtctactataaacttatgtggagaaaagagataaccaaaaatcaagagtgttggctctcatgtaagagctaacttaacacaagctctaaaacaaatacagtaaatatatagatagagaggagtagaaaattacagccaaccttatagctaatctattataaatgttggatttaacataggctaacagtaggaagatagctctaccattatcttgctcttatggcaaagatgtctcaattaatttggggagcactctagcgatattcgccaatagtgtcctgatttcgatatgacaaatctacagcaggtagccgtgtgtggttgcgtaaagaataagacactatctccatgaaaaaaataaaataaaggcgtacaagtttttcgcacgtggtcttcaatatagaacactgattattaattcatttcacactatataccgccaacaactacgtatttaacatggtataaaaatattttcaaacataaagttgatatatactatatcataacagtaagtatatttatttaattcaaattattaattagttgacagccaaaagtagttttgtcgtgcacacacatgtccacgctttcctgcaggtaaccctggccttggagccacagttcaagcggtcggtaaaattcgtgaagcgcgacgacgcagacatcgctgagaaggtagcggtttggggccgcctccatgaattcggtgatatggtatggttgccggggcagcggcaggtgatctaccgtgaggacaaccgtgtcaatatttcgacgcctggagatggtctcaacgactacttcggcttccgggcgcaaccgacgctaagcatggtcggcgcaagggtcataggtgattgaattctttatcatatctcaaaattttctgagatgagtagccagggtagaaacctctttttttttttttcaaaattttccgtgcccctttcatttcatattataagttgctatgtggtcggtagagaaatttactaacatctataactccaataatgttattacatgtaacattaaaaatatttcgataatatatttgttttcggtagaaaatattgctccaattttctataaatttagtcaaatgtaaaaaaagtttgatcaaaaaaaataaaaacaagttataatatgaaacagagggagtaactattttttttatttattttttttagagaagggtattttttatccggtctgggctctacatccaaccgaatatatgcagcctttttaaaattagaaacttagcctatcaaacaagatatacgtaactcttaaaataatctataatttaaaattcgctcctatgaagtaactatttgaacattatattggcgcagatgagtgtctagaagagaatccaatgtacactgacactgcccgatgcctagcatcccgtgctgtcaccaagatgttcgacctcctggcgtacggcttcaccaacgacggcgccaccttcaccgggtacccggtggtgggctaccagcaccgcatccagtcctccggctcgtgcatgggcagcctggaggagaaggacgacggcctcctcctcaccaccacctgcccatgggaccgccgcacgcggggcgtcttcgcctacaacgtcgccttcaccgtcccgctctcccgcgcgccggcgttcgtggccgacgtgtccaggctccgcgacctcgacccggcggcgttctgccagatcgacgccaagatgggcgtgctcgtgcgctacgtcgcggcgtcgtcggcgtacctcggcaaggcggaggactcggtggacttcgacgtcacctactaccggagccgagcccgcggcgcgccgcgcgcgcacgctgacgtgttcgacgaggtggagcagatggcgctgcgcgggcacggcggcgtcccgcactgggggaagaaccggaacgccgcgttcgacggcgccatcgccaggtacccgaacgccggcgagttcttgagggtgaaggacaggttcgaccccgagggcgtcttctccagcgagtggagcgaccgggtgctcggcgtcggcggggcgagcccggccatcgtcggcgacggctgcgccatggaggggctctgcgtgtgctccgacgactcgcactgcgcgccggagctgggctacttctgccggccggggaaggtgttcaccgaggcgagggtctgctcgttgttgcgagacgctgccgatggctaccttcgcgatcgtcatggcaatgtcagggttaatgcaactagtacagggaagcattcactattgcacgaatgattttcctaaaaaaacaataggttggacacggattataactggtcgtgtctgtaaaaattgactcgcaccatatatgaaaatcttttatagatgtatcttaagaagctatatgtaaaaatagggcttttttccagaaaagcctcttaggcggccacagggaaatatatatttttgcaaatgggcctcttaaagttttacccaaatatctgagttaccttctcttttccgttttagcactctaattttttttcaattcatccttatctactctcttctactttctctcctactcctctctttctcatatccgtctctctctctctctcaaactgctctctcctctctctctctagcgggtacgtggcggtgggcaccctacgcatcaaaagcggtgaggggtgacggctgcaacggcagtcctccctgcttggatcccatgaatctgctagcggtggcaggaggaggagcacggcggctgcggcagcggccctccctcgcccagatccggtggtgggaggagcttggcggtggcggccggctgcagcggccgatgactggcaggtgttttgcgatttttcctcagatttttgtattcgcgtacagacgatgtaagtacccatataaaaaaatagcaatttttgtatacccttcggagtagatgaatcagagatccacacgtgaaagtcacttttgccgtcctagaaaaatcgtttttatccggtgattgtaatctttaggacttggcgatgtgcgacggctgtctttgaggcatggaattgtcgtgcgctgagttggcttatttatggaccatttatatattcgccttatggtcgatgtacggcattgtttttatttggctaccgaagcaaattaatcggtacaacatcgaaaaagacagtcaaacataacaatataagtgcgacaaggtaaagttgaaatgacaggaacattatttttttcttagtagcaaaatattttgaaatatgacagcagcgtgtaagatcgaacatctcaagatcacaattacataacactgagccatattatttgttaacgaggcacaactttaaaaatgtgaaaaagaacaagttcatacattctatatctataagcctacaagttcatacagatttttgctaactaaggatgaaaattcacaaatagactttaataattgttttcttctaatttgttggttttattaattgttctagttattattgttgcttgactattgactctctttgtgagagttttataataagttataaccatctttgaagcaaaggcctgatttatatttcattattgaaaaaaggctgaatcctagacatccagacactacggacacagcatcatcgctaagatattctaggaatagatatgccagttaacctctctattaatttaagccaaattctaccctgcacctaaatctatttttcatacagagtaaaagttaattcatttatttataccttgatttggtaacctcaaatagtgatcacaaattcattcagctatgcaactgttcagagaaaaaaaaacaataataaagtcattcggataatatgctggctgatgtgatccctgccatctatttcatcataaatggaaaagattggtatatataacatgtgtaaaaaccgctacaatgacactgagccatacacaacattagcaactgctatattctcaaccgtacaagcagttataatacttgaaatgaaataaattgatattaatgttgagatatcgaccgtaccacacaatattctgccagctcagtttccctttgatgctctcaacctactgacaattctgaacttttactccaagaaaacgtgtgtcatgtccatttttgctatttatggaggaccaaatatttatgacaaagttaattaaggtttatgttaacacaacttaccaaaccttgtggtttaagataaatatttacactggaggtatgggtcgccaaataaagggctattgtttttattgttataaaagcaaaaaatataataatacgctaaacatgttggttatttttcgaattatacctgcttggactaaaaagaagagtgactcaacttgctaatacttgattccgaattttgaaatttttaaaacactaaaaagagtccatgatatttttcgatcgcttgttttctttaatgcaaactcccaacatgttttcggtgatgataatccacgtcatcagtggatataatccctccgtttgcatattacaggacgtcgatcggtttgttctaagtgaaagttcttcatgctagaccaaatttgaaaaagaactagtaacatctgtatttataacggtccatattccacaaggcaatttccaaatttttggtccacctgcaatttttggtaaataatttactgttttgaattagcaattttgtttctttagaacatcaattttgttcaaaattacccgatatgtgttcaactattaagtgttccgtctcaaatgttgggcccatccatcctcctgaaatgtttgcaattttgaaatataaaactctggcatgaatgagaacggggttaagattaggcatatttactatcactgccacagacctcctcatcaccaacggttcaaagttgccatttgtaataggcaaattttattgtaggccattgagattttgtggttttacctcctacacatgacaacactacaagaaacctgttaatccatgacggattcttgttgacggattctaagactgtcactggtaggcgcgatctgtgatggttatcttattttcgtcatagatgtgcactagtggatattctcggccctctaactcgtgacggttttatttggaccgtcacagtttatgactataaattcgtcatactctagttggcccaaaacaataggccctctatcatatatttagtgcaaagaaaaataaaaaaatgtgattgcaaaatgaatcaaacccaaaagacaatttgtttttgaactaaattattttgttacttcgttacttgtatgcgtatggtacaactgaaaatattctgtatatatatagtgtgcgaacaaaaaaatatttggagcttgtaggtattgaacctagcaaacgtcataaggggcaaaaagcaaacgtcacagatttatataatgaatttctataaaaatatattaaaagttaaagcaatttaatcaagtgaattaatgaggaaactaaaattttcctttgaaaatcatggctagaaatatttttttaatattctaagtggtccaaattattctctaaaattttccgtgaattttcggagttcaataactagttttaataccacaaagttcatttaacttattaaaataaataaaaaacaaattaaaatccctctctatgtccttgggcctttttcagcccaagtgttactcactccctcccatagtccgtatcccctctctctccttgggccggcttccccttcccctccaccttcttcgggccaccggcccagcccatttgctcatctctcgctaagaagtctatttttcctccctcctctcaattaatttcaaaatattaaaacttcgaatcgatttttatggcactaaatcaactcgtataaaccagcaagaaaatcaactggattaatcgataaacaatttagttgacattatgtccttacaaccttcatttggaagtatagctgtctgcacttgcaaggaagtacggttatgaagaacgaaaatttagtttattttagactgaagattcaagagagaccagagttcatagagtcgaatggagaatgatcaagagcttggccgagttaatcataacgagtttgatcttgattaattagtctggtccaaaaaatgggcgaattgcgttgagagcaaatcaggaacaacgccagctatgcataaaggtaaaatatgacacgtaccaaagaacatgaacaagctgacctcgaacaaaagtacagaaggacgactattaagtggggatttttgcaccattcaaaatcagaaactcaaattcaactttagggcaacaaatttcagccaatttaccaattaattaaaaaaatatccaacttttaaattaggagtggcagtgtggcacctcgcaaatgaatacattttcaacttgattctttcgtagggatatttgtgtatgactgcacctgccagaattcaaactcagtatcctggttagtgtaaaggctgaaagttcgcgaaatgaaaatttttaggtgtcacatcggatgtttgaccggatatcggaaggggtttttagacacgaataaaaaaaataatttcataactcgcctggaaaccacgagacgaatcttttaagcgtaattaatccatcattagcacatgtaggttattgtagcacttatggctactcatgaactaattaggctcaaaagattcgtctcacaatttcccctctaactgtgctattagtttttcttttaatctatatttaatgctccatacatgtgtctaaagattcgatgtgatgtttttgaaaaaacttttgggatctaaatgggggcttatactatttcctgtgtccaagaagttacttaatagaaatttttcagaactatagaatatgatatttgcaaagcaaagaaaaatgacctctggtgttccaataaaacagaggttgcaaggcatcagtcacacatctatctataatctatctatctatttataactatactaattaggcactttctacgagctcccatgttaattagaaagatcttatcgttaattagatagatcattttatcaccaccgttagattgaatatattatattaaataaggcatacaattaaataaattatgggctcattagtttaatgtcaccaagttaatagtgttgttttataatctcacgtatttcactggtgcggctgatttgggcgccgatctcaggattcggccagaagaaaattaaaaaaaaaggaagtctaacatggatccgatctaatatatctactccgtctgttctgttcgctaatgatggaaaaaactgcgaccatggcgccaccacaccgtgatttttcacttttgtgggctgttttaaaagcctgtcaaatcttatgtccaagggcacacatcaataatctatcttagatctatcttggagagtattaaccaatcagccaggcaaataaaatatggggacacgaggccacaagtggaacgagattgatttttccgtcaatcaaagattgatttttgtctgagacgacacagatcagaattcatccaggctcgctcatatacaccaacatctatcatggcatataatttttttgaggggttgacaattgataagaaaggttcactcttagtacatatttaatttatcatctttttatcgtctcatctgtaatatatacaggtaggtagctttcttattgatgctgatctcatgttgtataaagtactgctgattttatcgacataacgatctgttcttttttcccttttttttagcatggatagttcaacgttatcaattatctaaaaaaaagttcaacgttatcaaccaatgtacctgcatctcccctgtgtgtgttttagctgaagcgttgcatgcgtgtagcataagctgtctacatgaagcagcttaacagaattcaatgacaaggtgattatggattcatggaagggtcaatgcattaagatgaacttacaagaaaaccaggtttgaacccatttttatccggttatattttaatctatttttatttgattaagtacatgcatttacgtttttaaaagaattttaatgagataaggaatttaccgctggctcgcgagcgtgagaaagagttgtgtgcgtctgtgcatttttctatgtgatgaaaaaaatatacagagattgatatgaacaatatattaatagcgcgtgcaaatacgtgcagaaagccatcagtaagaaattttatcgtcaaccaaattttaataatttgagacaccacgccaattaccaagcacaactcactattcatttgttaccgattacaaaaatatcaatcaaatagggaaaaaaatataactgagactctcttcatacttaataactcataatttctcaattaaattaaaaaaaccaaaaaaactatattgagaccttgttgtgaattaagagattagaatacaaataaaactgtaatatttataatattaataataatagcccgtgcaatgcacgggttggcggctagtaaaactaattttatataaacttagttcacctttggacaattccaaaatatattataacatgaaacagagtattatgagcactgcatcacagcacaacttaatcaaagaagcagcgagtattactcacgatgagtttgcagccttctccagcagttgccacagctcaacgacagcagccagaattaatggtcctccgggttataatagttgttgttttgaacaagagtatggtctctgaaaaaaataacttagacattattttgtattataatatgcacagaagtgttaacaaatatatgattttattaatgtactttataaaactaatctatgcatatagtcaccatatttttaaaactaatctttgcatgtagccatcatatatgaaaggcaaatattttagaaatgatttataatcaaagattctaaagtttaatctcacccttatctaaaacgacatgtattatcagtccggatagagtaattatcttattcctgagaaatatgggcaggctcgacgccacatcacagttcctaagatttggagttaagaggaatacactgtcatggccgctcaaaattggcttagacaccagccaccggtgaatctgcgggccgagtctgatcaaagtggtggctccccacgtgaaactgcacaaccacccctcgctgacattgttttcacctgtagagggcttttacagtgcttgagaggtatggaaggtaccttcctccatacttcaaatccaccattgatttataaaagggtaaattcggaatatggagaacaacgaaaacaaaggcagtttagtaattcttttagccagttcagtaattatcattcgttaactttctcttattgccgatttgatttcctcatggagtaattaagatggtaattggctgctttctcatcgctatgtgtcggcggcacttgggtacaatttcctacaaataaattgagagtagtattgtttttttcatcgcaaaagcattacttacaattggaccattcataaattctcttcgtataataatacataaagacaaaaggcatatacatgtcgattctcccctttcaaaatatttcaacaataaatactgtcaaagttgattacttggttctttgatcaaagttttgatcaagcttagttagatgagtatgtttatacttccaaataagtcttacgcaagattacaaagttcgatgtctttaattaatcgtactgctaattgttccctagttacctaatttcaagcacagttaccgagtttatctcagtagttcgttggaaacaacagttgctttctaatttgatcacaggtacaaaattacctatatgaccatctaactttttacttaatacctggcccatatttttagtaccttcatgtaactatcttttgttatatatcgttggattaccagctatcaacggctataatgtctcccaagcatcttagaaagcctctcacctgtagttcaaccatcggcccatttgggtgtccaaacagaatatctaaaactcccaaagtctctcattccaattaggcgtgatcatctccccaactgaagcaaacaatttcaccttgatctcctcacccattgtcaatcctgggatgttacaacataacatatggctcgttagtactctctcgtttgtatgaatttccttgagagaagttatattctatttatgctatggctactcatgcagcccataaatactgcaccaaccacaaacacactttgttttgttagcaatatagaaacaaaatgtatggttgtggtagggtatattcatgtgtcatatgacatgtgtaagaaaggatgagcagaaaaaataatataatgtatttaatgatcatgcaaattaaccaattgcaattttctcctgttcagcgaagcaaaatctcctgttcgaggtgaagcaattttcttcaatgtcctcactaattgtcagtactagaacttcaatgtcttgaactcggtcacacgtacttcaatgcacctttcaccaagctgttttttgagatattactgttacattgcagtagtatcttgaagtacgttacggcacggtgagttgatgacaacttgagaccacatgcagagtctgagaggacatggactgaccggacgacggctgaatctaaacatttttgaatttatctaaactttcgtatctgcatcattccaaaatgattcttccttcggcaatctatccatcaatcggatatgtgaggaaaacttgaggttcccgctgaagttacatccccaaacaaagagtcaaacctcgaccagcagaaattcctactgtctcctattcctacgagccacacatttggctgaggctatgaaaagacgaagaaatattaaatagtgctagaatttcacgataaaacatatcttgtgccttttttccatctttatctgcctcgaacagaaacatgtctctgcaatttatgaagatacctagaaggctagaagctagggaagtccacgaataaatagagcaccaccagtcacacccactttccatggccagagttaagtgcaatatcaatttcttatctgacaaggtacacaaattgaaaccaaatcttgcaaacaaaaactaacgacacaacaatttgggatgaatacattgttttttttattcataacaattaggcaaattttgttgtaggaccctgcgactttgtggttttagctctagaacacgttaaaagtcgatcattagggaaagacactgtcaaaatgtgattatttcctgatagacaccgcaagcattaaattctcggactttactcttcgagctcatatcacttttaggataggtggagaaaatagtattttcatgcctctatttctaatttctccgtgacctaagatcacgacaccgaggattgtttatttccataatataataggttcagccaaacatgactgatctgcaacactgaaataaggagaatgtaagtaaacaagtcctcactgacgtcgtctgtcttgaagctgttagctcgagcaggaaccccatgtgtccctcctcagggtcaggatcaccactaattggcgattgcttttcctcgaagaacaaggagaagaacatcatgaccgatctcatagaaccagccccaataacatatcaataatcgaactcgaaagaaacgccatagaaggtctaatactgaatataacaccaaggcacgttattatctgttaacgaggttcagccgaaacctacatccccaaggcactaattacggacactactctcttatacagcatattacagtgtatctaggtatccaccctcctagaactacttgctatagtagaatggctagaggatagttatacatgtctgcaagagctatctgtcaggctaaaggctactcatttagtagtactacagtagtgaatatagtgactgtaatgggactcttcaacctatctctaatgaccagtaaacttgtggtgctgcagtagtgaatatatgtgtttctcaatcgaaactcaaacaacttttgagaagaaagcgaacagttgaatttgttattctttgacattttcttgacaggagtgtatagcattttttggaacagtgagcattgaacacgtatgtataaccgatagcctcgcgcggcaggtgaaatcgaagatggcatcacacatcacgattcttccaaatccatggccataccgggtgtttggtagtggcacacggtatttttgggacgttaccgtgttcctgttcgtacacccgtaagctacctagtgttttgttaaactctcggtaacatttgggagcatacgggagctttccttgccctggtagtgttcgcagccagggaatcctgggactgcagagtgccaattcaatctatccaagactgcaatataattttctgccagtaataccaacaggattttgatctgtgttctgttgtatgtgacgatatgttgcaacagtatgttcgattctttgtttttgtcttcaaagttttcgaatgaattcaatctttttaatacacaaagagaggttccaattttctggctatgcaataaaccgctcaggaggagccagaattcagcgatgggagtacactatttactgtggctaattacctaattccccacttgtctccatcacttgaatcatcactgatgcatgcaggactggtaattcctggtttgccggccaatcaattttgcaagactggtatcgagtcctcaccgacggcggtgattgccgatgaccacacgcctgaatcctctaggattccggcgtttaccaataaagtacttgtttatctgggccaaattaacagaagattaaaaggtgttgtggtcacggccaatgccaagcaaatcaagcaagttgaacaaactgtgaaatgtgtagtattacctgtgcggcagcagaataagaaccaaatttcctgatgcctcctattccacacatcatatgcactgctaaaataatttctttttgatgtcatatgaaaacttgaatatcgtggagtgtgtagtgctctttccgtcgtaagatgagcctgcactatttacgcaatggaaaggtaaccacaaccataatggacaatggttgtgcaccaacagcccagcaaccttcctattaaatcacagtacatggtagtactatctttcagttactgcgtactctctcaattgcacattataaaacaatttttcatgtcatctctcgtcgagattcacacatgtaattcacatacatagatccatgcattaattaatctattaaaaaaccaaaatgtcttataatgtaatcatagatagtagctaaaaagtacacattacatatattcaagccaattctctcaataaaacgaccaagaattaatataattcgcagaaactcttgatggctttcttttcacattgtcgcacaatttacactattagccgttaacccttgcattacataatcaatcataaaaatgttacaaatgagattttgcaattattaaataatgaaagagatcttctatggtgcttggaaggcatgacagccattgattacatacaatctgacatataacaaaaggtacgtagagaaaggtactaaatatgtgggctaggtattaacttaatacattaagtaaaaggttatatcagtaattttggatgcataatcatctgatgccgttgtgagagccgatacagatacagatcgagagaacatacatgagcgatctgcagcttggatggctcaatgggaagataattatctgtcatggaggctgttgatcaggatgttcagtaaatttgattgaaggcaaggattgctccttgatcaactgtcgtacataatgaatggttacaacaaattgtggaaagaggacgggaaggtcactgcttcctgtgtctatggattaatcgaagataatagtatgatcttttcaataatcccattttagatgagaatcagtaaaggaaagaaggatatggaacaaattatagggacggacggaaaactcagtagagttctagaggtcacagctaataataattactatactacccatgtttacgtttttctattcctaaactaccctttaaggaatgaacggtagatagtttatacgagaggaggtacttggaatacctttcaagaaccgtgaaaggcctcataatgaaaatagtatacttgggatactgaactgaggacagtacggtatttattaatttcgatattcaggtactcatcaggtacaactcaatactactcctattaatttattgatgtaatgtttttgaacaaaatattgacatatttagaccacgctaaattatgcacccctaccaaaaaaattattatgaacatttgaaccggattaaaaaaaatcaaagagacataagatataccgtgttcttataatcagtgatggctttcgctagtgcaaactcatgttatatatttatgttccagatgtagatggagccgatgtttaggactgcgaaacttacctgcatccaaaagaataaatacttgtttgtcagtaaaataagttgacccattttctcgcattgatgtcgatcaacatgtcaatgaaatatgaagggttaactaaaggatcatgtgaattggtatattaatccatgatcagattgaatacaacaattagttcaatttatggtaaaatctggactaaaaaaggtatttttgagtgccaaaaaataccttacccttcatattgctagtacacgataatcataattgtacagcctgattaagtatattgtgacatgctatatatctgtatgtttacatatttctttttttctaagtgagaagtgcaaattccatatgcagcttacttttttttatgtaagtggttgttgctacactcaggttactagaaactttcatgatacaaatgctattaatggtttccttttacattctctatcttgaggaaaacaactgtacgaacgaaaattgccatatggaaataaaaccaacaagatgttgaagaatctgaaggaactttggtacgcgatgttgatcattctttaaccaaagcccttaataagaggacatgcaagcggctggacttctcgctataccctctccatttcttgttatatgtcactttaacttttttttctagttagatattttcaagtttgattaaatttataggaaaaatagcaatactttaaacacaaaacaaacatattatcaaaatataattaatatgaagataatttggtgttacagatgttgctagatttttctataatcttgatcaaactaaaaaaacaacctataaaatgaaacggattggagttagtatttgatatttctggttggactagcatggtatatctgccaacctaaaggtcactagcccaacagtagcactgtatgggcttgtgatatagacaatgagcacagcatcgaattactctgaatctgtctcgctctaaaatcaatacataatgaatcactgtcagtatgaatcatggaaagagtaccactgaaattcctagtgtctcccatcccaacgagctgcgatgtgttggccttgtttttggtttatagccaaataaattagcactgtcaaaaaaaatgacacctgtttggtttggaaccaatatatttggcatagaaacaaacatgcccaatttatatgctcaatctcacccattttcatttgtcaatcatggaatgttacaagaaaacttatgttatatatgcggtctcttctcatgagtttcccttaattagaataggtgtacgctatttatggatgctctggctatgtatctcatatatagagaatgcaccagccgcccataaattaaactacttgcagttacagtgccatatttaaaatatcaaagccatctctgcaaaatcataggaaccaatgaaacagctcattttccataatctttccctttcacattcataatatagagctatagtagcatgaaaaggctgtaacacattgtcaggatttgctccttcgttcatattataggttgttctagatttgtttcaagtcaaacttatctatgtttgaacgcgtttataaaaacattcagcatcctttcgatacaaaaccaaaatatattcagtgaaagacttaataaactattttgttttgtagatattgacaagttttctataaacttagttgccttaatacagtttaacttggccaaatccaaaatgtattataatatgaaacagcgagagtattatgagcaccgcatcacagcacaacgtaatcaaagcagcagcctagaatgaaagatcttactcatgatgagtttgcaaccttctcgagcagttgccacagctcaacgacagcagagccagaattaatggaccttcgggttgataatacttgtcgtttggacaagagcacggtcttaaaaagcaactttgaccattatttctctattataatatgtttgaaagtattaccaaatatatgattttattaaaatactttttaagactaatctatacttgtagtcatcatatttgaaatattttaaaaatgaatcataatcaaagattttaaattttgactccacccttatctaaaacaataagtattatcagcccggagggagcaattatcttattcctgaaaaatatggccaggctcgacaccacaacacagttcctaagttttggagttatgaggaatacactgccatggctgcttaaatttggcttagacaccagccaccggtgaatctgtaggtagagtatgatcaaactagtggctccccaggtgaaactgcatgaccacccctcgttgacattgttttcacctgtagaacaaccatcggcccatttgggtgtccaaatagaataactaaaactcccgaagtctctcattccaattaaggcgtgatcgtctccccaactgaaccaaacaatttctccttgatctcctcacccactgtcaatcctgggatgttgcaacagaacatgactctctttggtatgaatttccttgagagaagtatattttatttatgcaatggctactcatggagcccataaatagtgcaccaaccaccaacacattttgtttcttagcaatacagaaggaataaggttgttttttcgtacaaacaaaatgtatggttgtggtagggttcatgtgtcatatgccatgtgtaaaaaaggatgagcggaaaaaaatacccttattataattaacataatgtattaaatgatcatacaaattaaccagtagatttagatccaccaaataatatcaccagtggtaagatttgcacaacatatttttgatagttttctttgagcgaaagaatttttcttaatttaacatgaactagtcgaattttacacattgcacacataccaatgaggataattccccttccatcacatcttcaaatgttatgtcctagtgtttgatgagagcacttgatgcatccaaaacagcgtgcaagctcgaatggaaatgtcgattgggacatggatgcattcttcaatgtatcccctacttcgcaaaatgaaaaatagcaaaaagcagtgtaaactatcgtttatgggttcagttgagcagaggcttaactaggaaaaatccattagaattatttgctaggctatgttatggactgtatctcttgatgccgaggccgcaagtcctaaaatagatacattgggaaaatagtcacacaacatgtttatgttcggcatggttgtctgcattatgaagaatattttcataatattcgccatagttacgctcacaaaaatgcgtttaaacacatttattttccgtttaggtatcaaagtacctaatcctacccagaagtgccgtagagcttcgaaaaatggccatcttggccttttttctcgatgacatatccccgtacacgtgagctccgacaaaacaacacccaagcttttcctaacaacacgtatcaccttgctttcccttactgcgagaagtcctactatacccaaggtagttgttcgctcacttgctctaaaacactaagcacattctttcctttccgaaaagcggtccctacaaaaaataatatttgattttcaataatcatagtggaacatgtgagaatagtcagactcatatattgtttgttttgctacctttatttcataagcaaaagacctcttagctagccggggcaggcgtgtaacctgatgtgcccatctcatttattcactgtcgactattactctttttcatagtacagtattttaagtttcctcactccgattaattgtagaacaagaatgctcggacaaaagttcctcactgaggcgagggttgcctattagactagatgaccaatggaaagcggatccaactctctatctgcaaggctaaatcaataattcaagtcgcacactcccgtaatccgccttattttctttccatcccaaagcaggtcgagcccacttctgaaccacagccgatgggtcctccgatcctgagctggaatctacagagatttaatgagctcatcaaccaattcatatttcttgttcacagaacagatttatggtcaaagagaacaaccgcgtcagaatttagtctgttcataaatggcgacacatgcacattgcaaacaaatcagttgctcgcatgatgtgcaattgaacatttctaacggtcagaaaatttcaatctgtagtgtttagattgcagggagcatagactatcttgtttctgcacaaaagccccagcttttactgaaagcataaatgtgtactatagaccatctagtttctgtaacactaataaatcttgttgaaatggattaagctatgcgacgcacaatcctaacatcatggcgaacctcatgaattcggtaatcttacgagtgtaagccaagcttaaatgggtaaataaggctgagtacatgcaattggtatcccctctgtatcacatttcagcgcacaaatctcctgctcaggtgaagcaattttcttcaatgtcctcactcattgtcagtacaagaacttcaatgtcctcaactcggtcacacgtacttcactgcacctttcacccagcagttttacgagatattactgttacagtacagtactatcttgatgtacactacggcacggtgagttgatgataacctgagcccccaagcagagcctgagaggacatggactgaccagacgacggctgaatctaaaccattttgaatttagctcatgtttcatatctgcatcattccataacgattcttccttcggcaatctatccatcaaatggatatgtgaagaagacttaaggttcccgctgatgttagatccccaaatgaagaatcgaacatggaacagcagaaattcctaccgtctcctattcctacgtgccacacatttggctgaggctgtgaaaagacgaagaaatattagatagtactagaatttcatgataaaatatatatatcttgtgcctcttttccgtctttatctacctcgaacagaaacatgtatgtgcaatttatgtagatagctagaagctaggcaactcacgtataaatagagcaccaccagtcacccactttccatggccagagtttagtacattatcaattttttgtctaacagggtacacaaattgaaaccaaatcttggaaacaaacactaccgacacaacaatttgggatggccacattgtttttttattcataacagttaggtaaattttattgtaggacatcgtgactttgtgttttagctctagacaatgtcaaaagttgatatttggaaaaatacactcccaaaaggtggttatttgctgatggataccacaaatattaaaatattgttttctggttgtatacgagagaaaaagcgtgaaatgtcaaaaatgcccccgcgggcccacttatcgttttcttcccccacatctcagtccctctcacactttggccacagcaccatttccgcttgccgccggcgaccaccccggccctccctcttagcctcctctatggcagcgtggcttgacttccctcgtcgcgtttgggcggcagtgtggcctagctcccctcggcgcacacgtgtagtgatgcggtccgtcttccctcggcgcgcgctggcagcgacgcggccccgctccccggcgcggggctgaggcatcgagcggtgtcaaccctaagctgccttcaagtgaagaaggtggaaggggattatggcactggtgctaggggtagggagagcgaccaagagagagcggcgccggtctgacgtaggaggagggagtgtggcaccaactgacggctgagaagaggaaggagctggctgaggggattgaaaaagagagattcgaaggtgcaatttgttcacaatgcgttgaaaagtgggcctgctctcgccaagttagcactaaaacactaaataaataggtgcagtgttcgctaacaaataataaagtatcttcccctataagtgactttgtgcggtgttcctctgctagagaaagtaccgtgaaaagaggtatatatgacggtatatgagctggtataaaagcacaaaatgttattccaagtctagcctatgcaataataaacaataacattcatcattttagttgtcgttgaatagataataagatatataaagccaaaggaagaaagaaacattaagagtactgcccatgccaacttgccaacctatctggagatcttcatatttgaagccacagctttcgtacctgcagaatatgatgaattaaacaagcaacggaactggccgtcaaaacatttaccgacaccggaacttaattatatttttgatggatcagccgtacaactgtagaatggttttgtacagggacgacgccagcacaaagttgcaatacactgttcaaaatcgccaggacaatggttcaacaactcaaactccaattcttgtgatatgcatcacaaacatgccggatgagcccaatcacaatattgaagcttccgatgataacacacatcgtgttagctttcattaattgtatccgcacattgtcctcacaaacaatgatagactagcatgctcaacacgaacgtcttggatctttcgagtttttcgaccccatgtgttcacagtggcaaatttcaatgcaagctatcatgttctagctttgtgtaaccctactgccataagtaaagttcatcggccacttttcctactgcaaatgaaattcctaatgccccccatattacaacaagctcatgcagcgtgatgtacgctcaaagatgctatagggtgccaacccaagtacgcctttaagctcgtaaatttgtcattgatatcgaatgcatctcaaccaccagccaacgttttgttgtggtcgacctaacatggcatacatataccactttatttatatattcattttgatgttgttagtatggtagcactgcacaacgcgtgttggcacgtacctaaggacatctatagtttttggtttgaccagtccgatcaacaagccaaacaaaatttcagttctgtagatgcagaattaaaatctatttgtgggatccacgcaaaggaatcacccaatcaccagtccgttctccatgcatgcatgcatgacaaataatttcctattcattcgttggattacaatttagagttcgatagctgcagctggtagaataggtggtgaataacaagttctatttgattacatttggacttggagtcgtaatagctggtagctggtggagttaaagttggactctgtaatccgataactctctttaatagagaggggggcaacacaatgtaaccatagcgactacaatatagcatagacacgcagggagatgatagcggcgagaccatggactcgtagcggcttagagatatattggttggggaggaacgcccataatcagagccccggagatataggcttcggatgaacttcgttaacaaatatcgtgtgttactgtgtcttcatctgacgtgtcttgggtggtcaatggctgaagcaatttagaaggttagtcattgttccgctataacgactaaattttgtaacagcagcatggttcgattcttctggtaaaaaatcgattttgccttcaccaagtagatgctccagggattctctctacgacgtcaagtacaagtgttgtactgtttcatattggtcgagtgttgtagcaggaggcatacaacattctcctattcaaccgaaatactctcattcacttaccaaagaggcttttactcacagcaaatacttctcggcctaatgtgacaggaaaatactaaaagactgacgcacgcggtaagaagaccagtctagaaaggagtattttagactaccacaagagaaaaataccattcaactaggtagatgaagcctgaagttaaggtcgttgagagagtaatattccccaagaatatatagtggggagcattccaaccacccccaaagctagcacaaggtgtttcgagggaccacacacatgtgcaaccatacccctttggatttctaactttacatgggtattgtagtatcttcctgtgtatccttggggtaggattgtaatatcacatgttccttggaaggctatataagctggtctcaatataatcagacacgagatgagagatatcagaataccataagacacatgagactccatgtcgacaaatattggaccccatgtcgacaaacctgcaagcctcgtccatccgcacactactcggcccagcctgctgctcggcaggatgtgtaagcatggcgtctagagtggcgtggctaattcgcgtgcacgcgccagcaacgttgctggcgcgcgtgccaggtggcaggattgccccctccccgcctcgtgatttttttcgctttctcacgatttttttcgttcccttttacgattttttctgattatttttttaaatctccagtacacgtgttttcaaatattttgtgttgaaagtttttaaatcttaacttaaaaattttcaaatctggacttcaaagttttcgaatctcgagttgaaagttttcaaatctgagttgaaagattttaaatctcgagttgaaagtttttcaaatctcgagatggatgttttcaaatcgagttgaaagttttcaaaatttgtcttgcaaatttatattttgagttgaaaattaagttttcaaagtttgagttcaaaattttaaaaattgacttcaaagtttaaatcttaagtcgaaagttatcaaatataatttaaaagtttccaatctgttagtaaaaaaatttcgaaaaaaaagaaaatctttttcttaattactgtcattatcttaactaaatgggttagttacagtaacacccgcggaaagctccgttagcggcgcgcacacgccagctagctttcgcgcagcccgcatggcatggatgagtgccgctgaatgtacaagtcagggcagtaattaatggactgcccagtccagtgtggctttcccgtgtgtctcgtgaggtcatgagttcacgtcttcccgaggcaacatggctaattttacaaacagggaaactttattaggtgaaccaggaaaaaactgttttttgtaaataatttttacgatatgtagctgatgattagtccactgtggcatgaacatcggcttaatttgagccagggtgggcagctgctgttcatagtaggtccatagtttttttttctagttgttatcatagattctgaagatataatcaacacttaattattttaatgactattttttggacggcaaaatttgctacaggacatctaaaaaacgggtaattagctgggagacatcgcaagatcgcgtatttgctaaagggcaccacaaaaaaaggtaattagctgctggacacccgtgcgattattttattattttcggaggaatagtagagagaaacaatcattaaagacaagtttgccctttgctcaaatgaatccaacgtgggtcccacatgtaaatccctctctctttttgtagatggggtggcggagcggcgacacaccggagccgacgaagggtggcaggcggtggtgttgctgatcccatccgtttctccacccagacgcatcgcccaccctgactctccactccaacaccatccaaaccgaggagaggacccctgctgctctctcccatctcaaattcgccgctagctgtgaggaacacgaaggccgccattgcggacaagccatcgccatcgccaactctttcctattctatattcccctcaccatgctgagaatatttctttttgacgccactctatttcatccattgcaatgacaggaacgctgtcgtgtcatcgccgactctagagcgagcaccgagtgccaccgccgcatctctgtcattgcgccggccaccgtggacaaaccaagccaagccaccgcgccagcatattctcctcggcatcctcttcagaagcccccaagaatccccgagaaccgagcgtcgagcagggagaacggacgttttcttcccaagcaccgaccaccgtctccatctcagattccgtcgcctccgatgagccaagtttcaattcctcgcatgaatagcttcttagggacctctctaaccctttggggagatttaaccgtcgctgttttccagagatgaagcgccgccgccaagctactacacgtgctgctgctggatagggatttcaggtatggggtgaacaacgagtgccctgccaggctgccaccaccaccgtcgttgcttcccagcgccgcttggccgccgctgcaaccagccgaagccgtcgtcgttgccagaagaaggcaagaggaaaggaaggagtagagaatgatagagaaaactgaaaaaaaaatcatacttactcatgtgttcgaagggtagaatcgtacttacatatgtgtttctctctctaattccttcggatataataaaataatcccacgagtgtccagtagctaattaccagctttttacggtgccctatagcagatacgcgttcctgcgatgtctcctagctaattacgtgtttttttgaatgtcctatagcaaattttgccttttttgacaaccctgaatgatggttaaaaatggtctgtggctttctattcctgcagcgctgttaattttttattagaaacacagtacaaacacatgcgcacacgatgcgcgattgcactaattctgaaatgttagttttatttcataaacagctgtactactacttatttgacatatattgccaatatcacttcactataaaaatatttatacaccggaccatatgatttactgcctccgtgtctatatatttgatgccgttgacttttttaaacatgtttaactattcgtcttattcaaaaacttctgtgaaatatgtaaaactatatgtatacataaaagtatatttaacaatgaatcaaatgaaaagaaaagaattaataattacttaaactagccgtcaacccgtgcgttgcacgggctattgttattaatattaacacatatcaaaatatattaattatatgttgagtacattagttattaaatttaattgaaagttatatgtaaactttttgttgaagtatccgttgtaatttttcataacacaataattctaaaattcagaatgaataaatagaacaaagtagaatttgtatggagcagaaattaataaatatataagagtcatacttagagtggatttatggatgaaatattttttttcgtcataaaataattcaaaaatccagagttgacaaataaaagcaccctacatggcaatacaatttaaatttctcatgatttgatatttcgagacacataattcataaacatgtcaaattgtaataaaaatctctaaattctgaattttaacatttcctctaatttctaaattttaatatccattatttaataacatggaaatttaaatttagaattagctaatcgttgttcttttctaagctgagtttataatttgctgtcgcctagatagatgaagtatttaaattaaaaatgttattttttggcatttagtcgaaaatggaaatttagctcactataagaaagtactatatctctttcaaagctctgctgctccaggaatatcagatgaatataataaggactgtacacataatcttttcaatcaattataatgcatactggttataaaatccaattataaattttatgatttcataattatgaaaataatgaataatacattggagttgtacttggtttggagttcacataatttacaacttgctaagtatgcatttaaaacattgcaattaaattaacaaatttatatcccatgctacttttcatgtcatattttaatttacatgaatcataatagatcgaagatcatagtaatgcgatccacctaatcaacggtggtaagtaagatctttttgtctaatgtgcgagcatcctcgaagtgtccaattaatattggttttcatacaaattcttgattgatcaaagggcattggtaatacgatcgacctaataaactaccagatctttagatagttatcgttatagtaaacatgagagctctctcggaatgcctataaatatgaacattatttgtgaggggaatatttataccgacctcttttgttaataattatcatgtcggttacgatttatgccataacaaagtctgattatcctgaccttgactttggacgcttccttcgcatcatcaacagcttgaacaatgtcatatgctactgtagttttggtagaagaaaaggtaagctgcagactacatgcagtgcatacgaacgtacataccgacaggaaatatggaaaattaaatattatttgctagtttatatttagagaaaaaacatagataagggttctgtgatctgtcgactgacctggttaccggattattagcacggctcatcaataggttaagatcaacagctgtgtcattatttcagtcaaaatcagtaatcgataattagttcttaaacagattgcaacatgtatattcaacgaataccgtacagctcgctgggaaacgatgctcagtaattcattactcaaaagtccaaacaaatcaaaaatcaattaatttgactgtatacttagcaaggtttgattatttgtttaacatgcaagtttgactgtaccagcgtgaattggggagcggtgcagatgtgctcgatttttcgatcggcatctggacttctcaaatttattgggttggatgatgatgtttcagatgagtctgaatcaaaatcaataaaaaaccaatctgtcaaagattgaggtaaaatagtagctgagttagagaggttttgagattcaaaattgtcacaaatcgtgcggagtatctcgtggtcgctggagtcctctctcccacatctctgtcgttaattgctatcggagagatgagatcgatatgtatctccctagattactgccgatcagtgagtggtagagaaaaaatagatgggctgaaagagcccatgaagatagaaggcaaattatagcccaccacgttagatttgtacgtacggccatgatattaaaattaatttaatcaacggtgatttctccagttaacgtggaagcttgtagaaagtgcctaattagtagaggtatagatttttttgaataagacgaatgatcaaacatgtttaaaaaaattaacagcgtcaaatatttagggacggagggagtataatctagcaacaagattggactacaattaactccaaagcgtccaaggccaccatgtgaacacttctttttcgctggactggtggatggacgctggtcaatttttgttgagcataaaagagggcaaccaagcagttttacaccaacggggttattagggagcaccgcagcacagcacttgagcaacgttggaggcttggagcacccaaggaacagctactgcaacagctggaaacactgcaaacagcgaactacagatacatcttggttatcaactcctgaagaaaaggcaatgtgtaaagccacagcagaaattccaagtgcctcacattcctgacaagaatttctcatggttaactgatacgatttcctctcctctcctctcccattcttacactacttaaaaagccattctttgtgacaccactcttttattttctagcggttttattaaacacacgcttgtaaaaatatattgggggtattttggtcacgaatcactagtgaaaatcgacatcacttcataggcccgcttgtaaagatagggttacttttacaagcgggtggcttaaatgacagccagcaaaaatcttatttgtgctgacggctgattaagagcaccgcttgaaaaaaaatattatggtattaaaagagagactccgaggcgcatctcttttttttttgtcctgtcaccactcccccttttacctctcattcctccctctctctttctactccctccagtgggccacgaccacggcagccgccgagtgctctcagcgatggccaagacggcgacgaccacgcagtgtgcgggcagcagcaaggttggtgggtggtgcacaggcaatgccgaggctggtcagtggcagatccggtggtgggaggcacatgggcagtgggtccagcgataaagaggattgcgggcagcggatctggcggcgggaagggccgaggctggtgaacagcggatccgtctgtgggaggagagtggtgtgggcggtggcaaggttggtgggtagcagatctggctgcaggaggcgcatgggcagcagatcttgtgacgaagaggcttgtgggtggcgggaaggcttgaaggcgtggattcggcagcccagtggagcacggataatggccaagaggccaaaacagggttacgggcacggtggggtgtcctagagggggttcaggtccaccgccagccagccacggcctccctcgccgaatctatccttcctcatccctccctcgatgacggcaaattggctccattcctcaccgacagcaacttggtgatagcataggccaccaacgacgcgtgcgaggactgtaattggggatttggaacaatgatttgcgatttgggaatttgtgattttctgtcggctgttttggacctggatttttatttttcttctccaaaaagtattttttgtggcgggtctcttaacattgccgccaactaaaatcgattttcgttggtagacatcctagcttggccacaagtgaaaattgatttttgccggcagccgactgcccatcactatagggttgaaactggtacatatagtttcggtctatccggactatttttcggattcggataggttcggttggaattatccagaaattctcgggttcggaaatgaatttggatttttcttggaaacaaaaacgaatatagtaagggtactatccgtctgaatcagaaaatggtcggatttcgcatacatggattaaattttagacacaacacgtatatacacattactttttcatacaaagtcagatgaagtcaaactttatattaaaattgtagtgctcgatgagatctacaacattcttgttgactatgttattatttgagatcatttaagggtctaaataccatatatgtttttacaaagtctcagatatacaattcaaatgacatttgatggagatgtgttccatatcaaagttgtagagctaaatgggatcttccgctttgtagtttataatatttgtatttgaaaatatttaaagtataaaacaaactctacaagtttcgaagatgtgaaataaaataaataatatatccaatttatacagcaagaacttgataagtgatatgataagtaagctatacatgtagtaaaagattttgggattattcatatttacatgtcggtctcttggaggaacgtgcatgaaaatcgattttcacatatggttgtgggaccacctacaatatcgaggatataaatattggagacgttgatcaaaaaaaataagcgatatctcttccttgattaaggaaactcaatttgaggggatttttatataccaataaatattcgttgccgtagtcgttccgtatctatattcgataatattcgattcgattttatttctgtatccgggttttagattccaattttgatcccagaaaaatgaaaacaaatatgataaagctagtttccacctgtttccaatctattttcatccctgcccaccagcacaaatgtattattttcattggccttatgtcgctggaggactgccagcgaaaatctattttgtccttcagcgaaaattattttgtaagtactgacagtcgttttatagtgttttaaacggtccatactattgattcatatgaagtatcttattaatgctgatcttatatcaccaaccatcccattgttcctttccgtattgtaaacatcttcaaccaattaattagcataagtgaattattttttgtggtttaccctgaaaggggttaataagcctcagtcagtttacctaaaaaaattgctggataccatggatgagcctggtacaaatgatattaagaagaaattaatatgaccatgatctagagtcgagcacgggcagagtggtaacaacagcccatgattcatctgcgctatcatagttttattatcagccaatttacatcgatttgaagtcttttttataataaactacaacacttctacatggtcagattgaagtaattatcgacaagaatgagatttgctccggtctttaaaaaaaaaatacctcaaggttacggtacctcacggtaccaaattatttccgatcgattggaactaaaatacccatacccatcctggaacggagcaaatcttgacaagaatatttgaacggcatgatttgatttgatttatgttcgaggcattgcctcgatcgggagcacatacttggatgggtgacgtttctggtctttccccttgaaggactgcgtcctcatctcgctttgaagtgaagacattagccagagcagagaatggaagacaggtcaacatcactaacacctaacaaatcatgtcagttaaccttcaattgtaaacaatggctaacttgctgttagcgtcatggaacaattgatattcctgctgtctctcactccgatggacaacaataatgtcctctgcaaccgaagcaagttctcttccctgtcctcacccatttacattcaaacaggctgatttgctgtgcagctcaagttcaatttggcgtgctgacacgcgcgttacttatatacgcaatatgtacggaactcagttataaacagtaccatccacccatggagtgattctccaagggaattcatatcaagcaatgcacacatttcgggagatagctctttcatgtcagtattaagaaatcactcccataatctgtcctgataataatgacatttttcgactcccataacttcttgcaatatgttcaaagacatagtacatctcaacattttttttttttacgaaagagccaaaatctgttgatacaacttaaagagatgaacccaaactgcattcttacacatagacgtagactcaacaatcaatccaacaacaggaatagcacaaatcaaatctaaacaaaacaataatttcactacaacgcaaagaatctattatatactaaaagtccattaagcttcctcaaaacgctctcaagccgctacgtggcgctctaataaattagagaaaattctaaaaaatatgagaaaaaagtaaaacatctatcactcgattttcactgaaatcggtgggtccaatgttataaaccgttagattaggtttatctcaagactactcctctgttccgttctatatataggtacgtattgccggcctccatccttgtgttgatccgatccatatagttacggtactgcttgcatgcgttccgttaaaggagtgtacgtacataaactttcttttttttttccaggtacgtacgttactattctttctttttttttcaggcatataattgagataataataataataataataataataataataataattattagtgataataaattttgaataaaaatactttataaatatagaatatacagcatataaatctcttcaagtagacataaataaattagctctacaatgtttgaaaacaaagttccacaattatgttatattatgtacccattattttaggttattttgtaacaaaaacatttgtccatcgatattcacttaaatcggtcctaagttgccacgtggcaccactacaaacaaaactaagctaccacgtggcgctctcataaataataaaaaaatttaaaaaagcaaaatatcggaccttaaaatattcacttaaattagtgtgcctgataattttaggtaagtccgtacttatgaacgtacgaaaccgctcaccctgatcacgtccgtatttctcttctttcccttttataatttctgaggataattgaaataacattaattattagaataaaacaattataactttgcaaacgtagactgcatcgtcataaacgtctataatgtttgaagaaagtttactgtattatattctttacacatctatctatatattatatactgaaaatccattaaacatctgttatatactaaaagttcatttaactccctataaatgctctcaaactgtcacgtgacattttacaaatattcttaagatgccacgtgacgatctaataaattagaaaaaaaatcctaaaagttttgataaaaaagaaaaaaatataaccattgatattcctttaaataggtggacccactaattttaaccattagatctctaaaaagatacagtatccccaactccaccgtataggggcacacacgtaagtacgtagtccctcaaccctccaactctcctcggagatcccactctcctctcctattttcgagccaacatttcctattttctaactaacacataatatatatatagatgataataatcagatagttaaatgatcatgactctcaaagttacatgcacttttctcaatttatttgcattttatcatgctatttatagttaaatacataattcaaaatccatttacccatatttcctatataaaatttagataatgtagttctttctgactacaaatatttgagtctaaattccagattcaatcagcaccaaagagcttggaaccatgatgcataccctggggcctgaacttaatggaggcggagttgcaagatattattaggttgtattcattagatgggtttgggagctaatctctcttacacacataaaacaaagcggctcattacattagagtattattaattaaggattagttattttttataaaatggattaatatattttttaaagcaatttttctatagcaaacttttagaaaaaacaccgtttagttgtttggaaagtgtgcgcacgaaaaacgagggagctaagtttggaaaggagggggaagaatacaaccttagcgaggtggacaccgatggaaacaccaacatcgactttccatgacttccagaagctcatagcacgctagatgattatatcaaggacaaagaactgagatgaggtggctagatgattatatcaaggacaaagaactgagatgaggtgcagagggagatgttccgcatcttcgacaaggactagaaaacaacttcatatctatcgctgaggagttcataattaaattcagaaaaaaaacaatttgattaaaatgcacattcaaaaatttagaaaacccattaaaactatacaaaatgtataataaaataactattaaaagatgagtccctatacaacacgatacgagattaagtacaatttaaaatccttaaaaagaaaatctagaataaaacaataatttgatttgaaaacaaattcgaaattagattcactcaatcactaaattcaaaatataacaaatattttttaaagaacttatcactattgattcagatggataaagaattgcgtatatatgaatcaattagaggattgacagggtggtaaaaaaacatttattgcccatagaagtttatcgagatttctcaaaaaagagatacaatgaacacccagttaaatatagaaaacacattactttaatttcagtttattttattataactatttttagaataaactaacatgcatgcccgcgtgaatgcgcgggctgtcatcctagtttaccaaatatgttagatgggtccatcacgcattgttttacgggccggtgtgccgcatatcaatcaaaacatggaagacgcagcagtcagctatacaacgttacaatggctgtgttctctccgaatagatcatacgagtctatctgcttgagctgtaccattaccagctccatgcagggtagttgatgccttgaaccagtccttacaaaataacaatattaactgacagcccggcagctttcatctaaaatattttaaatttcgctaaagctgtctgtcagcatggttaaaaaagaactgtagtttttaccccgactccaaaaatcctattgctgaggaaaacaaaacgttcccacagtacagcgatagaacagaacagaggtaattcctagtgcttcccatttccaagatccacaactatttgagaccagctgtgcagttacagacggggcatttgtaattccaagaatttcacaataaaactaccatctggtctttctcctggatgaatatttctcgaaaaggaaccgatgcctgctatttatgcaaatagctcggtcataaaccacacaccaacctgccataaacttagaccttgctgaatatttcaaagagattaaacacacaaaaatttgggaggatcacgtttgattgttttatttatatatttattatagtttttgaaacaatacacgcaagatagtgcgacgtttcgtattagtagagcagaaaaaaaatacaagattatagctctgaaagacaatagctaggaaaaaagactacaccacgtgtctacaaccagagacgcgctacgaaagagacatgaacatgacatctcgaagaaaaagaatcttctaaataacgccttcaggaagggaacaacaccgagggtgccaccgctgccggtcctggaattcaggacgtggttttcacctagtggaatccatcacggcacatgagagatcactcaacaatgcccaagtggaaatcggcgcacataggaatcaacgtttctggcttatgcccgtaatcttcctgtactcctgtgtctaggtctcctacttgatatagaagccaccatcagctgcattccttcgattcgcagccaccataccggcgccttaccgctctccccgccgtccttctatcgccgtcaggcttaccaagctctgcatcacactggcctctgccgaccacgacttccttccatcgtctaccacatctgtcagcctctcgttggccatcccgtagcatggacacgtcgactccctactcgatccatgcaccgtcgtcatagctgactgctcactgcaatcgctgcctcagctaccaccaccctcccgtccacttctgccaccccgccgctatgactgccagaaccgtcctatttccgtcgatgctgctagcaccgtcgtcctatagccatcactcccaactcccgcagcaggtatcgacctcctaatgccgacggcgtcacccgccgtgtgccaaccgtcggacgtcgtccgcggggcacaaccgctcctgcgacgtctcgcgtcgcccgccacgacggagtcacctcctcccactgccgccgcgccaggtactcgaccccagccaaatccgggtgaggatgccagctctggctcaagggaactagatccagtcggagtggcaccagatccgccgccaccatgttggagctcgctggtgaattcccaagctccacgtcgcccccgcccttgtgctggagacagacggtcatcggtttttggccctaggttgccgcccagttttccaggaagcaagctccagcggtagcaaggcggggatgagggtgggggtggtggtggcgggcgtctagggtttctccccgagccacccgagcatgggcgacgtggagcaggtctatttttattatagttggaccatattgtttccaccaataataattaaaatgaactagaaagatagcccgcgcacatgcgcgggcacattatataatgcgactgaaattttattatgaatatttatgtgtggctgactatatattaaaatattttttcctatattctaaaccaaaattaagcttatttagtgtgctttgaatgttcgttattttcttacaattacacttgcaacatataaattctaaaataaaattacttgagatcatgcagtgttgaaattatcagaaaacattatgtcaaaataatggaggtggttactatgagaaaatttagggtattttgactccccagaaggatacctcacaacccaaaataaatctaacaatatcattttttgtttgattttattttaagttttatatattttcattctatctgtcctcataaaatgtttattttttctatttagaatgggttttaaatccagcaatatcttttcagttttcaatttatttcatgtcctatttttttttggagatttccattctatgaatcatccttaaaacgctttgatctttgcaatctagggtgaaaatataaatgcatttattgcatgggtaaaggcatatgttctaaattttaatggtcatagtattttttgtgaattatcactaaattgaagtgtcttataacaaatacacgtttctagattacacgtttctagattgttctacatcaggactcaggatttaaaatgttagcatgttttaccaaaaaaataaaaaaatggacattgtctttaattcctatatggaattgacttgatatatatctaaggccacctcaaggttgtatcattgctaagattcctaggtgcaatcgacatgcttatcagtatgatctttaaccgaccacacctttattttcaacttgttgtttataatgctagatgagtacagttatgattaaaaaattgtgtcacttaaatttttttctctaatttattagtgcctttgtagatcatatgtgtaatttggatgctatgatcatcattattaagaacatttatttatctccaaaaaagattgttttaaaagtatcaaggtcaatttgtataagtacatagcccaatatgtatgttaagaaaaattaattaagtcagtagaaagtcgttatatgtctaacgggatataagtaatagatggatccatctatgtttttttttgcccatatagataattaaatttgaattgttaaggagataaacaaaacaaagagaaagaatggtgcatgccatacatgggcaaggagagagggaggcttgtgatgtttttctaaatgattaatctaaccacctaaaatgatgcattggatgtttaagtcaaaaatcaatggtcggatgttttgttttcttgtcaaattttttaggattttatctgctctacgagagcgacgtaacatcttaaaagggtttataggtagacttttaacaccgcatgccgcaacggagtaggagggatgcaaggaggtttgtggtattttaaaaaaaatagatctaatgacccaaaataatgtgtcaatcgattgaaaataatgtttccatagatttaaatcacaaccaatggttggattattttttttcaaaaattctaagaactctctgatttaagaatatcatatagtatcttagaagcatttataagatgtttaatggatttgattgccgcataggggtggggagaggatagaggtttgtgtttttctatttaataatactaacaatccaaaataatgtatccgtcaattaagtagaaattgatagtcggacacttcgttttttttaagattttatagtattttgtctaattcaatagcaccacgtagcggtttaaaagtgtttctagaatatttaaagttactgagggagagttaatagacctagtaggtgaaggtctatttgtgcgtttttttctgtaaaaatgattttggttttaattaatttctcatgaagaaaaaaaaaccgtatagaggaaggaacgggagagggaagtacgtacgtacattacataggtacgttctttgtttgtaaaaaggggaggttccggatgtggtttttattaccaaatagatctaatgatataaaataatgggtccatcaatttaaatgtaaatcaatggtcggatttctcttatttattagaatgccacttggcgactcgagagtgtttataggataccacttgacaacttgagagcgtttataggaagtttaatggacttttagtatataatagatagattaccaacatatatttttctcaatatgactttgacatctccacgatgacacatattgtacaaagttgcaaggcacaacgctatgacaactcaagcttgaattttcttaaatgcatgagaagcgtccacgatgaacctaaatatgtacaactaatgtggtgattgaatctcatgaagataaagattaagtatattatgcaaatcgaggtagtaataacgtgtgattaattgagtttatattattacaaacttaaaaaatggattaatctgatattttagaacaattttcatatagaaatttttcgtacgaaagacaccgtgttcccagtaatagcaaaagtttatccaacttttgttggagattcgaaaagggcctaagttcccggcaatagcatatcacggttatcttcgttgtgtgagttgtgtcagcacattcttctcacaacacatggaccagcgtcttcattatgaatggctcagagcttgcaactcaagctttcgcgcgccccttgcacagttgcatattcacagtggcaaatctcaattcaagctatcatgttctgaaattcctaatgcccccattcgaacaagttcccagtgtcatctgcacatcagaagcaatttgtcattgggagctcctcagatatttcactccaagctagtcttacaagacaacatgtgactgatttcaactgcaccgctgcacacactgttcatacacaatgcttacttttctgaagggtaccaagccaagcagatattataagctatctagtaagtttatcatttttattgaacacatctcgaccaccagcgtgtgttttgctgttgatgacctaccatggcatacatataccagttaatttatatattcattttaatgttttttttaacattcattttaatgttggtgatacggtagcactgtactgcgtaatagcacctgatcaggttatcttactacggtgacaacaagtgttgtactttttaatattgaccaacgccggattagttcaaacacagaaacaatcaggaaagccagcagccacacatcttcaacatgacattccctgtggcatggcccactagtgcagatctggtcatctgtgttaggggaaccttcatttgtgtcggcgaacggtttggtcatggattattggtcaatgatatgaaaactcatatgtgttaggccgggagccaccaccgattgcggtcatctttgtcaggcccaaataaaagaccatcgctaatgactctcatctgtgacgggtggtagttatgatccatcacggataagagtcatccgtgacggtttgtaattacaaacattcatggatgagaatttactttttttgaattttaaatgcatcaaaaaaccttaaaaatattcaaaatattattatgatattccaagtttccaaccatgctcacacatcactagctagaaattcatgaactttcaagtgatatgtgtatgcatatgatacgtgcgattcaaacctaaaacctttgaacacatgcaaatcaatcttactatctcacatatagatcacaggacaatcggtcatcagatattattcttttaacttttcctctccaaatataaaacacaaatttgaaactccagatttttcatatgagaacgtaactacaaagttgcagatctcatcgatttctacaactttagtgtagggtatatctctatgcagggttgtttgagaaattcagaaatattttagaattagatcacatcacatataacacatattcgggtatttcaaatttttgattttttttctcatccgtgacggttcgtaactaccacccttcacggataacgttatccgtgaagggtggtaattaagacccgtcacggcttagtgctatcatctttgacgggtcatctcattacatccgtcacaagtgatttgttagctttgacggggtattgttgtgaccctttatagtttatctgtgacgtgttagaactacgacccgataaagatgaacttatatcggtaatgggtcattcccggtagttatattttaaaagggaaacttattgagccattagagatgagtcatccgagcgagtttgctacatctcagagcaagatgtgggagtctgggtgcagccggcttgccccgccagcccgctgtgcttgcccctgaaccccgggtggatcatgagctcacgtggcgacttggcaaactggttgcaagttcataaaaacatgggaatctaggagaactaggaaaaatattatgacatgtgtctgatcaggaatctactgtaacttcaacaccgacttcaagtaggtggcagcggttgttcatggttagggcctcggtttttttctgatgggtattgtatatatgtatggcgaagatataattaatcaatgtttaattattgactgtttcgggaacaatcctgtgtgatggttaagaatggtaattcctccgtttcatattataagactttctagcattgtccatattcatattgatgttaataaatctagccacatatatatgtctagattaattaacatacatatgaatgtgggcaatgctagaaagtcttataatatgaaacagatggagtatgtaggtttctttttcggtggcaacgttaattttgatagcactattctaaaattttagtcctctttgaatcgataagcaatgagaaaaaataaacatgaatagtgtaacagtgcccccctgccaacttgcgcaagttgaaagagggagattttatatttgaaagcacatgctaattaccaacatgatgaatcaaatcagcaacggaacttggctgtcactatgtttattattcaaatcggaacatgcatttcttcatggacaagccaaaaaaaaaaatcttactatcagcctgcaactaattaatcctcttcgtatagtcgaacaacttgggtcttaggtccagcggctcaaagctttcgcgtctttaaaccgcttgcattcatagcgccaaaaacgattcaaatcctgccattagaatttctaatgcccctcattccaacaagctgccagcatcatcatctgcgcagcacacccaattgctcactggtatcccccttcaatctttattcctagctactgttacaagaaaaaagatttgactgactccaaaagcactagctagccgctgcacacacgcgatggccgacgcacactggggtttgtttttttacttatacatagtaccaagcaagcagacacttaataactctcattgttcttgaacacatctcaaccaccagacagctgtttttgctacggagggcctaccatggtataacaattagcatagtagcaccatacatactgcgtgaagattgtgttacatatctcaatataaaaaacaagtgtaactaactaatgtgaaacatgagaacaacttctcacagccacagtgtaatcagagaaccggcccaaacaagctgtgtaggatcgaaacacaagaactaagccatcaagagagaggtaaatggttggtatagctaaaaacccaaactttcagcggaaataaaagttaccctcaaattcgatggatcgcggtctgaccgaaagtgtcgcgtcggtctgaccgtctggaagccgtcgttctgaccggaattgatcgctcggtccaaccacctaaagatcgcctctgcctcctgtcatcctcgtaggtctgaccgcaggtctgccactggtctgaccgccgcctagccgccggtctgaccatcggtgagttgccggttagaccgccgaacccgacgaaacacaaatcgaagaactctcaaagtagatgataactttattacttctctctatgtttacaaagtataacaacatcactccctataaaaatctcgactaaactagaaaccataactaaactatcaactcaatttctcttaaaagcgataccgcgaagcctcacgctccctctctatttatatatgaggtaggcagcctaaagccacgaaccaaactcatactagaagtcctaatccacctaggaaaccttcccgtacaagaaacaaactttacaaactccgatcataccaaatttggactccttccaaattcgaatccgcatcccatacgcacataatacctccatcgtataccatatggaatcttcaccaaccacgtgcactgaactctacccttagtatcccgcatgatatctgaccgtcacggacatcgtcttatctccaagctgactcccgatccatcaccggcagtactctcccgaggcatgaagtcacctacacatgaatcaaacaaataaactatattccgagaccaagctatctccaacttgactcattagtagcaaacaacagtattacatacacatagtatccatctagaagctataaatataaaacaatcatagatatccaaacaaacaacccgaaaccgaaactgacacagaatcggccggtcagacctcgggctgggccggtttgactgcgcgatacacgccggtctgaccggcagcacatgcccggtctgactggaccaaatcaacagcagtagttcctattcacctgcaaattccaatcatctctaaaaccacttcgtaaataaattccaaatatcaaaaccaataatcttatatgccaattgttcatcacagaataataatccaaaacacctttggttttacaacaagctgaggcatgaacatgtagctgagtacttagctggtttcaacaccggccacttgtccatggtggatgtgtcaatgagggcgactttatatgaatttcttaattcttcagtgatggtctcatgtaaaaataaataaatttctacataattgatttttggaatattttttgacgaaaagaaataagcataattagattgtgcaaaatttttatatttcgtttctatgagaatgtatttagctagtgattgatgaaattcttcatcctttgaataaaaatgtgaaaattagggaacatctaagtacaatcccagaagaagtctatgaaaccacccaaccagacctaaaactgcaatcacagaacgattggacttattttttttaactagttatgatgttttgactatgcatcattttcagacggtgtatgtatgaatagatttcaagttaaaaggggctaagagcataatgttttcttctaagagactaagaacccatttcaagaccactgtttccatcgttccagagttgatggtgccaacccaacaaccccataaaaatagagggtgaatggactcctatccaaggcctaggtttgctagtacattgataaacgtgaagacatatttctgtcatttgaaataagagaacctcgttgtgaaatcaaagtgtgttttgattattatttatgataaataattggtatttgagataactgcttttgttatttgaagattattggcgatgtgctttttggatcggtcagactggcaaatattgtgaatagtttctgacgatgaactgggattttgtctggtggttgcagtcagaatattttagaataccatgaaaatccgtatcatgaatatttctgaccactgattgtatatgcttcaagtatgtctgtacgagcaaatataaaagcagaaatgttgttgttactcatgtgattcagccttttagtcctcttggaatcaataaaagcaaatagaaaaataaagatgaatagtgtgacagtgcccctgccaacttgccaagctgacgagtgacggagggagattttgtatttgaaaccacaggctgaatacaaccatgatgaatcaaaacaagcaactgaacttggctgtcaatatgtttattcaaatcggaatgtgcatttcttcatagacgagctgtaaaaaataaggcatcttattttcagcctgcaaataatcttgctcgtatggtcggagaacttgggtcttaggtccagcggctcaaaggtttcacgtctttagaacccttgcattcatggcgccaagtctaagcgcaatgtatcaaggtctatctttgagtaaccaaactaaagcttcaggtgctgcaattagaattcctaatgcccctcattccaacaagatgccaacatcatcatctgcgcaacacaagcaattgctcactggtatctcccttcaatctttattcctagcaacttctacaagaaaaacatgtgactgactccaagagcactagctagctgctgcacacactgtccatgcacaatggggtttcttttttgactcgtacatagtaccaagcaagcagacacttaataactctctcattgttcttgaacacatctcaaccaccagacagctgttttgctacggagggcctaccatggtgtacatttttttagagaatagtatttttttatccggcctctacatacaaccagatatatacagtcctttaaaatttagcccctcaaataacccaatttgaaattcgctcctatggagatttgaactcacacacaagttgtgctctatatagtcattttgccgttggtataacaattagcacagtagcaccacactacatcatggcacctgagattatgttagatttctcaatatcaaaaacaagtgcaacatgagcacaacttctcacagccacagtgtaatcagagcacaggcccaaacaagctgaggcatgaacatgtagcagagtacctagctgctttcaacaccggccacttgtccatgatggttgtgtcaatgagggcgattttatatgaatttattaggtcttcagtgatggtctcatataaaaataaataaatttgtacatagtacattgtacgaatattttcatcgacgaaaagaaatataattagattatgcaatatttttatatttcgtttcaaagagcatgtatttagctagtgattgacgaaaattcttcatccttttgaaaataatgtgcaaactagggatagggaacacctaagtacaatccctgatgaagtctatgaaaccacccaagcaattcttctaacagactaagaatcggtttcaagactattttatcaatcgttacataagaagttgatggtgccaagataacaaccccataaaaatggatggtgtaatggactcatgtccaagtcctacgtttgctagtactttgattaacgtgatgacaccttttcgtcagttgaaacaagagatcgcatgtgtatgatcagttgaaacgtagagaaccttgttttttttttcttttagaggcatgcaagtagcatcaaatgtgttgaacgaattatggcaacagttcagaagttcatacggtttcccattcggatgagccacggtcatcttgcatctgctctacaaaatgctcaccattgtcaatactaaagttctacaagaaaacacatggttgtgagatttttttaataaaaagatgccattgcatggctagcgaaatccacacggctaaatctatctccatgatagtttattgctacaaatagggctcatgtcacttgtgaatgggtagtgtcaagattgcaatgagcacattgcataatgtttctatacatgcattaataaagagaaacccgtgacatnnnnnnnnnnnnnnnnnnnnnnnnnnnnnnnnnnnnnnnnnnnnnnnnnnnnnnnnnnnn

SEQ ID NO: 27478 - DNA, 695 bp, Oryza sativa
  unsure (1)..(695): unsure at all n locations
ctccatctcagattccgtcgcctccgatgagccaagtttcaattcctcgcatgaatagcttcttagggacctctctaaccctttggggagatttaaccgtcgctgttttccagagatgaagcgccgccgccaagctactacacgtgctgctgctggatagggatttcaggtatggggtgaacaacgagtgccctgccaggctgccaccaccaccgtcgttgcttcccagcgccgcttggccgccgctgcaaccagccgaagccgtcgtcgttgccagaagaaggcaagaggaaaggaaggagtagagaatgatagagaaaactgaaaaaaaaatcatacttactcatgtgttcgaagggtagaatcgtacttacatatgtgtttctctctctaattccttcggatataataaaataatcccacgagtgtccagtagctaattaccagctttttacggtgccctatagcagatacgcgttcctgcgatgtctcctagctaattacgtgtttttttgaatgtcctatagcaaattttgccttttttgacaaccctgaatgatggttaaaaatggtctgtggctttctattcctgcagcgctgttaattttttattagaaacacagtacaaacacatgcgcacacgatgcgcgattgcactannnnnnnnnnnnnnnnnnnnnnnnnnnnnnnnnnnn

SEQ ID NO: 27479 - DNA, 738 bp, Oryza sativa
  unsure (1)..(738): unsure at all n locations
nnnnnnnnnnnnnnnnnnnnnnnnnnnnnnnnnnnnnnnnnnnnnnnnnnnnnnnnnnnacgggtaagggtgagattggagcttcggccgagaccgtgcaaagtatgtggtatggtatgcggcgccccctttcaaccgatgctcctcccgaaacctacattattcctgcgaatgaagtttgctacttgtgcgcctattattattttgccgcgcttcgcctcctgcgattggtggttatatattttcttttcccgggccgaacggaacagtattggactttcccttcgtggggtttttactgtgccgctcggttggtgggaatttaccgtttcgcctaccattgcgacacgtggcgctttattactggtgggtaggcgaacggtcgcccgggtgagctatatattcccactgctctttccttttcaccgccacacttgccattttaccgtgtgcgctcttttcctccgtttctttcttacacagcatctttcgacccctcaagcatttcgcccattccacgcaccattcgccatggcccctagcaagccaaacccttgttcggcgaaagggccggatccccaccgagtcgatgatgacagcaccggcctttttgggggtctctcttgtggacgacgtccagctggcgaagcttgtcaacttttggggcgttggtccaagggcaagcttttcccccagggaaaaccgtggtgccgaaacctatcgaccatcggacggtgg

SEQ ID NO: 27480 - DNA, 577 bp, Oryza sativa
atttaataaaaattaaatccatccatgctttatatttaggaaattttatttcccacatttaacttcacatgaaaattaaagaacatttaatataaattctaataataatttattaaataatttataaatcctgaaacaaaaatcaggatgtgacatccccccttcgacagaaggatttggaaggggcgaaggccctagttgcattctcctcgggcaaggcggcgaaaggaggtccggtgcaagggccgaacgtggccgacgtggcgaaagcggctgcggctgcaagggcactccaaattagggcggagatcctttcgacaagccaactggtggtgccccaagccactccatcgcatgcggcagcagccccaactgcgctcgccggtgtgcaggcccaagttagccctgaccccgaaacacaagccgaagccgacatggaagccatgcgacagaacatgacatggctccaagacatgcttcggcaaatgcaagaacaaccaccagcatacgaggcggcaagggggaccaaaggcacgtcggcttcaatcttcagtattccgcaggttatgtcacacct

SEQ ID NO: 27481 - DNA, 8297 bp, Oryza sativa
tagaatactcaagctttgatatcattgttgacgcaaaaaacacacactggcctgagagatttgctttactctagtgtagatccaaagattcgctttcgggttcagagcgtgccagttggtttgatcctgcaactaataagaaacagagaatccaaagttaaatccataaacgataaccgatcggctagattgctgatgatgtatcgtctaaatcaagccgatgcaatctgatctagatcatcaatggagtatataacgaataaaggactaaatttaatttatcggctatagatatcaataatatataatctatacttcaaaatatatttaaaccaagtgattgggatagatcggattgctcccgagacagtataaattacttatgtctaaaagtacccccaaagtaaagattatataagctcatgtcatagcaagtagttaaatctagcgtgtatcggctattgctctgatacttctttatactaattaagatatcattgtggattaaatatattaaacaataatcaatctattgttagtttaatctaagcagattgatatcaatcttaacatattttaccttattgagatcttgatataaagggcaaatttagcataccaagtagataaattaagaacgagatagctaaaccaggtaagatcagctgaaactctgatactatctctattgattatcatgaagcaagctagagattatggatctagatgttacttaataggtcaaactcaactgatgcggcattaagcataaggagaaacataatatctaataaacatgccaatgaaaacctttttgagatggtagatatgctatacaatctaactcgacgaacttatataattctatcgggtgatctcgatgttgaaaactagctgacaaaaccagataagaatattggcctagattatataacatatgtgataactcgatgatttatgtaaacaagattagggtgtcataaagatgtaagcactaatcctgagaacgcaagccgccataacaagttttatcttttctgtcggagatcgcaaccgatgcagcctaactcgaaagcaagaacttgtcgaaacaatgaaactagaaaaaagatggcgatacactgaaagtgttattgaactgattttaattgtttacaaggtatcgggtcatatttatatccaaaatacataatatgtccttatcgaacacgactccacttctattacaactctaaaatacgaacaagtcccttaggcggactcttaccaaaaatatctataaggaaactactagaatatcctaattaatagatacaattgccttcctcggactccatccacaattggcaatacttatgcaccaccttaatcgatcctgacaatgattctagaataatcttgccaaaatcggctacatcggtttctccctatctgatttggtatcagctgatgcaaacggtagctgacgcgcattctgtttctgagaataacaaacttcttccaaatctgcttcggctttgactccaaatccaatctataatttaccaaatttcgttgttaataatcatctgtaacacccattgttcaaatccgcaataattcactaaattgactattttcgcataacaatatcctatttctactttcctcctcacattatataaaagggttaacccgaaggtactatggttgaagctaaccaggtgtaaaagctggcccaaatctatctaaattatccaggtgtaaaccggagcaagtacacgcatacgggctgaactaggctatgtacgtgttggggtattacagtttttcctctatgacatagttgttacagatagttagaaatgttttctatggagagaaaaaattttagtagtgtattgtggagagactcttcattaaaaatagtgcaagctaacatgggtgtctgctgcaagagaactggtgatagtggcgctagccaagaggctgtcccaaggaaataactggcaaaattcgctacagaatactcaaaatttgtgtaatttgtttgtacaaattgtaaaaacgtgtcacaactaaaatatacttaaaaaactgataatttgttggaggacactttcagcttaattggagaaagaaattcttcaaaaaaaaagaatacccttagggtcaaaagcttttaagatgagactggagtgaaaatgaaatatgatgtacgctagtgatgtactttgggtgatggcaaatttagagttgtataacttctcaattttattttaatatatcatatttgaagcatgtggttctaagggcattctcgtcttttttaaaaatgtatctctccaattgagccaaagtgtcatttagcaaattatcagttttttaggatgtctttcagtcgtgacatatgttttcaatgtttatcagtaaattacacaaaatttaggtgtcttgcagcaaaataagtaagagaacaggaggttagtaggatggcgagttggtttcactgtaattttcatttgtcggagaattaaactgcatgaatatgtgtaccatgtaggataaaacaacttccaaatatagttttagaaggagtaaaatgcacaacatgtccttaaactcgttcaaccgtgtcattcaatagtgttattcccgtccaaaattgccctgactcggaacctcggtatagtagtccgtgacctggaacctccgtcgttgacagtgatgtgcttaaaaccaaagaaaccctttctgcatgggtagctgtgtacccttatgtatagtgcgtcccacgcaggcgtggtagggtgatgaaatgaaaaagttccccatttgactgtgtcaaaagaaataaaaaggtgtgggcatatatatatatatatatctgcactaaagaacacataaactgctggtggttcacagcagaagcaacggtgtacatcttgggcacacggtttaacgagaggatcaatgcgcacatatcttacttttggagtgttcaaatgattcacccatatttgtttatttttgtttcctcaactcaaatgatctgcatgcaagcgtgcatcatgatcaggttttatttttctccggaagaagtaagaatttttatccaacattttgttttaaattaatgccgacactttggtagttgggatacaattctttttagctcgggattactatatcacatacttcctccgtcccaaaaaaaaatcaacataaagggtagtccaaattcattgtcctagaaggggtcacgtcccctcctagattaaattttttttggaacagagggagtatatttttatagattattaagaactcgcctccgtgagaggtcttatttttatatttctaaaagatgccacatgataagaaataaagaaaattgatgattggaataacttacgcaatacattgttttacttttactgtttcataagcaataaatacaagagacaagcatgtatcttttcaaataaaaagagagacaagcatgtatgtttacaaacaaacagtacgttgtctttgaattgtgactgagatgaactccccttcatcactgttgctcctcagacgttatcggttcagatgagaactacatagaaactctgcattgatctatttatatgaagcaaacatatattacaaatgttagcgtaggatcgaacataataatcaaacctaccagagaggaaacctgtcagagaagggtgaattgtagggaacactaaaaatcaaaatctttagcggaataaaataaatcctagacaaagttgcaatatgactgttgtagttgctccggtgtaacctcctggatgtcctgcgatctgaccgccttgacgttaccagtccaaccgcctgcgtgccaccagtctgaccatcgagaactagaaaacactactgaaaagagctacaaagtagatcaactttattccatcaagacgtgtttacaaagtacatctaaagcactcctatctaaatttacaaattacaatctaaacataaaagcaaaccctaacttttctcttttagaaaatcgatgaactttgagtctcagccctttttctatttattcccaaaatatgactgcccacagccatgaatttaactagaactaggaatcctaatcacatagataatccacacatatccctttataactccaaattaacttcaatcctccgaaagttggacttcaatctatgcatgcaattccctttgtgtgccatatagaagcttcacttccacgtgcattgttctttagcctttatatcttgtgtgatcttcttaccgtctagacctcaatttttccaaagtctaatcccaatccatcactgacaatattcccaaggcctcaagcaacacctatacacatgaacaaccaagaaaccgtatctgagtataagttcttactcaacttgacgcacattagcacacaatagtataatatacatatagaaataatttagaagttataaacatcaacaatcaacatagtctataaaaaaaacaagctaaaatcggctccaaactacacttagggcccctttgaaaagcaggataggaaaaatataggaataggaaaaatgtagaaattgaagttgtatgtttttccaatcctacaggaattgaaaacacagaaaatggagagaagagccctttaattacaccacaggatacactcaacaaaagaaagtttcttaagaggtctaaccttttgcttattttcctatggaattgatcataggaatgcaatcctatggaagtttttctatcctctttctatgaatcaaagggctctatagaaaaaaaaattcttagaaaaatgaatcctctaaaattcctttggtaatcctccatttcaaaggggcccttaactagtctaaccaccggactgctcgaacaccttcatttagatcgcaattacccggtccggtgtgaccacacatacacataacgtctaaccggccttactagttaccatgcgatttgaccgcctgcaccctgacacttctccaatttcattaccacttcataaatattaacataatcactttttttacctttgagagttatttattaccaagactaaattatcacatgattttcatgattttaaagtaggatgctgtatgccattactgaagttaacaacctgacatcctcattaattgttatagtggagaatcctctattttagttctatagaggccatagcaatccatacgcacaccgctaggtggtatgaagtgatgcaagcaaggcatatatgttacgtagcaccaggtcaatcatcatgcgctagttaggacgagtgccgtgcacaaaacgatgaaacatgcatgcattcggactatatattagctagcatatagcatattattgatgcaggatagtttcatgtgtagtggcccaataaatatcgcaacatatatctcatactccctccgtccaaaaaaaataaatatcgcaacatatatctcatactccctccgtccaaaaaaaaaagcaaactctgagtttccgtgtccaactttaactgtctgtcttatatgaaatttttttataatttatatttttattgttgttagataataaagcatgattaatattttatgtgtgacttgtctttttaattttttttataattttttcaagtaagacggacgatcaaatgacatataaagcagggttcgtcttttttattttatttttttttttttgacggagggagtacgagatagtggcgccacgtacatgcagagatcattattccaacacagcaatgcacatttcactccgatccccaatccaatccaatcccatcacagcctatattctataaatcgccagcatgacatatatagcacacacatgcgtagtcatcatccggtttttgcagcgaagagcaaactgtgtgcagttattatagaagcctcatgaatgagtcatagtccatacgaccaagttaatcggcaagaattttgaaaaaagggttaaaagtccacttagagcaagttcgatagtatagagccaactactaattctaaatcatttataaacaatctaatagtttatttatacaatagttacttataagcatatactacaccgttaatatatggtcacacctctcgtacacacagaatatattggagtctatgttgcagctggctacaaatctgtacgttttgcttctctctctttcatatgtacaaatagggtgtgttcggatatccttttcccaacccctcttcctcgttttccacgcgcacgcttttcaaactgctaaacggtgcgttttttgtaaaaaaatttctatacgaaagttgcttaaaaaaatcaaattaatccttttttgaaaaaaaatctagctaatacttaattaatcacacactaatagatcgctctattttccgtgctcactgtgctagcctgctattgtacttgatcttactctcccaaaacttgcgcgatcgatcagcaatccatcagcacactggcgtattatcaataggttatttgacacccctaggccatgcattcttaatgacaaggtatttaattaattattgaaatagctcgtacaatacattgtttaatttttgttattcactacatagaaacgatttttacagacacacttctattttatcataggcaagctaactgtctgtacctaaaaagatttaggtgttgttcggttaaggcccgcctcttaagaagcatgtttgtaaaaataggctattttcacaaacgggtcttttaagaggttagcttgcaaaaatccattcattcctccgcctatagttcgcgcaacggccgcccctccactcattatttcctccagtccacatgtgcatcctcccggctgcctcccctttttaatttatctcctttgtctcccactgccccccatgacttttctctcttctttctgacccacttctctgatcttccacttcccccttctcatctgtcatctcccccaccctcctctctctcccatggcagcagcggccttggactaatcagatctgccgccagcgcctacagcagcagcggatccgcccaatctagggacggcaggagcgatggtggtgaccacagtagcggcggccttagactggccagatttgtcacctgcacccatgagagcggcagatccctccagtccagggatggcgggagcagcggtggcggcatacgggcttaggggtagcggcatgctcgggaagagcggatctgccacctgcgggctctggagtgatgacgatgatgacctcgtcgagggctgcaatgacggagccaacaagctgcccgctgctagctgcgacaatgacgggctgcggcggtgatgatggccactagggttagggtttctacatttgtttttttatttctattttaaaagttcgtatttgggcatcgtaagttgaccgcttacaaaaattgtgtatttgcaagcaacctccttaggaggtctacctgtgaaaatcaattttcgcgtgtggttggaacacctgcatgctaaaatcacgatcttcgcaattacctcgagagaggcggtttacttgttcaactgcaaaaaccacttttgatcgtctgaaaagatgttttctgtagtagtgatttcataggcaacacaaacaagagacgagctatgttagaaacatgtgtagatatagtttcatcttgatgaaacttattttatctctcacttcattaattcattaccacatcataaaaatgcttacatcatattctatttaacgagaatgaaatttctatcgggagcggcctaaccgtatccagatagaccttaaatattgaagggtggctttacctacgtggcaggtacgttgactgaacagtttttcacatcacaagttgatcactggaccataagtgtttctttggggaaagaaagtaaaatgctttcattaattaggccctaatataatatatcagctggcatgggcttgtacacgtcatcatactatctcttcacaacctgtagttgagactaacgaaatgtcatcaacccaccaaaacatttaatttatcgttccttccttccatttcatacaaccttaagtagcaaaattccctcttaattatcttgcgctaacagtcggtgttaaacttaacatgacatttctctatcgtcacgtcgttctctcttgtcaacatcagcagattgatttagttgacagtttttatgggatagctattaattcctgttgtgcatgccagatgggctaggcagaggatagggctactgcaggttccctagttgtacgaaagtc

SEQ ID NO: 27482 - DNA, 7586 bp, Oryza sativa
tacccatacatacaactgatgtatacgactttcgtataactagtgcttaactgctgcttgctctggcccacatggagagaaactggcttggcttgtatgaagtgaattgattggcaaatgaggcagggtctgttgtatgctggagtcggacgatgtatagcggtactcacaaataaactagttaatagtacagttcaagctatatatgttggatttactacccgatcaaagttcagaggctttttatacaggcattctccgaagcacatgaaagaatacatacatacccatttgcatctcttcttgaatcctgatcaacttaattaattatacacaatatagcttagctacatgtagttaagctagatcgaaatatactccatctgtcttaaaatatagcaacttaaaattaaatgacatatacgttctagctagtttcacaaatctgaacagatatgatatatttcatacatccgattttaaaattgctatattttaaaacgaagggagaaatctacgcccggtggccgatccctgggctgggtaccgacccctgcggcatccagccgctgctgtccgggcggatgatctcggtcgccggcggcgacggtggcaatggcggcgctacaccttgcagcaaatcatgaggtgaagtagcttccttagaagaagcactagtctccttgccattcacagcatgatcacctggcatcatcatcatcctagctcgtgcaaggcaagaagatgacgatgccaacaagaggagagcagtgaagaagatcaccattgccgccatgtgtggagctggagccatattgcaaattgcaatgcaaatgtgggattaattatatatagggcggtgtgcagtttgtgagtttgtatgcgatcggcttatcttgtgagaatatgtgatcaacaactagctgatagaggcgtatttataggagaggagtgggagatttttcagaatgtggtgacaagaaatagtgagcaagtggatcaagtgtgtggtttttgtggtggtgcattggtggttaatgggttgacgtctgaattggtagggtatgtttgtattaattcgatgtttttttcgatggtatttatagtaaaatcaatctaagcagtttaacttttctattctaatggatcatatctatttatactactgccataaatactgataatagaattatttttcctactgataactagtataacttataaatcaacggttaaaatcaaacctactagctagtaataaagagatgaccataaagagtattcatacgatcgagtatggtcttgttttcaagcttttgttagcttcttaattgcttaatttcattatagaaaaaaaatatcgatcatttttttcatgaattgatgaacacacatgcatgagcgaaattgagttagtcaaagtcaatattgtgtaataacttttctttaaactaaagtttcaaaagaacatgattttcattccatgatttaaatgtaatagattttattaagtatgagtttattaacaaatagctagctagggtggaaaaattcatggttatattctttctctttagttttcaatttattgcaaaaaaaaaagctaaaattgatatatgaaagcttgattcttcaattaattacgtgtctttcaggtgcctcacgtttctttcagttccgtcacatccactacttttgatgcatttttttttgttccactaaaccgaaagcaatcgaataccagtttgacagatagacgaaggaatagaatttggcgtgcgtgcactcctataggtagctcagtagctggtacttttttggtccttttaaacatggtattgtaaataattaaaaccattgcatactcggattagtgcattatgtgtaaagctgtttatcctgatgcaaagaaaagcatgttgacacactccatacttttaacagattgttgattatagataagttatcctgcttggtactgatgattcttgtggtttcgtcaactcaaaaggatgagtattttggtaaatgccaccacaaaagaagcatatggctcagaaatcccatcgtaaaggtaagatcttttgcagcaagtcgtgaatatgaaaaaaaaaaaaggttgccaaatacactgtaggagaaacaatctctttagtaccggttatagcaatcgagaccaatatgcatactaagtcaaacaaagaatatgtggaatgtgggattcgaactcaaaatctctcacctcaatactcacgcgcgctactattacacctactacacatatctacttggatcaaaatgctttctttttaaactaatcctatagatatctttagtatctgatactaaaaatatttttaatacaaattagtgttatcaacttatactaaaatgcatcttcagtaccggttggtaacattaacgggactaaaaatcctccagcatcagtctcacttggtgttaccaactgctactaaagatgtatttttagtattagttgctaacaccaaatgagacaaaaaatttctagggacttagacttttagaaccggtatatttgtgtttttttaatcgagccggcatatttgtgtttttgggcttagtataaaaaatcgtttctgtagtagcgatggtatgttgatatgcatatattctggtgggagaaaaactcaaaaacacagttgtgtcctcgttcctccacccaattaggtatcaactaacaccaaaatatgtgtttcggctctttagaaattaaatccatatattttggaatggtgggaatatatagctaaggcttttttttaaaaaaaaaaccttgtatcgcattgctggaaggaattgacttaaattgttgcatcgatcgaattgatgggtaatatgtactcctttgatttgatttttaacagtaaataagatggagtttcctcagtgcttaatgtaggattgaatcacaataactaagccaaccagagaggggtgaatgattggtatacccaaaaccgaaaacttttagtggaaataaaagttaccctcaaattcgacggatcgcggtctgaccgaaggtattgcaccggtctaaccacctggaacacgtcggtctgaccgagcttaaactccggtcaaaccgccaagatcgcctgccgctccctgtcgccgtcgctggtctgaccgccgtgtgcccgccagtctgaccgccgcgatgccgccggtctgaccgccgatgcgtcgccggctagaccgtcgaaacccagtgaaacacaaatcaaagaactcttaaagtagatgacgactttattgattatctctgtgtttacaaagtgcactaacagcactccttataaaaatctcgactaaactcgaaaccctaactcaactatcaactcaattgctatcaaaagcgataccgggaagcctcacgctccccctctatttatacccgagataggcagcctaaagccacgaaccaaactcatactagaagtcctaaataccttaggaaaccctctagtacaagaaacaaactttacacaaccaatcataccaaatttggactccttacaaattcgactccgcatcccatacgtacacaatacctccatcgtatgccatatggaatcttcaccaactacgtgtattgaactctagccttagtatcccgcatgatctctgaccaccacggatgtcgtcttatccccaagccgactcccggtccatcaccgcaaatactctcctgaggcatcgagtcacctacacatgaaataaacaaagaaaccatattccgagaccaagctatctccaacttaactcattcttagcaaacaacagtattacatacgcatagtatccatcttgaagccataatcatgaaacaatcacggatatccaaacaaacaacccaaaaccgaaaccgatacagagtcggccggtcagaccgcgggctgcgccggtctgaccacacgatacacgccggtctgaccggcagcacatgcccggtctgaccggatccaatccagcagtacctgtagattcacctgtgaaatccaatcatctccaaaaccactttgtgaataaaatctaaatatcaaaaccaataatctccgatgccaattgttcatcacaaaataataatcaaaaacacttttgattttacttaacagtaaatgagatagagtggttttgtgccaacatctaaatacacagcaaagcttaggcatgtacaacagttgatcgagatgtttgcagagtaaatagtactactaaacacaataacgaaacaagtggtcagccgcttatatcgcccccccccccccccccaaaaaaaaaagtcggtacaacctacacttatatatttctttgaaaatttcagataaaaaatatttatggtggaaaaatgtatgcttgagccatgtctcactgaagaaacgactacttccacctcaattagtcaattactttttcaccatcgcctccaacatctcagcgaactaaggctgtgttctttttagctactccctccaggttgataattcttgtcattttgaataaggacatggtctttaaaaaaacaactttgaccattattttttaatatgtatataaatgttaacaaatatatgattttattaaaatattttttaagactaatctataccacaatatttcaaagataaatattttagaaattattcataaccaaagatttaaatgtttgacctcacccttatccaaaacaataagtattatcagcctgaagagagtattgcaacttagctactcctcgatttcctagcacgcttttcaaacttttagcattgcattttacataaaactttttatatataagttgtttaaaaaaatctaataaatttattcatcaaaattttatatattaagtattattcatatgctaatcacatttcttgttttacatgtggctaattagccgttttaagcatccgaaaagaacgcagcataagatgtcaatgtagtcgactttgtatgtatacccgtaattacataagtacgtaataataatactttaatagtctgctgcagattttaaccatattcttaacaataacactccctctgacaagaaaatacaattacagtactcaatagataaattaacagggaaaggaaataacctagctaaatgccccttagtaaaggaattaatggtggtgcgggagaggatggttcatgccaggagagatgctaggaggaaaagtagtactttgcaatttgcattctttttaagttaaaacttttcactacgtgtctgaatatacccttatccaatatataaagccggtagttaattagtatattttgggacaaaggtagctaccttcatcctaaaatatactaacaatctagtattggataatatatcccagcattatgaatttgaataagcatatctagattcgtacttcactctaatttaggttgttgtgttttgagatgaagtagtagttttagctcttgctcagggaaagagctctttgactagactaaggcaaaattgaatatagttgtaagttgtgcaaatggaaatgcatcctccgactttagggcaacaaaggaagagtgggacagtaatttgtattgagtttgacgctacagtaattcacagcagcagcattataaaagtatcattattatcacagtacatcatggtactgtagcaaatcgatcgatctcctccattcaaatgcaaatcggacggctgtaagcgtcccaaattcacaattactatgtatatatatgctcctggattgttgacatcttagcccttttagaaagcatattttgtaaatagatcctcaaaaaagttactgcgtatagggactcatcattggtgtcgagattgaacatcttggcacaaattaatctggcacatgcatgccgaaaagtctatttgacaccaaccctcggtcggtcacctatgaaacaacttctttcccctcccacccctccctgaatcctatagatttcctataaaattttggaaaacccgagaaatggaaatgtactatacataactcattttcgctaatttatttttatttatgaaaaaaattgagtccagaggatgtgggtccctccctcctccaccaccccctaaaccctattaatccactgtcaattttttgggaaaaagttttgacaaatcaatgtattaccattcattttccctaatttgtttttatttaattagtaataagacttgatggaatctaggatgatgagtgggaagtcgggtgactgggtgagggatcgcactaacaagatttgtacttgagatgtcgtgtaatttacctcgaggccaaggactctggcactcagtttcggttcattttcataataagtttttttaagggcctatatgtgaaatatgttttttgaaaagggctacatagaaaaaaatatatccagatatatgctcctctgactttaccatgaaaagtcagatgatcaaatcctttgcaaaatgcaaatgcttgtacataatgcactttgagttaggtcaccatactcgatcatatgcatgcatgcatgtaccctgtatttcgttttacaatagaagaccagcattgacttctgttgcaacttgcaagttataaaacgtgtacttagtggatactatcatatgtaccttgaaaaccttatgcttcagaacatatagctttttttttttgcgaggaatgcatggttcagaacatataggtagaattgtaagttgtcttgcatttttattttcctacaaaattagatcgaagtggcattttttcggggcaatcagaagcaagttaattggatgccctgtcatttctagaacactaacaaacaaatctgacaagactacttcccaatgaagaggtagcatgatgcaaattcagcatattttccagggaaatgttccaactcatcacaagtcaaatctgcaaaagggaactattggggatagctctagctttctgtgatacaatcatccaattaatattctcccttttgactcctggctaggtagtgtgctctccactttggtagacctcgcctgttcatctgacacgcatattatttgtgcacaattgatcttacattttaactacctttttctccacctgtgatttgctagttaatggcctagcttattgtcataaagtgcaatatatatactacatatgttcttttataatatcacaagttcacagcatgtatatatactaatataaaagatagtagtggttgtggtgaatcaccaccacccaagtatcatgcatgcaggacccacgaactatgagttacttgtctcttaacccccacatgccatagatcccgtcgaaagaaaaacataatataatattaatgataatatattagataattagagaaaaaaaccgttgcaacgcacaggcattatgctagtagatgaaaagagagcatgcatgcatgaatctgccgtccaagccccatccgttgtctttacaaaaaatattgtggtcaatgcgttttgacatgaaattacgtggaaagcagatgtgcaaatggccgatcgatctcaattggttgctgtggaa

SEQ ID NO: 27483 - DNA, 6206 bp, Oryza sativa
  unsure (1)..(6206): unsure at all n locations
tcatctattaaaaaatggaggtagtattaatcaagataccaaatcacatacttatgcatatatatgcaaaggatgacagaagcaaagtgtcctagggttagggcaagttgccttttgaacaaagttttgcttacgtacggctgcaagatagcattaattttgcactcatcgatccatgacgagttgttaactacactaaatgaaaatgactttggtacacagctagtacgtttgtagtctaagtacgtactgatggcagtggtaccaaaaatgggaacccctggttttgatggtgctctgcggaaatccattagctgatcctcgcaccaatctctctctgcaatgaaattcttttgttggttgatcccctgcacacctcactttgcacaactattctccattctgctaccacatgaccagatcgaacaattcatcacgaaacaggcatgtatttagttgtgccgtgatgaggaaaaaatgacacaattaggcagagttggattcaacactttcccaacttctactccctcatttttcacgcgcacacttcccgaattgttaaaagttgctttacaaaaatcatattaatttttttaactaatacttaattattcctgtatgctaataaatcgctctattttacatattaggctgtgttagttcggtttgagtggttggaaacaaatctcctacgcacggaaaacggagcggtctattagcgcgtgattaaataagtattagcaaattttttttcaagaatgaatcattataattttttaagcaactttcgtatagaagagttgggaagaggtaacaacgaacacaaccttagttcccaaccacaccttaatcgtacacagccttaaaatggaacaggacgagagagacgaagaaacaataataatatcccagagtaaattagggaagcaacatcgggataaaagggataagaattcacaagaaacacgcaagttgaggaaatggatatgtatgttgtcctttcctctgtacggatcactctcccttctccacccaaaccaaattaaagttatgtcaactttgacggcatacatgtaggcaacagcacatgcgagcatcacccatctgtactatacaaaagaaggcaattcaattcaattaataagcaccatgatgataggtatatacatcttctatcactaggcaaatgatcaactccatattattccgtcgtcactcaccgtcattgtctctattattacctatcaaccgatctagattgttaaaattacatcattttgggaaggaaaacaaaagcattgtacgtagtataactaaacataactatagggcacttatgtaggtccttttgtagcacgtgtaggacgacactaattaagcatgcatatatatatggtcaaacaataccaccgtgcaaagttacagaaaaaagaacatgaaaagaagtttaacctatctctatctctctaaatatatgtactctctccgtttgatattataaatcattgtgaattttcatttaaacttcttggatatttgaccaagtttttataaaatatagtactacctctgttacagattataagtcattttaactttggtcaaagtcaaactacttaaaatgtgaccaagtttgtagataaatatagtaaaatttataacaccaaattagtttcattgatatatttttatagtatatttatattatgttgaatatgttactattttttttaacaaatatatggtccaacttagaaccgtttgtctttgaccaaagtcaaaacgacgtataatctaaactgatggagtgcactaaattagtttcattacatctaacattgaacatatttagtagtttctttattttgtattaaaaatattgttttaattttctataaatttggtcaaacataaagaaatttgacttagaaaaaaaagtcaaaacaatttataatatgaaatagatgtagtactgtgactcataagaaattcccacgagaaaaaaatgaataaattaaatatagcaaggattgttgaattgtaacggttcattaaaagatcgaaaagttctggtatatatataacttggtaactgtcaaactttattcttcgaaaaaatgaataaattttctggccaccaattatggtaagaacaaagattaatgaaccacataaaaattgagtgaatagtatcatatactcggcaattattaatttatacagtttataaattaataaaatacaaaaatgagactcaatttagccttatgtattagttcaaaatttcagaattacttactagatgaaacacatcacattgttgcaggaaagttgtatggcaacaaataaaatggggggcgtagtggatttgctttgtagcttagggcctgtttagattccctggcaaaattttccaccctgtcacatcgaatgtttgggcacatgcatagagtattaaatataaacgaatttttaagcctaattgctacatgatttgacaatgtggtggtacagtgaacatttgctaatgatggattaattaggcttaataaattcatctcgcagtttacaagcggaatctgtaattgattttgttattagtctacgtttaatacttcaaatatgtgtctgtatatctgatgtgacacgctaaaacttttcacccctgatctaaacacagccttacaatatccatacaaatattaagataatataggtttgtaggagaagagaaaccacacatagatcaatcacccaaagtctaaaaaaacaattaggtgtgatatggtaaaaagggataaatccattttactctcctcaattcttcactttgcctaaattttaaaacacaaccccaaatttcaaaaccggcggcagctgcgtggggaaggggaagtgcttgtgtgaatccgggcaggcggcggaattgttagcttggaaactaaactaatggccgtaaattaggtctgtgcaggagattatctttcctttgggccactaggcccatgggccaagaatgtacgcactacatctgcctacgcctccatcaggtatacgggctgcggcccatgaacaagaactgtaagtaaacctggtaacactttaacagtagctattatctttttttttccctgaagcttctcattcatttatgtccatttaatcgctaatcgaggcatggggcatttgggtcacagcaaaaaaaaaaaaaagcaaaacggtggaaaaatttggaaataaaaaagaaaatggtcgaaatgacatttgtagcaagatgttttgtttaaaagtggcattctaaccaagccacattccagagatgccaaaatgtcaattttcttgtgtttgagggaagcataaaggaaacgaaaaactcatctttttcgtgttcacatttccccaactattaagcggtgtgtgtttttttaaaaaaaattatttaaaaagatattttagaaaaatcatattaatcatttttgagtttaaaataactaatcatcaattaatcctatgctaacgtcttacgtatcttatctctcgtttcttctctggtcaaacacacatctaatcatacactgtactacctctatcagaaaatactcgtcattttagctagtttagcctatagtattaaggccgtgtttagttttaaacttttttttttcaaactttcaacttttacatcacatcaaaactttttacacacgtaaacttccaactttttcatcacatcattccaattcaaccaaactccaattttagcgtcaactaaaacacaccctaaggttttaaataaaaagactataatccctactaaatatggttgagggtggattgatactttgaggtataaaatagcttgaagtgataagtttttatgataaattttgaattctaaaatgatacttcacctaggcctaggttgttttttcgtgtgccaaaatttaagtatacggaaacacatttgaaatattaaacatagactaataacaaaacaaattatagattccgcctgtagactacgagacgaatctattaagcctaattaatccatcattaacaaatgtttactgtagcactacattgtcaaatcatggcgtaattaggctcaaaagattcgtctcgcgatttacatgcaaactgtgcaattggttttttcatccacatttaatgctccatgcatgtgtccaaacatttgatgtgacgggagaagttggaagtttgaagaaaaaattttgaatccgtgtttagggtgtgtttagttcacgccaaaattgaaagtttgattgaaattagaacgatgtgacgaaaaagttggaaatttgtgtgtgtacgaaagttttgatgtgatggaaaagttggaaattggaagaaaaagtttgaaactaaaccaggccttagttccacactaaaattgtaagtttgaagaaattgtaacgatgtgacggaaaagttaaaagtttaaagaaaaaaaagttgaaatctataacaaggcctaactacatcatggacgagggagtatgtttggctgttgaaccattaattacaaaccaccgctccaaggcgccaaacccattgaagttgtagcaaaatgcaagcccagctggcgccttggcagcatgagcttccaacctacccgaccgttgcgttgccctcccaaaaccaaaccaaatcaaatcacattcacaccattccacttcccccctttctccctcccgaccgttgcaaattcctccctccactaaaacccaaatcccccacttcccccaccaccgcgcctttccgccatggtgtcgaggacgcccacgaagcagccgctgtccccgctgccgagggcggccagcggcagccccaccaagccgacgccctcgccctcgccctcgccggcctccgccaggcgccgccgcgtgctccgccgcgggagccccgggaggatcaagtcgctcgccgcaacgttcgacacctccctccgcggctgccgccgccgcctcctcaagctcttcgcccgcctcgccgtcctcggctcccccaccaagcgccgcgccgccgccgccggcttccgccgcctccgctccccgccgcggtcgccgtctcctccaacgcccaagccgaatcaggtagcggccgtctcgccgcagctcccgctcccgctcccgccggtgtcgccggggaggaggacgctgttcctggacctcgacgagacgctcatccactcccagaccgacccggcggcgcgggcgcggcacgacttcgccgtgcgccccgtcatcgcgggccaggcggtcaccttctacgtcgtcaagcgccccggggtcgacgcgttcctcgccgcggcggcggccgcgttcgagctcgtcgtcttcaccgcgggcctccccgagtacgcctccctcgttcctcgaccggctcgacccgcgcggcgcgcttttcgcccaccgcctctaccggggcgcctgccgcgacgccggagacgggaggctcgtcaaggacctcgccgccacgggcagggacctccgccgcgccgtcatcgtcgacgacaaccccaacgcctactcgctccagcccgacaacgccgtgcccgtggcgccgttcatcgacgacgccgacgaccacgagctggagagggtgatggggatcctgtccatcgccgccgagttcgacgacgtccgcgacgccatcaagcgctacaaggaaatcgtcgaggcgagctgaagaagaagaagaaggtgtggctactagcctactactaaatattagcttcttaaatcagtttcatggcagaaattttccccctttcttgtaagatccttgaattggttagggatttgggattcatatagtggtggctacctgaacctttcaggatcttcctgaaaggcagattgtgggaatggattatgtggttcagaagcttcagcacaaactgaaactggaattgggaaattctagaatgctgagaatgttatgaaattggagaacaaattttgttttctactcatgtgcatctgatttcagtaaattctaagattgtggaaatatattatgaagtagttcaaaagcttcagcacaaactgaaaatggagttggggattctagaatgctgagaatgttctgaaattggagaaattcgagaacaaattttgtttgctannnnnnnnnnnnnnnnnnnnnnnnnnnnnnnnnnnnnnnnnnnnnnnnnnnnnnnn

SEQ ID NO: 27484 - DNA, 5708 bp, Oryza sativa
tggcaatgtaaactatccctttatgtctgaaacttcgcaggtgtatagcatcggttacaggcttctgcgtttcgattaacttgtatagtagacggatttttttttagcaatttcatttcaaaaatttcccctttgttgtaaaattcttgaattggttaggacttggggtattcacatggtggtcaacctttcaggatcttcctgaaaggcagattgtgaaatactcctacattatgcatatcatcagcttcagtgcaaactaactggaactgggtgttccgagattagttaaattgaagatcaaattttgtttagtggacatgagactctgctttgagtaacttcaagtgcgtattgtattgagcagttcccattcatgttctatagagagttttggaaatgaaacccatcccttttatctctgaaacttcccaacattatagtatagtgttgaacaatttacaggctcctctatattggaatactttagatgaaaagacaagaacaagggacgtgaactagatgacgcagctacttgaaattagttttgttgttgtgcgttgcaaacaaaaaaaagaaggcatactagtacttgttttcttgtgttcaaactgcagagacaacgtattgcgtactcctgaatcaccattatggcattatccctgaaactctgaaaggaaccaaaaatcctaatgagctaagcagaaacggtttttcttctgtgagatttaacacaaatgacttagcattatgaaataaacatgtagaatgtcaaacaactttttagctgaattacttctatataaataacaaattcttttggaactgattgctatgaaagagactagctcccattaaaaatttctgaaagtgactagtgcgaacgttgcagcctaaactatatcatactatattactgacattccgtgcactccaaactcttctttattagtgattgtttcaatgaatacaatcagcaaaattacaacctttttttctcatgaaaagatagaaacttgattgagagtactcttttcttagattgatgcctatattagaaattagccaagaacttcaattccaacaccacaccaaaatactacagtaaaattgatgctgtttttttgtatattgatgcctatattagatagttgccaagaactccgatttttaataccacagtaaaattgacagattacgaaggggaaaaaaagcagtgaacgttttcttttcatgaagctaagagcaaagcttgtaccgtgactgtactggtgaggcatacacggaactagtctactttatgggcaatctgccaatgcattggtcagaaaatctttttgtcaaaacgggtcagcctgacagcgagacgcgcctgctgattaacgtgacacaaataatggtttgaagtaaactttattttattgtttatcttcatatggagatctttcttgcttgctatgcatactaaccaagtgttcagacttcagatactgatgtgtattaactattaaggcaaatcttgactggtaactgacatttgggcaccaccaaccattttatttttctgggagtcccacttgtcagtgacacatatccgcggtttgatgctgaatttctgaggaacctggaggacagattgcaaatttgcaagtagagtagtctttgaacaccttatatccgtgcacaaaacggtggtcaatccaggaaaccgagcaaagagttggacacatgcatgttcacaccgagctggaggccataaatagtagagaccaagctgcatcttcttgttatcttcagttattcagaagttcagagcagtagaggaagaacaggataagatcatagctagagatttcagagagagaatctagagagagagagaagagatggctggaggagagcatggagttaatggccagcatgaagaaaccagagctatggaggaaggcagcagagatcatcaagcaaggtgtgagaattcagagcaagatggaggaagcaagagctctagtaataaccaccccatgttctctgtccaattcgcgcagaaggtatgtgcacatctcagaccaagatggtttcattttgatcaaattcatcttgagtttccctctcatagatatatgtagtatttccctttgatcctggaatgtatagccaagctcaaacaagttctccaatccctatgaccctacaataattctgcagagaacaataaagaattcagtagcataacaacactataacagacaaaggaaagatcaagatcagaatttcccatgtggcttgtttttagaggcgcatgtggtagtagcatccaaaattttcagtaataatatactgttgcggctacggcaaaatcccaaaaaagaattatctgttcttgtttgcgagtcattgtcgccttcatggagccaagtcttcaacatgattgcgtcttggtcatcggcagcaatagtagctttcacagaaattaggattgggttggctactatgacaagcaattgttgtcaatcttgggatcaaacgatgaacacgacattgctgctaatgatagatgatgatgatgaattgctgtttgtaaaatcaaagtgtgtttgattcttattctgcgatgaacaattgtcatctgagattattgtggttttgataaacacaaatgggggggcaggtgatcgcggagatcttggggacgttcttcctcatcttcgcggggtgcgcggcggtggcggtgaacaagaggacgggaggcacggtgacgttcccggggatctgcatcacgtgggggctcgccgtgatggtgatggtgtactccgtcggccacatctccggcgcgcacctcaacccggcggtcaccctcgcgttcgccacctgcggcaggttcccgtggcggcgggtgccggcgtacgcggcggcgcaggtggccggctcggcggcggcgagcgcggcgctgcgggcgctgttcggcggcgcgccggagcacttcttcgggacggcgccggccgggtccgacgtgcagtcgctggcgatggagttcatcatcaccttctacctcatgttcgtcgtctccggcgtcgccaccgacaaccgagctgtgagtttgatccttctccaaaccattcttgttcttgtacgttttccaaactgtgttcaatgttacctcttccgaactgttccctcgtactagtagttttctgcgtgtaagtttttttttaatcgctaaatgatgcgtttgttgcacaaatatttatatttgaaagttgttttcaaagatcgtattaatcctttttcaaaatttaagataatatttatttaatcattcattaattcaccgctccgttttacgtacaaggagataaaaggttcccaaccgctactatcgaacacacattgagttgtgtcggtaagtagtgatgacggagtggattgaacgaataatgctcataccatattaatttttatatatttttttaatttagatatgaaaacaaatacaaagtatctcgaatacatgtatgaacaattatgggtgttattaaacgctataaatagaagtcatcatagtgatgtgatctgctgactagcctaggcggctgcctgtggtcgacgggccttggatcgaccattacctatgcccttgtgccctgtgtgttggggagatgggggtatcagatcatagcaatggcgagattttgatgaggcagaacggaaagatgaggacagtgaatttataatggtttataatcttgttgccatacgattatagctcataggaattgataaatcatttctaataataaaatgagaggttagtactatctccatctaaaaaaagtttatttttaacatatcccacgtacatcaatacaaagttaaaaaaagactaaaatgtccttcactttttcaaactccattacacttacaatacatcattgtttcaaatatgaagtcttcgttgaacggagggagtattcaattagtaatggtacattggtacatagaaaatggtcatttaaagttgtaaacaaaaataataaagtgtaaaaaattgtcttaatgccttgcagttattatatgttgaaaatagcactcgtttatagagaaccatgacttgctcggttggcaatggtttggtgactttcactatgtagacgcatgtttcatatttcagacttgattatatttccctcagattaaatgaaaggttaaaaaatatgtcgcacctctcccatcttaatttcatcagatagccggtaattcttcctagccatctcagcaaaaagaaaaaaaaacatgagagagtagtaattttcaatcagcaaaggtgtaattggagaaagtagtaatatttcatcagctgtgtgtgtgtaaaacgagaaaaatatgaaagaagtgtctcaaaaatcatatagcgactttatgtttacaaaaaatgcagaaaaagggagaaaaagggaggagtataagacgagaaaaatgcgagtatggtgcgcgtacaagtacaaaatcactgtaccatatatgtttacaaaatggtattcatactttattaagacgatcgccatcgttatcctgatgcgccctgatcctatttttctaccaaaatagttgctagtcgctctcaagatttgaagctagtgacttgttgggagttgcaactacaagccactcttctgacattaatttcaacattagtcatacaagcagttgacccaatatataatgcatggaatgagttttctttttcatttctttcaaagtaattttatagactgaatactcatggctcctcctatttgcagattggtgaactagctggccttgccgttggagctaccgtcttagtaaatgtgctctttgctgggtacacgtcttgaaccattgatattactccttccgttcctaattagatgtcattctaacctaattagatgtcattctaacttttcgcttgcaacgtttgaccattcatcttatttaaaaaattagtgcaaatataaaaatgataagtcatacttaaagtacttttgataataaagcaagtcacaaacaaaataaataataattccataatctctttaataagatgaatgatcaaacgttacaaacaaaaactcaaaacgacaagtattttgggacggatattgtacctctttttttttgagaaattcggttttactaatttgtgtttgttaaaaatgcatgttacaattattattttcataatacgtctgctaataacttttaaatataataaaactgaaatgtgaatgaagttgaataggctagccctatccactgtagaaagaagtttgttgatcctcactgtagaaagaagttgatgtctatatttatgcagattcaagtaccaatgtgaaaacattacttgtatgactgagttttcaacttacaaagacacatatctataatatagataaaggggtcctggaacaccaataggcataaataccttatggactaactagaagcatgttttccaaaagaacaattgtagcacatttaataggacatgtacagccgactaacaaagtcgccatctctaatataatcctcattatatatgaacagtatatattaaagatagcagcaatagtatctataaacagtattaacgagaatgtgtacacaagtttcgggtgtgctctcgccgtatacactaacactaacaaggtgttatataaaattct

SEQ ID NO: 27485 - DNA, 4619 bp, Oryza sativa
agcacatttaataggacatgtacagccgactaacaaagtcgccatctctaatataatcctcattatatatgaacagtatatattaaagatagcagcaatagtatctataaacagtattaacgagaatgtgtacacaagtttcgggtgtgctctcgccgtatacactaacactaacaaggtgttatataaaattctaaaaataattagacatgcatttctactattactgtacttatatataaaattctagtttcagattcatcgttaatatatagcaaagaaaacaggaaactgtgataaatctatactcttaaaccagcaaaattttcattttctatgaccaaaatatattgaattttcagttaaaagtctataagtaggtgtagtaatactataagtacttatataaatttatttttttaaaaaatattttggagacatttattaccgcctccgttttcaaaagaaggaaacttctgtgaaataattctcgataaactatgccaatgctgcaaagaaacacatttttttctctcctctacttgcacagcagtaaatgacctctacttgcacagcagaaaaagtcatttaatgacattagttactccgtattatcatggtacatgctctattctctctgtatggtttagctagtcatatatggatttcttcaatttagtcaatgacaataatattcaattggacataatctgcaggccaatatcaggagcgtccatgaacccggccaggaccatcggaccggcgatcatcctcggccggtataccggtatctgggtgtacatcgccggcccggtttttggcgcagttgctggcgcgtgggcctacaatcttatccggttcaccgacaaaccgctaagagagatcaccatgactgcatccttcattagaagcacaaggaggaactaggtcccagaattgatcagttttattgtggtaaaatgtttcctttttttttctgtagctagtgatgttgatggaatgaatgggcagtaaaagtaattgacactgtgattgcatagattttacatgctttggttggcttgttgtagcttaaatggtgaaggattgggttacttgttgtaattatcattctgaagaaaaacattgacaccaaatggctgtgctagaattttgataagatttatttttatttgagcattatcgatcacaatcaaaagacctccaatacagcatggaccagcaaagcgataggtgcaaaaatccagtcaaatgatgcggcgtccaacaagcgggtactgaacaaaatatgcatttcttaatcatttggcctacggcttattaatctacctaaaattaatttataagtaaaactttttatacttgtgccattggcgatttaaatgccaatctagtgatttgatgcaattaaaaaaaatcaaattcaacttcaaaatttaaactaaaaaagggcgaaaaaagaaaagaagaaccaaatctgtccgatcaaaaaagagcgaaaaaaaagaaaaagaaaaacgaatccgattccgcggtaaaaaaagggcgaaaagaaataaaaaagaaatctgtctgattcctaaaaaacgggcgcaaaaaaaaccaggtgaaaaaaacgaccagccaataaaacgaatccgcgtggacgcggtaaaaaaaagagcaaaaaataaaataaaaaaaacaaatctgtcggattaaaaaaaagaattatgtgtgatgcggtaaaaaaatcggatcctattatatttgacacggggctatatatctatatcttctctatctctactacttaaaaaaatttaaaaagtttccgttgtccgtaataaccaaaaaagggcgaaaaaacaataaaacaaaaaaaagaaagtgtgattcaatttacttccgtcccccgtgaaaatcttatattatcttaatatctctctctctctctctctctctatatatatatatatatatatatatatatactacttaaaaaataaaagaaatttccgtcgtccgttgggaaaaaaaagcgataaaaacaaaagatcagaaaaaaaagtccgactcctccggtggaaaacagagagaaaaaacaaaaaacgaagagaaaaaaaaacttccatcgcaaaaaaaaaaatgtccgactctaaaaaaaatccaactcctcggtggagaaaaataaaggcgagaaaaaacaaaaaaagagaaaaaaaaacttctactataaaaaagaaaaaaaaaacgtcctacatccctgcccgcgtgatgaaacgccagccaaagcaaaaaaaacaaaattgagcaaagggataaactagattgaagttcccaaaattaaaagatgataaacgatattgaaactcccctaactcgaaaagagggaataaaatatattgtaatttcccgacaaaatgctctaaatttgaagaaccctaatttcgggtaagaaccataagagtcaaatccaaatcaattaagctaagggttcgggttacttaccggacttgaagcccctgagctcaccccagagctttccgggaagcggcaccgccgcaccttcacctcctcgcagtcgtgtcgggttccctgcgcgcgtgctgtcctggagcacccctccaccgtcctttgccgaagacgggaagcgtcggcttggcgtcgtccctaccgccgacgaggtctaggtcactcagcgctcgtccccatttgcacgcccacctagtcggaccgccgacgtcgtggcatggctttgcaccgccctcggatgcaccccctagccggcgaagcaggagccgctcagcggtcgtcgctgcacgcgcgcaccagcttgccggaccatcgtcgttccgctcgctcgtcgccggagagaaatgggatcaagagagagggatttgggagctagggttttgcccctctccccggttggcacttcattcggcgcagggacgattggagccgtccattagattggacggctcagattcgcctagcgtcgggccgtcgtcgccattgattacgctacgccaatgggccgcggaagtgcatcggaccgcccccgcatatgtcggctgcactcagctgcttagcttgcggaccgtcgaattgactcaactcgccgaagatgggccagcccaagtttgggccggcttgggaagacctaggccgaaagcaaatttgatcaaacaatgtagctcatatttttcaaattaaagtccattagataaattcttaagtaggcccgaaaaataaatctaaaactaaatcctaaatcctatgctaattgatcaaattagactcggttctacctatttgttaatatatcaaattagacttgatttttacagatttaaggtttttcaaggtgtcacactatcaaacggtgtttttcccgttgcaacgcgcaggcgctattgctagtttaaactaaaagtgaaaatcaacaaacttgtatcaataaacgttaaaaaatatattccaaggggacctgatacttctgcttccgcaggccacagggtgggggcccaaaaatggtatgggccagagctaagctaagaactaagaagctgctactcaaaaatttgtacagctcggcccagtgaagcaaagtgtcatgtgatcactactttagcttagctatgcaagaccaaaatagttgtaggatggcactggcatctagtgatgtgatgcaactttctagtttgctagtaacacgaatgattttcagttctccacaaaaaaattgtaacagagtgccatggcagtatatagaaaaattgcattcctgcttacaccaccagatctgttgtacaaacatcgtatgctagcaagctttttaggcttcagcctcgtcacaaaaaaaaaatatggcgaaagaaggcggatatggatatatgttgttactggaacatcctgaggaagttgttcgcgtaggccatcggcttgacgtcagggtgtggctgcaagatgaaatcagtcaagaccttggttgtaacgaaatcacatattatgctgtttacaagacaaacacaaaactacagtagacactacatacaaaaacataactagtactcgtgtcaaaattatctgtcgtttccgacagcagaaaataactacgagcaggtcatttctatggtttgaaacgacgagtatttcagatcagagggagtattcagaccagagggggaatcgagtaacaagtgtaacatgcactcgaccagcttcctacaaaaacatactactgccacatacagtcttctatttcttgggatactaatcttgttgcaagaaatagagtaatagtgtaatgtactcaccaccgctgagaaagaggaaatatttggttttagttctggagctgtgaaccgaatgtatgcacccttgttacccatctgtatcaaaatcgcaattcacaagatgtaaaaggcatgattagatatttaagaagaatatcgggagcataaaattgaccaggaaacaacttccatatccttatggtgcaattattagtttgtgcaaccaactatagttctattgtcgcaaacctggtcgcaataattgggagcagagaacaccgttataagctttccatcatgttcaatttcatagccttcatctttcacttcatggggatc

SEQ ID NO: 27486 - DNA, 9485 bp, Oryza sativa
ctttttaacaaattttacttcatacccagattattttcttgtagaaatttcttagtcacatctgcaccaaacgaaagaccaacaccgcgtttgcttggacctctaccaagttgaggctgaggatcactccataatacttcacacattagacctgtcagcagaaacaggagtcatgttggcagataactaacatgggaaaaaaggcatcaaggtaaataatatgccaacacttataatgcaaattaatggttaataacttaatatatgtcactttggaccataactttgaattgaggttcaatcaagtgatactgggccattaatgtattccatctcacaagaaaaataaagatgatagatcagcaaaaatagccaagttcatgtgctagtaagttgaccaagttatagaatcagtaccatgttgttcaacaaaataatcgaacaaaactcaaattacaagatggatcagacataatagctaaatcaaatgggagcgaacttcaatgataaattggaaaagacaaggtggatcatacctagaatctgctgaaaatcaagcacatacaaaatagaaaagaaataaatagctaccttcttcaggaggctcacggaatcgatcgatggctctaatatctgaaagcttaacaccatcaacactaaagagacctccatgaacaacaaagaccttgttgttgatgacatgagcaaggggtaggcaacagaatgcttccgcaaatagttcaataaatgcttctcccaacttcgacctcacttctccctcaaaaccatatatcttattcatgctcttgctctcatggtttcctcttgcaaggtacatacctggatcattcaaggtatgtataaaggaaaccttattacatgaacaactaaaatcgatacatctattataagttagaataatgtaataaaagagctagtaaagtaacagattgcatactaatatctagttcatgaaaagtatcaaaactagcagttacctgtcggatagaggcacttgaaagcaaaaagagtgagtatgacttcaacagaaaaagatcctctgtctacaaagtctccattgaagaggtaaggattctcttccgagggaagcccattgagcttaaatatattgagcaagtcaaaatactgcagtggaaaaaaatattacaattccaatcaggctgtcagtatatcaatatgtaataaactaaatcaaatgacagctaaaattttagcatgtgaaattaccaatatcattttccatttcaaaaaagaaggggacacccagaagcactaggaaaaaaacaaaagcaatgcattcaaaaaatttaaatacctgaccatgcacatcaccacaaaccgtaaaatgacttccatcaggaacgttcacatcaacaagcgaaggtacagaacgcaatagctgcacggtttgtaacacaatctggtaggcgtacctgcattatcaacctaagtagtaaacaaccttggggaaccaatataaccaaagaaaacacttcaggtatgtcccttgtacaaagtgtaccttttgtgtatgcatttctgtttctcaaactcatccaacatagccttgacaaaatctaatgttattgtgtctccatcaactcttggtcctgtatattgtggctctacttctggaacatacaaaaaaaaatattaaccacaatgtcaactaagcaagggatatttaagaaaataacaaaagccatccacccagaaagagatgttcacaggtaacatacgaaagagccatagtacactactctgtaggcattggtactgcaaatttaaatgaaacaatagcatagaagtaacatgagacaattaggtccttatattatagaatgcatccgcttggaagtagcagattcataaaagtgctaaacagaaaactcatcaagaacaacttttctgtaggcatcggtactgcaaatttaaatgaaataatagcatagaagtaacatgagacaattaggtccttatattatagaatgcatacgcttggaagtagcagattcataaaagtgctaaacggaaaactcatcaagaacaacttttcagttatcctgggaatccagggaagtacgaatttcatgagactagcaaacactccctctgatttttttttcctcaaatggcattggttactcgaaaaatgaactaataaaacaaactcgtcaagtttgactaaataacactaatatatccaggccataatcatacccaaggttggctttgtcaaaaagagtacatggacctagcagagtggaaatatgttcagaaagtaaacaccagatacctatgatacggtagtcaatagaatcagctacagagcgcttctcttcatcccctacagaaattgcctcttcaaaacggattttctggacagctttctcacactctttcaatttcctagtagcatctggatcattagggctgattcttttcacctagaaagaaaagtagacttattaatgtaccacatgaaacaaaataatgtggttcctgctatccctagatggtcaccaacattaatataaagcagcaccaagaaaagcaagaaaagtgactagaaatagtcattctcaatcactcaatctgggaagagaccacaaaactaggaaaacaaactgcgcacctgttgaaaatccttcagagcttccttgaacttacccatggcaagatatgccgctccacgtcggtagtaaccctacaaacaaaaaaagggtaaaagataggaacttgcaaacctgtggcaggaagaaatggcaccatcacttacttttgagtatctagcatcaatttcaattgcttttgaagcatcttgcactgcacttccatattcctctaactttgtatgagcaaatgcacggtttgcccagtaaactgcatttgaactgtttagctcaatggcttgactatagagctctatagccagggagaacttgtttgctgcagaaaataaatagaaagattatccaccagggaaatattcctttagaaaactttgggaaatgctgcatacagcatgagagcccgaatcttttattttgtgagggcaatatcaatagcctgctaccactcagatggatataaaatataacacattagagtacataaacagatactccctcccgttacataattcttgatgttttggacaactgacatggtctccaaaacatatctttcactatgattttctattaaaatatatacaaaaaatatgtaaacaattaattttattgaagtactgtttaagaataatctatgcatcatgttctagtgtcttcaaaccaaatatttttcacgttattgatagtcaaagttctaactgtttgacctcaaccttgtccaaaagtcataattatggaaccggagggagtagatataatactaaaagccttattgatcaacaactattacaatttcatgttgattggtattctaaataagtgttattagcatgtaactcacttatgtcaacatttgaaactctgaattacaactcaaaaacacatgcagttctgacataataaaggatgaggacatgaagtggatcaaatcctaacatacctttaaaggcatcatttgctttaagcttgagttcttcagacttttgctcatttaaactggagttggcatccatgatagtttcccttgagctttctccagtaaatgctacttcatacacagaatttcaagtcctgtaccaatagaatacatttgcagcaaaaaataaattaccagatataattaaaaaatgcaggagtattacggctacggacaacattaagtagaaacaatgccccagcatattgggtagaaaaatcatgcatatttcacaccaagaggcatccatgtattagaaacaattagcctggagtgtggatcataaagcacgtgagcaaaaggtagaggggctttttagaaacattggctgcggctgcggctgcagttgtgctgtagccgtctaactcgcccaagcatggctgtctttaaggcagctgatggctggttgctccagcgcagctgcactgcagccagcactgccaaacagctccagagaagggaggctgcatatggtttatttccatttcaagccatacctaaatttggtaacattaacggaattggccatacttcgtgacttgtagcctatatagcctatactttagcagaaaatatgcccaaggtttaacatcgctagattttggtaaggctcgtttggacaacaaaccagacatgccctaaaaactacaaggaatcagaattgccaggaaccaaagttaaaaagtaacagagtaatcattcttatagagatacgaatacaggatgggcagtgatttcctgccaaaccaaggtttggacaaggccctgcagaccatagagctgatccaacaaactctgcatttctgcagatacggatacattttgcatattggagatctcttcccccaataaccaacaaatcacaggctcatataaggctgtgttcttcactcaactttcccaaactcaaccctttcgcttcccaaactgctacacgatttaatttttagaaagtttctataggaaagttgctttaaaaaatcatattaatccattttttaaagaaaaactaatacttaattaatcatgcactaatgagtcgttctgttctaagtgcacgagggattagttcccagttcccacctccaactaccaaacacagcctaagcctatctgaatactcacatctcacctgagcttggtcggagttcattagacataatcaagaacaaagcatgcccatttcacatgatcaccaactgttccattttctaattctcccacattttagatttaaattaatataatgctaaattcagaatccattctaatgtatcttccgttgttttcacaatttatttaatattttggaattaaaaggtatctaattgtatttgtgttggagttttagtttagcatgtttcatggattaataattctaaaatctggaatcgatagatattgagttttactcagtttggagctctataattagttctttttcacagtttaataattccaaaattcagaattattaaggagtagattacatatgatatatggactctctttttaaaatgaggtggactcttattttatctaaatgatttgtataatacaaactcttagtatgacatatggccacgtattacaatccacctaatcaacggccagatctttctagttaatgttgtccctcaaagagccctttagaataggtaaatatataccattatgaagttaccaattttgaaaaatgccattatgaagttgtgccttagaatcatgccattgcaatatgaactcatggttcaagaaggcagctagtcgggcagctaggtggcacctagcgcctaggtcaacccaactagtcaaacccaagaaattagcaagcatattacataaaaactagactatataacactagaatagcgacaaaacatcacccgaggtagttcagccgcctaatgcctaatagagccagctagccggtgccactccacctatcccgtcgaggtcaaggtcggcatccatctccgtctcgcctcctacccagctctagccctgtctggccatgctcagaggacaccgaacagcagaggtccaccccctgcgagctgaggccgccagccacaaccagtgattttccttcaccaatcttgtcactggagcttgtcatatggccattctccgtcaatatgtcggtggtagatgagatggaagcaatggaattaggtgcaggaatgaggaagataagaaaaagggaaacatggtctaaatatctccacattggcatatttcagaagatgggaacttggtgtggtatgtaaggcagagtaaactttacaattgcaagtttcaaaaccttttactcctcaatggcacatatcaaatagtttaccccctaaacataattttgatactatggttgttactgttgattgaatagcatacccaaattaagcacgaaacaagcatttgcaataagaaatcttagcagcagaaacaaaatcgtccatacacatactgacacacccttatcatcaggagcagccatggacacttgacaatctgtgacagttcactcaatactgtgacagtgcagcccagaatttgatttttcttagaaaaccaacaaatccaagagttgaaaactgactcgcgcaaccgctggtcaaacatgcagcaaaaaggagggcagggaaaccgaaacattacgtgcagcctggagggagaagggagccgaggcagcgtcgtggcgcggcccgaaccaacgaagcgcggggtggcccgccggcgatggagggcggggtggcccaccgcgcggcggcggaagcgcagggggcgagggtggcggcgtggaggagacggcggaggagtcggtggaggggagggaatcgtcggctgcaaagggggatacaaccggaacaccaccaatctagggttgccaactgggccggtggatattttgcgtggcctatgggaataagttcacctgacgtcccttgattgtacgtcgagtctgtcggaggtcacctaaccgcaataccagaaatgagtgcccctgaactatgtaaaaacatccaacaccaaaggtaccagatgcctggtttcgctgacgtgacatcgtaggttgtaaaataaaataaaataaatatgtgaggcacacatgtaattgagagaaaatggtgtgggccccacatctcttctttcttttctttttctcttctctgctctcctctcaagcgggcacgcagcggcaattgggggagaggcggcccgccggtggcggggggggggggggcgctagtcgatgagcatgagcaacacagcgcctgggtgtgaccaatccgggggcgtggtctcgttggccacggcgagtagctgccacccaaggacagcgggcagcgggtggtggggtgccacggtgaagatgatccaccaaaaagggaggcgcaacgccaggagcggcgatgattggtcctcatcggagtcaatggcccgcaagcgcgagcctcgcggcggtgcaacccgcgaggtttgtttcaccgacgatgaggcccgggaggtgaccgaaaaaagaaattttcccattttggctcaatcatcttctctctctctcctgctgtctcgttggccacctctctccccctctcctactgtcgctgcccccagatttctggccccatacaggtgaataggctggaatctaggtgccgttgctaatgtactctaatgggaagcccttccaagctgcgacgacgatgatgtccacgcagcgccggcggcacaccaccaccagcacaccaagctacggcgggggcgggctcgaacatggcgacgacgtgtgcatggttggagtagccgccaccgagagttggagcagcgggaggcagggcgctgctacctttttttcttcttgcttacatgtgggccccataacttttaattattttttgctgactatgatgccacgtcaacgaaactactcatatattgccatgggacctaatttgcacggttttgtatagtttagaggtgaagatttctggcattgcagattagggacctcagacagactcgacttaaagttgagggacgtcaggtgaacttattccacggcttgtttgggaaaccctaaggcttttaagagtctgtaaaatttggattctcggcttttggtttctcttttattttctagattctacaacgtagtttcttatttgactcctttcttttcttcaactccaaccttcaactttctcgtttttcattagcacacttttcaaactgttaaatgtttttttaaaaaaaatacataagttgtttttgaaaagcaaataaatccatttttcaagtttttaatagttaatatttaattaaatatgtgctgatgagctttttcgtttcgcgtgtttagaggagcttatgatcctaggagaagctccttaaacaggtcctttagataggcacaacgcttttctatccaactaaggtgataacgggtcttctttgttgatctgaggccctattttataagtttaagattccaaaaaagagatgattggtaaccagtacggcatcctaaactcaaatttaaaaagcaaagttataccaataggagtaccttcacaccatattgtttcttcacttggagggttaccaacgtcaaggtcatttgatcatcgggaagatctcatcttcttgatctttgacatttcgtcttccatttctcaaatgattaatgcggataatccatggcttcaaatgccctcgcacggttcatcatgacacagtcttcactcgcccttcaccaccggtttcggttcgtcggcgccaagccccttgcttgcccttcaccaccgcattgttcatcgcagctgagcgtcgcttgcgcttcaccgtcttgccataggtagtcacttcatacccgcatcttcaatatcttctctttaattatcatccatcgataagtccatttcctagcttcttcatcggactaatcacttgcttatacactcaataagtgcattagacccttaatcgtttgtcatcaataaaccaaaacccactacaggcatagatgctctttcaatctcccctttttggtgattgatgacaacacgattaaagcttacaaaagattgataaaaaatgattttgcatccaaaggttagtttgagctcccctaaatgtgtgcatacaagtttatgaagtgagcacatatgcacatatttttgaaaatgagagagctccccctaactctttgcatccgtggggtgtattgtgtgtgaacgagataccaaaagtaaaacaacatacacaactcaaattcttggcaccaattcaaaatgtatcaaatgaaattctcgatgccaattgcaaaaacttgattctatgccaactgattccggttccgattgagaaagcatgagtaatcaagttcaagtatcaaaagaaaatctcaattgcatgtggcatggagatcaaataataagcattcacgccaattgataaacacttacaaatattctctccgcctttctcatttactcttggacatctttaaagcatgcatttcgatgatttctcacaaatatctcaccctttgatcaatcttttctttatcccctatagaatatttctccccctttgacatcaaacaccaaaaggggcataagtagggaaagaaaagcaaagggatccttgatgagggatcatcgagtacttacctctcaattttatatttcatcacttgtgattaggaaatgaagatcaatttcacataaagatcacaagtaaatcaataagcattgagaaacaaattttgagcatagaaagctcacatgcaaaggatgtaaagcatagaagaaaaaaaaatctcacctaagattttcacaaaacatttcacaaaa

SEQ ID NO: 27487 - DNA, 10717 bp, Oryza sativa
aaggaatgaaacttggcctagatgcacagacaaggcaagtgatccaatcataccaatttaaataacaagctatggatcgtcgagttaccttccatgttgatttttgagatgcccattcaataaaattgatatcttgaacccaatttgaaattggcaccttgatgggtttgatgaaatctcttccttgatttgcttgattccaatcccgagaaagaacttaagctttcccatcacgaacatgtttaactccttgatcacagtctgcgtcctgataatgcttgtgctcttcttgtaaggccatgacccgatccggtttagcatttgcaccatcttccttctagctaatagtccaaagacaacaagagagagtaacattcacaaattttgtaaattgagaatgaatagttactccctttttgtaatgtcattgaggatgttgtagggaagatctcgttgaatgatgtggtgaattcttggatggtacaccgatgggacttgagcttgcatggtgtaacttgctcttgagtgctcttggcatcaatcccatccacttgtaccgaaagtatgttcttcatagtcaattgcggcaggttgaattgagttgattgaggttgatcaagtagtccaccttggtcatcatgggcttcttgtggtctcacctacccaagtgtcttcgaagatgtttttaacctcctatgagactaatcacaaaaatacacttgataacaagttagtctcaaaaacacaaaacatagggtatactccccctaaaagtgtgcatccaagttcttgaattacttgtagaaatgcacttgtttgatgaaaacaaatggggagtatagcctatattttggagaaaggcacataaagtattctcaagaaaacacttgtgccaaaacataacacacatcataaaatgagcatgtagattatcggaagatattgaatcaaagcatgacaatcaaccataaaaaaaactatttgggttacccgtgattcttgcacggaaggataacctttaagtatgcatgttcttgtgagcttggagccttcggcctagatccttcgggtaaccaaggaatcttcctggagtctccgaggtatccacccagagccttcgggctcgatggcatggtgatagatgagcttgattacaaatcgagcggtcttatcaaagcctttgattccacaataaaatctgcaataaaccttgtagataggtcatagaacattgcatatttttcattttgggagttttacccaattctcaaacaaatagaagccacaaaaatcacaaaaatttagaaaactgaaagtttcaggattttcagaatttggaactcaaaaagagcttgaaaagggcatcataacaatattcaaacgactatagaaaaatccaagtaaatttagatgtgaagtccaaccatagaggaacaaaagtcattatatatactcattccagtttgcaacctattttgagatataaaaatcacaaatcagtcaaaaaccatgaattttctaaaaatttcagcaacttgagcaaggtgagaaaaagtcaaattctttccaaattaaatcggaatgatgcgaaaccttgcagaaatgatcttttcacttaatagaaacttttccaaaaagaatttctcaaaaaagatttttctatcaagagaaatgtcaaaaagagttttgtaggccattcaaatgaatatatctcaaccaaagtgtcaaatcacattcaaataagatttttatgaagtttgacatttggaaagccttagatgggttagagatactaattcatgcccatattcacaaagaattttggctcaaatagttcaacccaccatatgcaatttttggccaaaagaggtaaagtcaagatttttgatgaacttcacaaggctgcaacatttgaatggttggtcttttgaaaaagctttgaactaaaaatgtgtttgaaattaccaaccctaaaagttttgtattggcaactttttcaaaaactcaatagattttgatttggggtaaaatctcacttttaacaaaaacaaagatcactaaagatcctgtttagacaaaaaagagttgttttcttttgaaaataagaaattttactccaaaagctttggaaaacatttcaaacacatgttgaaatacttttgaaaagattttcacaaattgtggccttttacatacgatttttgacttttgactaaatatgctcttttgaaaacaatgaatgcaacttttgagatttttcaagttttgagagcaagagatacatgaatgtggtttgcacaatttcactctaaagtatctctcacttgaaatcaaagagttgaacatttaggttaactcataagattgagcaaaaagatacataaaagctcactattcaaaaaccttcatccaaaattcaagaaatagcaaatgagaagattttggattgcaatacatatgtataagcttgacgtacctccatgaaccaatatatatcaagatatatgattctagtggcaaaactcacttgatgatacaataggaccaaatagcattttaaagactatcatagcatcaatttgagccaaacacatttagaggatgcgaatgatgagaggttatagcacttcccctaaatgtgataaccaattactcaaattcaacttaagcatcaaccaagaaatgtttaagaaaagcattatgcacaagcataacctacacaaggttaggacataagtatttaaatgtaaatacttgttaccgagatgacattggttctttatatagaacaactattctcgtatttgagtccaattttgcgtattgtgtgaacttaattttccacaaatgagtcaaacctccaatgcatctccaagtacctatttctcactttagcacattttggtccccaacaacattgggtccataaaggttagtcacaagagacttagacaccgaaatggcctttgtgctagtgtgtggcgaacaaatcaccctagtagcacaaatatcatttttggcattcctaagcaaattatgatcaaatgagagacttggcttaggaatgttacccatgggacaatttttaccaatatgtccctttgcccggcaattttatcaaagtcgacttttgcttctatattgcttttcggtttgtttgttgccggtttgcctctcacttgatgttttgcattgttcatccaatgtgcaaggagaccttgaggcaaagtgtcccgcttcagtgcacttgaagcacttgatgtgaggaatgtccttcttcttgctcaacttatttcctttcttccaagggcaatctctaacatgatgtcccactttcttgcacttgaagcaagtaatggaactcttgatcatcttttgatttcgttccctggtatgatcattgatggacttgatatccctttgatggatcttggtgcacgctacggttgatccctttctcaagcttattcaccaggccctcacggttttcttgagaaggtttgagcaatacacacaagtccatgatccatttgcttctcccttttgcctacacaatccaagtcacatatagtgctcagggacatgtttgcttgggggaaacaagggttagcacaagtgagattaacttgaacatgaggctcataggattttaccgttgcaattatcacctcatgagatacctctagcatagcatgagaatccacaagattcacatgagaacacaaaagttcatcatgtctttcttgtaaatccacatacttgttagtgatctcatcaagttgaaatttgagctcttgattttgcttcttcaaagatgctacacaagcaatagaattagtggcacaagcaaattcattttccaatttttcatacctcatagtcaatgaagaatgaaaatccttaagtttcttgtgttcttcggttagactcatgatttcttcattcttcttgatagtgcatgcttgttgcttttgaatggcttccatgaacttgatcaccattgttacatccttcttgctcaagtgatcaaactcggagtcaccatctacacccataaagcaagcataatcttcggaaatagaagatgagcatcttggtgaggtggattcttcacttgtccattagcgctcatttacttcttcctttaaaaggttagttccacatgtactataggaggtagagcatttatccatatcatcctcacacatatacttggggctaggtgagatgcatgagtcaacaacacaatgcaatatgacaatttcattatcggtgttgttggaatccaatgggagaattggatgatcgtcaaccttactcaccaattcattaccttcaatgtagtcatgtgttgataaggtagacgtgggatgattatcacgatcatcgaaggtagttacttgaggttcttcgcaatttggcgatgaagttgaacacttctcaaatggttcttccaaaaagagtacatcatcacatttggacttgccgtatctctccttgagtgtagtccaaatgagatgagcatcttcaagcggcatgatggttttaaatacatcttcactcaaaacactaaataaaacattagtaacttgagcattgagatgtatgcatttctcttcctcttcaaatgatagcaatttatcattaggaggagaaatgctcacatctacaactcgctctatttgaggacccatggtcctaaatatgtcaagtatgcgagtactccaagaatcataatttgagccatctaaaaggagtaaaggaaccatatccaccaaaccactagtcgatatctttactctctaagcggtaaagccctaaatagagagacttggctctgataccaattgaaaggaccttgatgtcgcctaaagggggggtgaataggcggttttaaaaataaatgcggaagctataacaaaacagggtcagattgtctaatatcaggtcggatagtcctatgtgatcggatagtctgaactgatattagactatctgacctgcacaacaacaatataaacaagagaacaacctaagagctctagattcaatccacaagtaaagaggtgagctcgaccaacaacaatattagcatagcacaaagtaatggaacaagaaggtaaagagagtgaggaattcaccgaggtttacgcgccgatgtatttcccggagttcaaatccttaaggggattctagtctccgttgaggggctcgcaaagagccgggtctttttcaaccctatcctcgtgaggttgcacaaatgcactcctccttccactaagggtatctctttccttgcggagacgagatccggccttcacaaacttctcttagccaaccacacgtagatcggtggcccaagaacgacacctagtcgtctaggagtcctcaacctccaagagtaataaacaccacacaactcttggacaaatcctagtgctcaagattaaaacaaacacacactaggctcccaaactccaaatccatacacaaagatccaagtcacaaagaacaagggggatttgagatagagagggagagagctcaaaaatccaaagcacttagcacaaagctcaacccaaagcaagattggaatgaaatcagtttgggcaaccctagaaaagggttggtggggggtttatgtagatccccccaaaatgtgaccgttggaggggaatctttcagcccacgtcggatagtctgatacaagatcggataatccgatattttaaacctccaaggcaacgagaaacagagaacgaagttccatgaaatttcggactttccgaggcatcggactatctgatgttaaatcggagtatctgatattttagaagcaaaaacttcgtcctcaaacagagactcaagttctatgaaatttcggagtctttgtatcatcggactatctgatccaacatcggatactccgacacttagaaaaactcactcgaaaggatttttcaaacaaagacagagagtgaagttctgtgaaaaatcggatagtccgatacatcggatagtctgatttcaaatcggatagtctgatgttgctcaagtaaaaatgcaataactttttactccgaactctgatttcgaagatcttggactctatggaaagctagtttcgtgagctatcaaacccaacataaaacatggtcaaaacattcaatagatgttgaaacacttgcaaagaaacccggtgtaagtgttgtgacaagtgaaacaactcgggattaaaattttggcataggtttttcaactcacacaaagatgaagcattttgagcactagtattcaaccaattatatgcatgtggtatccctcttaatagtacggcatcctaaactcaaatttaaaaagcaaagttataccaataggagtacgttcacaccatattgtttcttcacttggagggttaccaacgtcaaggtcatttgatcatcgggaagatctcatcttcttgatctttgacattttgtcttccatttctcaaatgattaatgcggataatccatggcttcaaatggcctcgcacggttcatcacggcacagtcttcattcgcccttcaccaccggtttcggttttcgtcagcgccaagccccttgcttgcccttcaccaccgtatggtccatcgcaactaaactaagcgttgcttgcgcttcaccgtcttgccataggtagtcacttcatacccgcatcttcaatatcttctctttaattatcatccatcaataagaccatttcctagcttcttcatcggactaatcacttgcttctacactcaacaagtgcattagtcccttaatcgtttgtcatcaataaaccaaaacccacttcgggcatagatgctctttcaaattgtcaaggatataaaaaacagagagaaaagaatggcgcacgctgtacatgggcagggagggagggaggtttgggatgtttttctaaatgattaatctaacagactaaaataatgtgtcagatgtttatgtcgaaaccgatggtcagatgttttattttcttgtcagaattttattaggattttctttgatttaagagaacaacataatatcttaagagcatttataagatgtgtaatcatcttttaacaccgtatgccgcaaaggagggagggaagaaggtttagggtgttctttttttttaaaaaaaaagatctaatgacctaatataatgtgtcaattaatccattgaaaaaatgtgtccatcgatttatgtcatatctaatggttgggttttttttttccaaaacttctaagatttttctctaatttaagaacgccatatagcagcttagaggcatttataatatatttaatggattttaacaccgcacggggatggggagggaaggagggagataggtttgggtttttttcttattaaaaaactaacaaatcgatagccaaatgttttgttctgtttttaagattttctagcattttatttaatttaatagcaccacgtagtagtttagaggcatttgtagaatatttagagtcacagagcgagagttgctagacctaataggtggaggtatctttgtgatttttttgatgtaaaaataattttgattatgatttctcatgaacatagctcgttggtacgtatgtgacgggaggttcggaatgtgtgcttttttaaaaaaaaaatctaaccttctaatataaaaataatggatcactgatttaaataaaaatcgatggttggattagagtgcacttgacgacctaggagcgtttgtaaagtaccatttggtgaattaaaagtatttataagatgtttaatgaacttttattatataattgtctttttttgaaatttaagattttatttaatttaagtatgtgatatagtagcttagaggtgtttacaaaatgtttaatggattttaacactgcacaggggtggggagggagggagagaggtttgggattttttttattaaaaaatctaacaacctagatccatcaatttaagtagaaatcgatggtccgttgctttgtgttttttaagattttctaatactttctttaatataatagtaccacttagcgatttagaaacagggagagctgctagttctagtagttggtctatttgtgttttttacctgtaaaagtatttttgtttagttctagtagttggtctatttatgtttttttacctgtaaaagtatttttgtttttattttctcattaaatagaaaataacacatgaatgaaaatatggaaagacaaaagggaagtacgtacagtacatacgcacgtacgttcgacattacgaacgttggttccgtatatgatggttctggattttcttttttctttataaaatagatctaactaaatccaaccatccaaaataatgggtccaccaatataagtaaaaatagatggtcagatttttcttatttattatggtgccacttggcgatttgagagtgtttatagggtgtcacttgacggtttgggagcgtttataagaagtttaatggatttttagtatataatagatagatttagtaaacacattattttgtggatttaatcaagatttgattgagaatcggtgccttctaaaaaaagtttagattgatacaaggaagtcatatgccttgaatagtacttctataaacattaattttggataaagtttagaccatgtattttgggttcgattacagtttgcccataatttggaattggaacctcatggttgcactttggaccagggtacctatcatctcccatcatgcttttgctctttctctaacttgatgaaacagacaatcactccaccatacacctagtttggagaataatattatgagcgttacttatagaaaaatgttgcattttatagtgtaagggcattgacaatacgatgacatggtgagtggtgtagtgcttccccgtcagttctgaactaccacatcaattaggagagcagcctgtgcatgtaaatatatatgctaatgaaagaacagccttgtcttacaaattagcttgccgaaggaggtgtcttggggtctgtttgagggagcttccagattctcagaagttggctaccaatcagctgcttataattttaagctccccaaacagacccttgtacaagctcataacaattgctttttttgacccattaaagccaccatgtaatgaaatatattgtactcaacgatgaccttaccctccgtggcatattcgtctctgagactacacaatgagacaacttcgcgttgtacatgtcctaagaaagcccaaaataacgtgttgtcttgaaatatagagataggcatgcatctctcgagctaatattcccatcgaaaaagaatgaatcagccgagttaaaaacatataacattttcttttactagtacaatacaacattaccagcatttttcttttctcacggatccatccatgtttctatctaactactgtagtataaaacttctgtacacatgcaagaatcttttacaagtttctgtgatccaaccaaaattcagagacttctgttctgaacaaagtagagcatcaccatcaatccatcacatggcccctatcctatcctgtccactgcccaccaattagcgaggtgcatctcagtttcggccatcgaaaaagcagaggcctctcttctttctaatcttcttcttcctctttccagacttcaggatcagaatcagatgctgcagagcatagactgtacactgtagttccatcgatctcccccaactgtatttgtcagccaatgctgattgcggctgttttcaacaagtcttctctacaatactgctaatgtgggtcgctaatataagaacccattagacatgaaacccatatgtcaggcactcaaaatcagagagatctgtttccgcctcgatgtcgccggaaatggcaacagatcatcatcgtcaacaaccaaccaaccaaccaccagacgagtagaaagcttctcctacctaacattgtagttggcgccatcgccatgaaaggtggtaccacacacgatcacgtcagcgtctcgagctattagcaatcgcagtcacactcacatggctggtcgtcgtcgtcgtcgtcgtcttcaacctctggacatagctattagctagctagcattattgcctccggcgtttggaggtggtggccgggaagcagctgtcgggggagcagatgtcggggacgaaggcggtggtgtcgggtccgccgccgccgccgccgtgagtggcggctggatggcgttgccagtggaggccggaggccgtcggcggcgaggggagctccggcaccgaccactggatctctggtacctgcccgaagagctcgtcggcgttccggtcatcttccgatgacgaccggtagtacggcgagccgtccgtgctccctcccagcttcccgctgtcagcctggtccatccatcaatgacacgacaaaattttatttcaataggattttaccaagatcaggatatatcactagtttccgtatcttatagtataatattagacgatgtattcataaaggttgaggtgtaattgtgatgttacgtgtacaatggtgtatgcatcttctgagtttaaatagtatatattgcgagaatttcaaaaagaaaattgtatccggccaaaatttggaaatagaaattgtatctagtaattctttattttttttagaaaagaagttgtatatattg

SEQ ID NO: 27488 - DNA, 965 bp, Oryza sativa
ttaaaggtaatgtggtgtatgagttgccatctaattaattagttgatgatgtgaataatattagatgcgacaatcacctcaatcacaaaactcaaaaggtaactaataaacctttttcccatctttttaatactcccccatcccattttaagtgtagtcatggtttttcgcgtctaactttgattgtccgtcttatttgaaaaaattttgaacaaatttaaaaacataagttacgagtaaagtactatttatgttttatcatctcataacaacaaaaatagtaaggggctgttcagattgatgccatttttaaccataccatttttttggcaaatttgtcaaaaaaaaatatatgcgtttagtttgttgccaaatttgatgaatacataagaaatcttgctaaaattttagcaatattgtcatcttgccaaaattttaacattggtaaggtttattttgtctacaatctgaacaggcccggcctaattataaaaaaatttcaaataagacggaagatcaaaattaggcacggaaatttatgactacacttaaaatgggatggaggaaatactatagattaaaactataattttaaataaatagtgggagtatttactgcagacactagtacactacccgttgagactgcactgttagatccacttactgttatatctgggacatgcatgcatgctgccaatgaagcagctggccaaacgcagtcgatcgcctcgagacagccatgtacagcactacgcgtgtgagactgtggaagggagtacattataggcctggtttatttcccaaattttttttcaaaaaccatcacatcaaagctttaaacacatactgatagcattaaatatagataaaaacaaaaactaattattgcacaattttcatggaaatcgcgagacgaatcttttgagcctaattatttcatgattagccataaggctcaaaaa

SEQ ID NO: 27489 - DNA, 4945 bp, Oryza sativa
ggagctgcatcaaacatgccctaagaaacttaacgccagctcggagcttcgcttcaaagacaagaccgagcggttcaagttccctgcatgagtgtataggcgcaaaggcaaaaacaccacccatcttgtagagaatgcaacacccagtgtgtgtgtgtgggggggggggtggggggggggcagtaaaggtggcgaccttgtacactctcgccatagtcatggtttagttgacgaacatgagacctgataggtcccccttccacacgttaacgttggtagggactggctctcacgtggtgctctatagtctcctctcactccaaatatagctccatcctcgcatcatgagcactgccctcgttgctccattcaccatcagtgctgatccaacggcggatgtagtattcactcaacaattataaatcctatttttggttcttagtaagttagggtccgtttggttccttggtaaaggctagcctagccttacctagcaaggctagctgtttggaaccggttaaaaaagctagcttttaggagcaatctagccttgcggggcgagaaaaatctcgctggctcgggagagccgatttggctagccttcgacggcaaaactctgctcgcacactaggaagcaaaccaaccaaaaacacagtatgtacagcaaggttagcaagctggcaatgtgatggtttagcttagcggagctaggctagctgggcgaagcaaccaaacagacccttaaagtttggagatattttactttttgcgattacacgacagtcggcagacgcatacgcacacacaccattacatgcaatgccaaacacacatccccatgaatatgtcacctaacatatgctttaagaaatggaaaccagtggcatatccctaatgtcactaaatccctgttgaaagcgtaattgtatgtgcgtaatattcatgcgcactaggatttaaaccctattgggtaaagccatgcaccccacaatttcaccaccacaccactggtacttgaaggttattttatcttgattctctatgcgtttttctcaactcaattttttaatttcttttgttgagttagatcaatattttgaatcttaatttgttttaagtgcaaccattatatggtaaaagttagaaaataagagagtgtacacaaactatgaatgatatgattgtgattttttttacattgatgttgaattttaattgattaagatataactaattttgaatcttacagtaatttagagattattaatcttagagtaatttagaaattagtaatgctgatttttattttgagtaatttagggattattaagcttggagtaatttagacattattaatgttgaactttgattaatttagatattattatttttgaatatttgagtaatgtagagaatgttaatcttggagaaacttagaaattatcaatcttggagtgatttagagtttattaatcatgaatttagaaatttatttttttagatgtgtaccagggctctattaattttagatttatttttcgtattaagtggtatatgtatgtcaatgtttaatttgaattttttttagatcgatggataaagatggatctacgaaatgccgagcggttccttacagtcagctagcggagttaccataaccaacttgtgaccgcggcgacgagtttctgatcattggatgcactggaatatctaccttggtcatgcattgattgtgggagcaagagacagttttatgagaaacaagtccactcatatctcataacaacggttttatgtctaattatacatatcaagataatcatagggttttatatatacatagtgaagacgagaatatggttaaccctcgcaccatttccacaaaattttaactcaacgtatctattcatcatttttaataatacttgatttaaaaaagtacagatatgattatgaaggcaattctagagcttaagcccaagctgccctatctgtcttgcctctgctccagttgtgaaatatatagatgaatatgtgtttgtatttttttaagaaaatcaatatcctattagttaagtcttactcgagctttaggcttacaagatttctagcttcactataatagcaaagcacgaagtatcataaagtaataaagaattaaaacaccagcttgatcacacacacccagaccattcacagtgtgacacggagttttgctgaacctcacatgtctcctaggtcaagaacgttgttagccacatgcttcacaatgcaaagttgctagtagtaggtcccaccactaccatctttctcactttttccctttatcctctcccctccctctctctctctcagcaccgagccgccggacggagacggcgaggtggacgggcaacttcgcagctctccgcccaaccgccgtccacgctcctcttccccaccatcgttggcaccgctctccctcccccctctcagccgcccccttttccctcaacacttgcgcaacctttcgctccatcgccggccacactcccctttcccaccatcgccaatgctgctttccctccctatccgcgcccccctcccctttcctcgtcggggtggcggcggaggaggatccggccactcctcatcccctccttgccagatccggcgggatctggccttgggaggcggtggcaactcaacgacgacggcgggtgctcgacgatgccaacggcaggaaccgcaacggcggtagctcgatgatggcggtggggtaggttcaacgatggcagtggcggctcgacaacagcggcaacagctcaacgacggcggcggaggaggaagtttaggagggcaccagctccgactggggcatgagcatgaccacccaacgcggtttcttttgtcaccgagtgccttccacctgacaatccctgacgaggtttgtgcgttcaatcgacagcttgggttcttcttcactaggtcacgactcacgccgacgtggcatggaatcttcgagctggcgagacgagacgaggccgaatgtcatctcaccgcactgcgaatggcctcgtaataatgctcttcgtttcatcggtcgcatttcgcctgcgcaacacacgtacacaaaaaaggaagctggatgtgatcacacgcatatattcacgtgaagaaaggtacattggaacccattattgagggggggccatgctacctgccttatctgacatgtgatctgcatatatgctgccccagaaagagaccatccatggatgctacatgctccatttgccggagaggccggtatgggtcgatcggaaacgtcgacggcggtgaccgggtccttttctcatcctcggagatcacagatggcgatcgatcaggtccctccatacctgtaccaatgacctaacgcctgttttagttctcaattttttttttcaaaaacatcacatcgaatctcatgtactagatatatgtttaaaaataactaattgcatagttagggggaaatcacaagatgaatcttttgagcctaattagtccatgattagccataagtgctcagtaacctacatgtgctaatgacggattaattaggcttaaaagattcgtcttgcggttttcaggcgagttatgaaattagttttttcattcgtgtccgaaaaccccttctgacatccggtaaaacattcgatctgacatcgaaacattttcttttcgcgaactaaaccagccctacgatcggtcaggctctccctgaaaccggaaaattttgactggaattaattttgtaggattattaattaggcccatttagttgagcttgccttttcagctgccacttatactgcagcttggatcctctgcagtagtagagagcgattaagtatcctataatataacataaggttaattatgcaattacatagctagtattggtttgggattctttgcattgaagaagaagaatgcagaggcgctatagtccttgcgttagctcatgttctgatgcgttggatcttcatcgaacggtacaaaatcagcatgctacagcaaaaatgttcgacggtaaaaccgattacggttagaacacttttgcttcggtgtcgttcagctgtcctaatacatatcactgtagcgcatcactcagatcaccgtgtaaataaagttctctgtagtacatattttagatcatatatatataaggacatcctgaataaaagctacagtactttacgcaatggaaattccagtgctctatataaatattaggatactttgatagaatactatcaaaatttggggcgtggaagaccccaacatcagggcaaaaattgcagaagaagacttgtatgcatgtgctaccataatttggcatcacctcaagacataacaaacaaccttgcatgctgagtacgtagctagacgacaaagataagtttatgctgcagcacgaagacaatcaataaaaagcaaagagtggaatcgaagaaatagcaatattacttaagcctagacaaacatgacttgattgtacaaactactatgcaccgcatatcagacctgcaccatgcagtcttgcttgaatgtggttgcctgttaatctatagactaaataaagcagcaagaagggtcctcataccgcatatttcggtagttctcattgttagcctgcatgaagagcacatggttctcttgccgctttatttagtttgtagatggacatgcaacacatacaagcaagactgcacgacgcagatctgctatgcggtgcaaatagtttgtacaatcaagtcttgtttctccaagcttgagtaatattgtcatttcttttattccactttttgtctttttattgattgtattcatgctgcagcataaacttatctttatcttttagttacatgcccatgcatggttgtttgtcctgtcttgaagtgatgccaaattatggtag

SEQ ID NO: 27490 - DNA, 4572 bp, Oryza sativa
caacttctcatgtctctagcatattcgttctagctgaaggcttatcgtctctttaggtagttccacccgaagggaacacttctctacggccacaggttatcctgatgcctaagcaagatgcaggttaacaatgagaactaccaaagagttatcacctacagagccccttacataagcactaagctaaacaaatagactgggatgtacaaaggaaattacttcatataaaacaaacaaagtttaccatttgtttacctatggttttccctttcaggaacccgcgagcttacaaatagagctgaagtattaccttcaagcccacacagaggtcgatctttttataactatattagttcaatctatgaccaaaattaagctgttcacacatgcatgcctgaaggaattaaaaacataatcaaatatacttcacttgctaatcctgctgtactgaaactacgtatatacagttctctcgcccgaagctcatggcggcagtagatggtgcagcggcggccgtggaaatccggaggtggcagcagagaggatttgagatgctccgactagtggcggcggtgacgcagaaccagaggtggctgcaaggattatttggaagtgggaggggtagctcgggcgagcggcgacacggccatgttgctggaagttggctcacggtttgctcccttgtacagtgcttgggaggtacctcagtaacaaatcaacaatccaccgttcattcatatagcatactaatttaggaataggaaataatattaacaagggtagcttagtaattgctacattcctatttgctttacataatattggcatgaccctgaaacctccctttgtgtttaatcctaaccctataccccgagtgaaagaacgaggttggagcaggcacagagcgtgcggcggcggtgacaggcgggagcgatgggcgcatgcggcggctacgaccgcggcgcgcgtgaagggcgcgtgcagcggcggcgccaattagccaagtcagccaagctaacttaatttgattctgggaatggtaatcttgttgaactcatgcatgattaattcttaaaaagtaagtgaattccatattggaccagggtttgctaaactttgtatttcacaccatctaacttgtcaaaaggttgcagtttggactaaggaaatgtttcggctgccagcttgccgctattgttcttcgtcccacctacatgagtgtgagtactcgcacgacagcggcaaatgaagtgctcgacgggtcttgctgtgcagacaatcacgcgagatgctacagtgattctactctgatcctcccaggtcccgtggtatcgtgtaattgtattcccacaaaaaatccattatggtgaactcacgtcgacgcagagcgggaggcacactcgaaatcagcgacggcgacggcgacggcaacggtcggtgacggccgcggtcgtcgatggcacactacgaaggaaggggagcccgtgcgcctccaccacagccaccaccacctccaattccaccttcgcctggaatgggtcggggaggcacgcttgacagtggcagcgaccgccacggccgccgtgagcttgctgtcctgaacgaatcggagaatatagatacaaatattgaaaagatgacgcatttgccattaactgcacaaatcaactatgaaagtcaattaccattttaaccttccacctctcatagttggtccacccttttaatacctttttcctggtacacgttggattattgatgatcaacggttgtaattaattccaagcaccgaataagatctacttgttcagggaggcagtgagggtatcacacacaaggataccgtcccctaacatctctgttaaattaaataaaattatttttaaaattacacggtataatgcagacactcacaacgcacgtatactcacccatatgaacgcacgtacacaaaccctacccctatgagcatcttcaaagattaggccggcaaatccttgatattgacgaagtcaccacagacgcctcgctgtcaacgggtacgtcgtctaccactgaaattacaatgccgttaaatcctgaaaatttcactgctaaggggagtcgaaccaaagaacaaaggtgctactgaggctcttgtaaacattaggttacatgtcctttcacaaattaaataataattggttgcaccatataaatctatatggccaccaagcagatgcccttgagtaggaaacacatggtgggaaacaaatttaattgctcaatccagtcataatgtttaggataaacttttaaaattctaaccatcttgaaaaaaccaatttacccataattagaaaactcaatgatcaggacatcacttcttcagatacacatgctactcctcaagttgttttgcaaggtccaatcactagagctcacattcgataattaaattttcaagtgagcttgtttctaagtacttctttacatggttttgaggatagattattacctaataatttaattatgattagaaactatggagagtaccatggagtgcatggagagagaggctaggagatagacaaggtcattatggatgttcaagttaagatggaggtcctactcatatcaagttcgagttgacctcgggctccaagagtagtccacactaaattcgtcgctcaagttgcatttggactccgatttcaatgttcatcatatgtatggaaagttaatgagaccacctttcccatgtatctagtcccacgtcaaaattccttccaagttaatgggaatcatcgaaacaaggagtttagaatctatcatggtgctgtgttatcgtctttgggttcattgggccgtgtatcgtctctagtccaataggtacgcatccaggggtccagtaaccgtcattgagttagggttgggttttacttagataatttctaccatcacggttttgctgctagatcggtttttcgaacaccccaacttcgaattcttgattaatcattatctgcaattgagttgttatctttcttgttcttacttgtatttttcgatttacacacagggattagccttctcggcgaggtcaactgggtttcagtgggttgataactagagttgacgtgatgttgcgattgtagggtttggattgtgttgattagaaaccggatcgtgtgtgtatacttttcgccaaattgatagttatcttcacctaacggaagatcgggcatcccgttgccatcattcaagatggttcaaaaatccacatccttgatttaagaaggaaacattagcaacataagaaacattcgtgaaactttgacgtataagagcaatcataattctagcatttcagttgctaaataatcatttttttctcccatatattactgaaagataaatatttttggtgtggtttgaaaaaaaataattatgtcggtacaatattacaatgataaaggattgattaattaatggaaaattttagaaaaatattatcgcaaagatacgtgatttgtaaaatacaatcgtaagtgagaataatatatggggctagaccttcatgttagcatgtactatatctgtcctaaaatataagaaactaaaactggataagaaatatcttagcttctctaaattcgtagcagtaggatatatctcatccaatcataagtttttatgttttgtgacagcaggagtaaactatacataagatgttcttttctaacaccttgatttttgcgattgtactaggcaaataggcccaactaattaactgcatagatgtaagtgtacctgcaaattagaactgttttctatcaacatttttatcatttaatatttgaaaaaaaataaaactgacatcaaacaatgtttaattgggtgtacacgtgcatgggttaacactcatcttctctttttactgggaggaggctagtggctgccatgcagcaagagacagggagtccgggctcctagctatgaaatgtgcagcctatgtcctggtcctgctgccttacatgggccgggctggctacggccattttggtaaacaaaggaataagtttactttagaaccctcaatttgtcaccgagtcagaaattcatccctacactaaactaccaggtacctgacttacagtaccgtgtcaactttgatccattggcagcatagagcctgtttgatagggctccaaactccaactccgatgggagctagctctagtgggagctagaaggtgggagctagaagtcaattgaaaagtgattggccagctacagaacttcggggctaggcacaggtgacggcatcggtggccagggcatggacggcggcgtcgactgccaggcacggcgacggcggcagtagccatccgcgggcggcggtggctcgcctcgtcgtcttccagctcgccatccagctcgtcgtccagctcgccgtccaccgtcccagccaggtgttgcagggccccgctcacccaccgggtccactgcggggacggaggcgggtggcgttttccacccgaccacctccgcggggccggggtcgggggagaagtcggggggtgggggcgg

SEQ ID NO: 27491 - DNA, 3449 bp, Oryza sativa
tcctagggggaggatgacaacagtacccttatgatttttcatgtttttgtgatgtatggctgattttttctctagaatttcaacaacgcaatttgcaaaatcatagtaacctgggaaattacatatctctacaaaaaatcacccaatatacatgtaaaatcaccctatttctctctctctctccagatctgaaatctaaaaaaaaggaaaaattgccgagccgtcgcccgcacactgtcggccgaccacacgcctcccgcctgcgccgtcggccgaccgcgccccgcccgcccaccaaatcaccaccggaagcgcccgcacgccaccggccgaccacgcgccgcccgcccacgtgcctgcgctactcctggccgccgccgtgcgtcgccggcccagatgcgccgccgccaaccctagcaacgggatgcgctctgaagcaatgggagaggatgagtacgggatgagaggggtgagcttggttgggtagggtaggtcagtggtattttgctgtaaatacgttaaaaatttaaagggtagtgggtcttttggggtggagtggagctgtggagcagaaaaacccagccccacacccttagttcattttttaggagtaactctactaactccactcctaaaaatggaggatctgaaccgtttggcatagctctagctccagataagttggagttgggagttggagctgtgccaaccaaaggaataagtttactttagaaccctcaatttgtcaccaagtctgaaattcattcctgaaaccaagctaccaggtacctgacttacaataccatgtcaactttggtccatcggcagtatagtgtccggttttggctgaggtggcaagtgagccccacatgccagcggtcaactcttctccctcctctccctatccctcttccatgtggtattgagctccggaggcttagccggatggcatcgcggtggcggaggatgaggccacgaagagggtgtggctggcttcgtacagctcctccaactcgttagagtcggctaaggtagcgcccgagcccaccacagagggaatgcaattgaaggagagacttggctctaacttcattagtggcatgaatcaagggccagacccatgggatgctgatgttggacagctgcacccgagttagggaaaacgactccaacaacgattggaccttgacgagggatggaatggggtcgccggatttcggggagcctgttggtggtgtaggccaaaacaattggggatagtggcggtggaaatgcactgttctgagagggcaaggcgacgaaacaaggagatggccgacgtgcgtgttccatgggacggtgtcggtggtcgggcaccagagggagatggaagacgccatcttctttgtggcgccattcttggccgccgcgaaggaggcggcgatggaagggagcggcgacgtggaagaggatagcaaggaggaggatgacgaggttcttcacggtgtacgacgggcatggcgggtcccacgtgcagaggtgtgccggaagcggatgcacgtggtgctcacggaggaggtgcgacttcggaagctgctgccaggcgacagcgatggcgttgatgtcaagaacaaggaccaggcccggtggaaggaggctatggcgacgtggttcaccagggtggatggcgaggtcgatggcaccgaggaggccgacacaggcgagtagatgatgggcttcacaaccgtggtgaccatcgtgggaccccgccatatcattgtcgccaactgcggagatccccgcgttgtcggcctgcttcgctcgtgcggaaagcgaggtctgtggcgtcgaggaggccaacaccaacacatgcgagcagacagtgggctccactgccatggtggccgttgtggggcccagccgcattgttgtcaccaactatggtgactcccgtgttgtcctctctcgcggcagcctgcttcgccaatgcggcaccaaggaggctgacacaggtgatcagcagccaccatcctctcccgcgatggtgtggtcatgccactctccttcgaccacaagagggagagagatgaggaaggttaagaagaggggatagagagtgatgacgtgagtgccgttgtatttctttttacttttaaccgaacacttagtgacgtgtgggtctcatggttttttctgactttatcaatgccatgtagacactgcctcaccaaaaccatcatccaaattgccttgggacattatttgcattggttttagaagttaagggacatatcatatttaaagacgaattttagactcggcgataaattgggagagaagtgaacttattcctaaaacaacaagtggactagtgcttggtcggccttttcatattttatttctaacttcacaaatttatgaatttagatctgtgattacatcggtaacatttagatatcttaataagattttaaaattttaaatcactataatgtaacatacgagcttcaaatttacgagtatcgtaaatatggagctgtggcatagtacgggacaggtaagggtgtgttcgatccggctgcggctcatgagctcatcatggcatgcaatacgagacaggtcattatatataatcaattaaatattaactattaaagatttgaaaaacatatttgtttgactttaaaaaaagatactttcagctatttcttagctatgtcctaatttattactgtgcatgtttcttaaaatgctaaattgtgtgttttttaaaatattttctatatcaaaatatctttaaaaaaatcaaataattatattttctaagtttataatatttgtttgactttcaaaaatgatactttcagctatgtattagctatgtcctaatttagtactgtgcacgctttcttaaattactaaatggtatgttttttaaaagattttctatatcaaaatttcttttaaaaaatcaaataaatatattttctaagtttattataagattttttttagaaaaacattacaatcatagacgctcataagctaggagtactatactttttttactaggtctctaatttcgccatgtgttcatgcctggcttagtaaaattaattgctagaaaacacataaaagcttagtaaaattaattgctagaaaacacataaaaaaaccagtaaattttaatttgcaagataaagtcatgaaggacgtttcttttaaaaaaagacatataaaaaaaaagctcacaatggatggtacagtttacaatcactatcaggaaatatagacatgaatatgataactatgataaatggctgtttctgtatagttggatcagcttttgaatttgcaattttaagacggatttccccccaaaaaaaaacaatttgtgcggccattaggcgttgagacctcggcgaatggcagccggcgacgtcgtcccacctccaccgcgcccacgaatc

SEQ ID NO: 27492 - DNA, 9162 bp, Oryza sativa
taatccaatctaggatgataaattttttggatcggtcgacgctgactaagtctaaatagtcctccctccgtccctaaatatttaaccttgttaatatttttaaacatatttgaccatttccaaaactttggtgaatattattaaaaacttgagtagtagtactttatttaacaatgaatcaaatgagtagaaaaaaattaataattactttatttttttaataagacgaacggtcaaacatatttaaaaaagtcaacggcgtcaaatatttagggacagagagagtacatatatacgcgcgcactaattacagtttgcctataaatatgaatggtcaaattttgctacatgacactgcttttgtgttgttttagccctaagacactgcccaaactcacttttgggggaaaacactccataaacatggtaatttgccagtggacaccgcaccgattaaaataataatttccggttgaaggggagagaaaaatcacgtgaaatgtcaaaaatacccttgggcccacatgtcagttctgtctcctatctctcttctcctctatattctctcggaggcacatggggcggcgtcagtcaccggggcttgagctcgtcgcggcggaggagatggtgaggactgcgaccggcggagtggagcaaggcgtcggctgcggcggaacaaagctggcggccgaagcaggcggaacggtagcgtcggccgagcgcgtggcaagcaaaatggagcgccggcggcggcgggcattcgcacggtggctggcgaagcggcaaggggaggagctgtgcacgagcggcggaggaggagctgtgcgcgttctcctcctcctcgagctcgtcaccatcgtcgtcgtcgcccgccaccaccccgctctgcgccgctggatctgcaagccaccatcccgcaacggcgtcgtgattcggcgattgggatgagagaagggcggtggcggttgcggcggtggcgatgagtggctcggcgtcgacgctggggatgcggtgcgggagctacggctcgctcgcgtcggccggcggtgggaggaagggcgggggtagggggtgggggtggcgaggcggcggggagaaggagcggctgcagctgctccaccgcgcgctgcggttggtgggccgccggagatcggggtgctgttgctgctcgccgctgcctccaccgccgtctacgcgggcacagccggcggccggcggggagtgacatgtgggcaggaagagaagagagataggagatggagctgacatgtggaccgaaggacatttttgatatttcacgtgatttctctctcctcttcaaccggaaataattattttaatcgacgtggtgtccacttgtaaattaccacgtttatagagtgttttcccctaaaaatgagttcgggtagtgtcctaggattaaaatctaaaatcagacataagtagtgtactgtagcaaaatttaccatatgaatgttaaacaaacccttaattaattataactacgcatattattaattgcatgggcatgacgtagcgtacgtgtatatatgtgcgtgttgcgtgtcgtgggttgcgatgatacatggagctgtgtgtgtatatatgtacgacgttgttgctgtcacaggaaggatctgggccgggaggcggtggtacgagtggccaggcccgtgaaatcgtggccgcctgcattcccaccacccaactaatcaaacacgctcgatcgatcgcaatcgtcgctgctgcttgacggacgcccagcaagctagctaccaacccggcccgaagtaaactacggccccccgcggacagctacatcatgcagctgctcaattattagtatttggcgttttacttagtacagtttgggtgtgttcagtttacactaaaattaaaagttttattaaaattaaaatgatattataaaaaagttaaagtttatatgtgtaggaaagttctgatgtgatggaaaagttcgaagtttagaactaaactcggtctttatctctattagcatatctattctaaacatctcgtatagttagtttgactctttaagattgataaagttattacatgcacaagtgtgtcgttatcgataggtacaagtaagttgtatatcactgaaaacaaacaaataataccaagtctaggatttgaattcgacttgaataattttcgtaacaaatttaactagtttagctgtatgttaactaaactgtgtcttatttcgaaaacagatgtagtatatcaggatagtataaaaaagtcgaataaatacccaagttgaaattaaagcactgacatgtactacctacgtttccaattcgaggatgaccacgctataatcattcttttcgcggaatactttacgtgctgatgtcactactacagattccatttttacaaatggggcaaatcgattttttcatgcggacggatggcccgcatacgctcaaaagtctgtgaaaatagttttttttcatgcagccagggcaaccgcatgtgaaaaataggtttttttcgcatgcgggcgcttaagccaatctcatgcgaaaagaaaaaaaccgtgaaaaaaaataaaaattccaaaaatccaaaaatacacataaaccctaaccctataatgctcttgccaccgtcgttctcatcctccagccaccgccaatgccagcgtcatcctctcatcaccgacgccggatcggggcaggggagggcggccgccgatggatcggggcgggggagggcttccaccgctcaatccaggtgggggaggtccgccgctgtttcccatgcccaccgccgctagagtccgcgctcaccacccttgccctcaatcgccgttaccggagccagccgtcggagtgagagaggagaggggagaggagtggggaaaataatagaggagtggagggagagtgagggcagccggatccacacgggtggcaccgcccgctcccagacacctcctcgtcggtagtggcgcccgccgccgcccgctccctctcggtgaggagagcaagagagagaggagaggagaggagataaagggagaggaaggagaggaagagagaaaggtggaacaatttgaagtgttgagtgggaaaagagagaggaggggagaaaatatagatggagtagatgagggtaatttcgcatgcggactacttaataggctagcatatgaaattctatttttcatatggccccttaagaggaccgcataagaaaataagctcatttttacatgcggctccttaagtggcccacatgagaaaatagattttttgcatgcttgtctcttgagcagtcgcatgcgaaaatgaagattgattttctagacacgatcagttccgatctacttgcagcctatatggttctcgtacggaaaaattgttttttagtgtgcgtacatatggtaccaaatatgataagtagttaccagtgtatgacattaggtatcatgtttatgtgtaacatcctcaaatttttaaactaaaatttgactgcatcatgctggcttttgattaaattagtgtgttttaaaaaaaatctatttgattcttaaattggttcaagtattacttccttagagccctactaatttactctaattattccctttatttcaaaccttagtgaatttgagcaaattctctcaaatttcaaactatagattatttacctagcttaccctaatattagtgaggatttgctttactccaaaccctagtaaaaccctttcaaattcatagattaaattcaatcttttctaggaaaatatacaaaattcttgaattttactgttcatcgcacacaaggtgctcgatgaaatacccagcccagctagagcagcccaacaccatccaatcttgcacaaagtttaggtttgatcctaggggaccacatcccactcaaaaactgtggtttagttggccttctcctccccttcacgcgcgctctctggcgttcgactttgccgcgcgccgagccaccgcgcgtcggtctctggatcgatcgcacgtgcccgaccgccttggcacgccgtcacccgtccgacgccctcagaccgtcgtcaccgcaccaatcttcatgacgacaaagccaggatgacgaccgccgccagaaatcgtcgctcgacgccgtgcgctcccgtccaagccgccgccgagtgcgatttcgcttctacccggggtgaatcgcgccaattcttgccgcacggttggattgaagatagacggtggtattccctctcacaattcaaaccattcacccccgagtcggccgtttccaccctcgccgccgccacgagtcgctcccggattggcgccaacacgtcgccagcagatttcacacgtagtcaagccaatccttcgccggtaagtattcaaacgtggcctcccgccactcaaattgatcttggccgccctctcacagcctctgccaccccagccatatccaaagctcgagctcatccatggcgatgacggtgcccgagctcatccattcctcccagccctataaataggaccccaataccttccttgtccatcatcaatcatcaacaaccatagccccacaacctcgaagctctgctttcccaatccattccatcaaccaccatcgctcgtcgatcgaacaccttgtgcgcaatcgactccacacctctccatccatcctccgccctaaatatcccttagaacaccttatatcaaccatgttctagcatagtagaccctaaccgaagccctgcgtcgagttttacctcgccgcaccaagccgagcaccgccgcccccgcgctgctctgttcttcgccgccgaggagtttttccgaccgcaatccttcatctcggcatatctcggtgagttcttccgttttaaccatctacatactccctagattccattttagcaatcaccttgcactatcatgttgccctctgggctgccgacgtgagcacggccgccgcctatggaggcgctcgtcggcaactaccctccgcgccttgccaaaggttggcaagcagccggaattcatctaggtacctcgtagatgctctagaacccctcccctagccatgtctaactcatatcatcttgaccaccatcacggcctaaccgtgccaccgccgccctagccgctaggccatccacatatcaaattaatccctccgctgccgctcgccgtcgccggagaaccctagctccctcccctcctcggccgcaaccactttccccctccatcgctgccgtaatcgccaaccctagcaccgccgaccgcttttggggattggccggaggtagaagaagagaagagagagagagactgacaggtgggacccacacacagtgctatttcacatttatttgattttcaaactttagaagcccatatcttttaaaatatagatccaattccagtgagacttggaccaatattcttctaaaatcattctctatcttttaagcccatttttgctatttttgcattttattttattttctctatttttcatatttttggattttatttgaattctttttgaatttgaattttatatatgtctaaccttaggtcttgaggattcttctgactcaatagataatatcaatcaatctcaggacatcgagcaaggcaagttaccatataccttttgatcatttaagcctatattttataaattatttatttatagccttatattcaatattctattttccatgcataaattaatcatagaaacccagataatttagtattgcttactttgcttacaatctggttaaaataccttatacttagattgggacagtacgtaagatttggttgatttccgggtggctagtactgtctcgatcgatataagttttaccaggtacttatgtcgaacgaacaggtacgaccgcagtttctagaatagggacagacctagttattatgttaattagcaatatggcatctctgtatagtggttcttatttttaagtcctcgcgcaggaggcaactatagccgcgaagggcaactttaaccattaccatgtacaggtaaatggtttgtgatactcgagtataaattatatggtatatttctaaaccctgatcgagatgacgtggtgtcatacgatcagttccccttaaatacctcgggaacgccagaactcctcttgctactgttaacaatacgttcagagcatatgaggatataagttcatggaacatgtgccataattgttaatgacttaatactgggccatgactaaagccgatgattatcagcaagtcgtggactgcgggtaaagcgtacatctgctgcagtagaatatctttaaaactattcgaatagccgtactcatggagttgagtaccgggactcatatggtaccctagttagaaatctaaagtctatatgttttataaactcttgctataactctttcagattgtctagtactgcttttgtcaaagaaccctactatatgtcaatgcataacatatttccatgataacttgttgagtattgtgaatactcacccttgctcttataacccctttttcagatttgggtcaagaggaggacccttatgactattactacgatgaccccgataacttagagaatccttaaatattataccttcctagtcagaatgtatagaaacttccgctgtgtattaattagttaggtgagtacctattattgtaaaacccttagtattgtaaaactttaacatatgcaatgaagaaccagttatattgtatgtatcaatatttactgatccagggactgatacattatcttagtcggatccaagttgttagttctgggctccgacattatgcatatattaatacagattgtaccgtctaacactatagtgttacgtagtttttatgtttcaattaatgtaatactccctccgttttaggttataagacgttttgactttggttaaagtcaaactgctttatttttgcctaagtttgtagaaaaaagtagtaacattttcaacccagcaaaaatttattatgaaaataaattcaattattgatttaatgaaactaatttagtattataaatattactatatttgtctataaacttattcaaacttaaaataatttgactttgaccaaagtcaaaatgtcttataacctgtaacggagggagtatatcggactgttattccgttaaatacttgtgaagtcacactagaggaaattgttgccaataattttacatgcagtttatctaataagctctagataaaaaaattatacacataaaaaaatcacaaatcaactcttttcactatcatgggtcacaaatcaaagcatgttggaggccaaaattggatcaaaattcaatttaattggattgttcgaatgtacctattgaagcaaaattcggtttgttcagtgtattcggttaactgaaagtactaccgacttgaccgaataaaactcggtcgtctaatacatgacactgaactaatgatcaaatttctcgatccgggtcttttcggtttggtcttttcatgcccatcaagcccctagatatttggtagagcagagacgggtcggtgtgttaagaagataagcaagcatacaggctggtccatatatatatgttgggctgaaactgaaatgggctttaggcgagatttccaaactgtactcttcgtggggaaacaggctgtggctcttgcatatgcatgggccgcgcagactgctctagttttttttttagaaaaaagtatactttgacaccttcaactataggtcgaatctaaaccataccccttaaccacagaaccgggtaaaacgactcctccaataattaaatcagtgctcactgacgtggtgccaatgtggcacggttgacttggtcttaatctgacgtggtgcttacgtggcattacaatgaaaaaaaaacaaaaaaaatatgtgagacccacatatcatttacatgaaaatttattgtggaacccactgaccatttggggcccacatgtcattctgtccctcctgcctttcttcttccttccactccagccaccccaccaccaacgcgccgagctcattctgcacaaagatggtcattgagtactccttccacggccgcgccatgtacgtcagattcaccttctccagatccgggtgcggcgccacagtgcggttgtgcagccccgtccctcccgcgacctgcgccgttaattatgatgttcacctggttccccatcggcttctgtagctggatcaagcagttctggagcaccacctgcatgcatttcatttgcttttttctaaatatttgcttattcttcgtcgtcgtcgtcgtggtggtggtggtggtgttaattgttggatcaaaagaaacagaagaagaagagtttaattatatacttgcctgcgagttgcagtatatgaagtcgatggtgccagacacggagcagtcgcggaagaactgccgctgcgcatgagtcttcaccttgtccgtgaacttctccaggtccgggtgcggcgccaccgtcacgttcggctcgaattcctcggcgatccacgtcggcatgccgtcctcggcgatcgagcagccgccgcccgatgctgaggctgccgagcatcgacgagaactggtcgaccacggtgaggatgtccttcatgagctcctatcctacgagctgttgagcgccgttgcgcatcttggcggcggcatcgcggtggtggtgttgaggaagccgtcgaggcaggtgccctggtaggtgagcgtggcgctgagccacgtgcggaggtcgtcgacggccttgttgaaattggtcatatcgaagccaccgagcttgtggaaggacgtgttgaggttgtctatggcgcacccgagcagctccttgcaattctgcagcgctcccactattaaaaccgctggtgcccatcccggatcctgctctacctcgttgtcgccgccctctctactggagaggggaggaagaggaaggagaagggaaccagagggagagagagaagagggaggaggaagaagaagataaggggacaggatgacatgtgggtccacatgtcagtgggtcccacatttttttttacaaatgggttcctcattttttttattttaattccacatatgcgccatgtcaatgccacgtgg

SEQ ID NO: 27493 - DNA, 5213 bp, Oryza sativa
agtattaataattataaacttgaaaaatatatttatttaaaatttttaaataatttttatacaaaaaattttcataaaatgtatatcgttcaaaaacgtagtaaaaaaaacaaagaagttggaatttagagtcgaagaaaactggagagagtagtctctctactgtgagtggcaagtgcattataacaagtttaatatatagtatagccaactattaaactattagctctaaattatctataattaatttaaaagctaatatatataatagttacctataaacatatatataatatactacattgttgataactgatgtgacctgtcatatatatatatatgacttcatggtgtccgggctccaaggtataaaacacacaaattctcttaaatttttaaaaatttttaaattgtgagtatatacctaggtatatgaatttgattcatataaatacctaacaacaaaacaacttaaactcaattttatttcacaattcattattacatacctaacgaattatatgtttggatgctatatacttagaaccaaaatctaaccaaaataaaagttcaaacttagttcaaacttgtttgaacatgttagtaaagaagttaatgtttatatcttaatttacccccgctctctctctctatatatataggccgctactcttctatctaattttttatttttttgatgtgtgtttataattgttttatagctgtacctgctatggttatttataggctatctataagagatccatgtcagcatattttcctacatggaagagattaaataaagagagagagcaaagctatctactaacctggagatagtctatagagaaaaacgaagcaatggattagagagctatagatacccatatagacatactattaaggtggtttactattaatctagtcaattgctaagatgtacatattttatattttatagagagcatcttactttatcatcgtggatgtcgttaaaaccacaatgtgcgtggtagtactacatggcagagggtagccagctactctatggcgcctactctgtgccagtcgcctgcctacagcctactgttccgaatgccgatggccgtcgacccgaggtgagacgccatggagccatggagaccctactactcctagtagctgcgactttgacaggcactctggcagactacaccaccagttgatgtgatggaaagatcgagtgccattgcagtgcacaggaatcatatcatcgattcgattctccaataatctgctccacctccactgccatcggcatcctctctagcgtaggagtacagtagtaggagtatgtacctctacctattagatgccaaatgtaatcattttcgtgtaaaacattccaaggtatccaacgtttcaataaatatcttagcctaaatgttaaatttgtacgtgcagtttatattaccatctcccctaaacgaaagaatagaaaataaaaagaaagaatacagaacaggatcacgttagaacggaatattttaagtgatactaccttcctacttccacgtgcgctctctctttgatacctggtacatgtggtaccgattgagtaccggctagtacccgatacctggtaccttgggtgccagttggtacctggtacctagtatatttgctactgactgagtactggctggtacccggtacctggtaccttgggtacataccgcatggtacctaggtatcagaccttggtacctgggtaccaggcatgatacttgtgggtatcagccatgattcctcaagatacccccaaggtagtgaggtccggctaaaagccggccgcgaccatctccaggaacacgcgctgcagcaacttcatcttgaagttggcggcgaaggagacgaggtaataatcctaatcgcatatctaaaccaaagaagatgatatttatttggtaaagcgcattctattatcgtattgcgacactgctcctatccctaacgctagctctgttgacttcattccttgtcggtgttgcgagcccctctactttacgaaacgaaggaaaatagcaatggaatgagaggtcccagagtaggttgccgccggtgttgcgacaaccaaggcaccgggaccgctggcttcttctccttctgctacggcagcagatgagccattggggcgggcctaatggggggggcatggagcctcagctgaacaactcctccaaattccgttcgaagcaagctactattaaacccaaaagagaagctttcagatctaccagagaagttgagtttgaggcaaagaaaaaaatgggaacgatgagaaagaggatggtcatacctacactcaccgacaaggaggcagcgggagcagcgggcaaggacggccgcgctggtggctcgtgggaagcgggcgacggagacatcggcgttgctcgacgcaggcagagaggaggaactcgcgggtagacgagacaaagtcgaggcggaggggaaggcggacagaaaggttgcccatgacggaggaaagagggagacaaggggagtgagtatgggagtggggattaatttatctcgcggcaacggaatcctttgggttagtttttctcaaaaaaaaaagattttgactgaaatccaagtgcaaaacaaataatcgtaaaacataggaataatcatttgcttggaccacagaaaaaacacgctaatcaaataagagaggtagtctcgaaggaaatttttcaagaggttagaactcaggaaatttttcaagaggttagaactattactatgttttctccaaaatctctatagtactgtttatttcatatgaattttaaaggatatgatcgaattaaatcatttatttcaaatatcttcatatggaatttcttataggattgaaatcctccaaaattcctatatttgtttacaaatcaaacggacccatggacagggcccatagtgtccagttatatttgtggatacttaaattatgtttactcccctaaactttttctttggatcccttaccctcagcaaattatttggctcattttacactaacctattaaacatagttcagttaataatatttatcttgttttccactttatacaagttatattttaagctgaaattattttatcgctatagttgacaccatcatggatgttcaaaaatattcttaattttttattaatgtttgctttctttaaaatctagatggtttcaatcaatcttaggtgcttcgaagcaatgtaaacaacttcaaaaattaagaaaatttcgagatgtaagttgcaatgcctctatcatcttaccaaaattctattgcaaaatatgacatatatagagagaggaaaaggagaaataccgtcagagattaaagttagtcatttttaatagtttaaggtgtaaaatgacaaaaaaataatttagatgattaaatgctcggggtgaaataaatggactttttttccatacaaatcgatccacttaataaactttaataagttttatatttaattataattagtagtaccgagtttcgatagaaccagagcaagaaatagcatccggacatccaaaacatgagatattttgcacagtaatattgcccagaggtggtgggccgggtggctaataattggtgtctgcaggtggagtcatcgttggtcgtatggactcttaatatttcccaatatttttaggagctctttttagaacaacttaggaatgatgtagtatatataatacaatgtcatgaagaaaaataaaatttggatagaaatgcatgtgcatgtgcaaaacagaaggttataaaacgttgcaaaattctaggaatgattaatttgcatatttgcgttgtttggatagatcatgtaaaaatacggaaattgtggagagagggatagagagagagagaaaaggacgggcagctctagaaaatagtatcattatgcactattcaaatactagttgacgcaatagttagtagtttcaatgcatgttcgagctcaatatgtgagggggccagtagtactaattgacgcaataattagtaacaaaatatttcccatgtttttctacgaaatatatatatggatgaatatatgttatatattatataaatgatggataggcatatgctaaaaacattgtgtaaatgatgtgctcttaattcaatacaattacgtacggtaacaattattaggaggccaaacccacctcagtcgaaagaaggtctggtgctatcatcaaagagattaacaagaaattcgatgttcttgtaacaaaggtttcttttgaagttttcgagaaattcaatcttatgagaaaaatttctaagtggtcctttgaatcgaaggaatagctagcaacaaaactcctatgaaatttcacgggttgctcaacacatggggatatttgaggaattttaacctgaagttaaagttctaggggaaaaaaattcttgagtctatctctctcttgatctctggtttttttttctacgatagatctatccaaacagttattcatgctttttttgtgtgtttttccaatttatagattaggtgctaaaacacacaatcctatatttttccaattcatgtgtgtttaagaaccttatgtttcaaaagtttatgagattggaacattttaaatgaattgcttataattcttaagtctatatttttcgtttcagtgaccagatacaaaagtattccataggattcaaatctaacagaacatgaactttttgacaaaattttgaagaaagtgaactaattcttataaaaaatcttgaaaaaatcattgtaagaaagtactcatttatattataagactttaacttcttttcttagtcaagctctcataagttcaaattaattttattaaatctaacattgaatatatcttggtcaaacttatagaagttaggctaagaaaaaattgaaacgtcttatactataaaatagaggaagtacacaatatatattttgctaatcccttttccatacttaatagtataatactttatccattttaaaatataaagcacaactataactaacaaaaagaccaaaaaaattattaccttctggtttaaatcatcatttcaataaataccatgcatacatttaacagacttagatatcttcaaagtaaagattaaaagccaaaattagagaactagttacattatatagttgcgc

SEQ ID NO: 27494 - DNA, 4759 bp, Oryza sativa
  unsure (1)..(4759): unsure at all n locations
ttgaccgccaatattactaaaatatataatggagaactagctatgcttataatgcatatttgttttcaaataatatagttccacttatacttggagaataacatgttgcaggaatttatcaaataaaataaagagaaagtgaagagacctcattcctaagcaagcaaatggattaagataggctcacaagtcaggtgtaaccgtcggaaaccgactttcactgtcacaaccgcctaaggaaccaacctatcagtgcctgaccgaagctggaggcctactagacaggcccaggtttgtgttcggccgaaccctagtggcgacggctcagctcggccctccatgtgtacgctccagatactcttccaatgacggttacaggggcaaaaccgacatttcgcgttgctacaaccgtcataccggccctataaaaggaggagctcattcactctcttaacacactcaagcaagctaaattcctctccatacattagtattaatagtatggtgctaagaggaatagtatagaatagtgttcgaaaggcctcagagtcttcggaagagttttcaatatggctctagcagctcttgtaatctcttttgtaatactttccgaattaatgaatattcttctttatatatcttcggcactttgcttagtctgagtactggtcttactttatttttgcattatattaattgtgtgggtagtctaccagagaggtgttatggtgcgggtttaatgtctgatttatcagttgctctatgtcgactgcacgggtatagagtagtatttgataatataagcatggtgcttagattattaaatatcattagttgggcatatatgctgcgggacagtagaggtgggccgctgatggtgacagctcagtacggatattcctccatgttagtatatattcctaagataaattcctggggagggtactcctccgtatttaacctcggttggacggtcatgacatgttatcgtacggaactcggcaacccggggtggtctttcgaagtaccaggaggacactgttagggggtattagccacatgattgtacatttgcatatgcaaactaggatttgagtgtatactagaagtataggaattgaatgctttctatttcttcttccacttacttagaattatttcattacgaggattgaatagctttgcttcatgtcactctacccttatattacatttaacccctatttaggctttgacaattataagtaatatacgtataaagtgcattagcaatgctcactcttattatcttcccttgacattaaaaatacgataccttgaagtacttccgggtgaaatgctataatgatatatccgtgcgcttgcggataaccataaatataccaggactatttctggcgcaattgctaggaatgaatatttctagtaatatcgttaagaaataccaacactggctactgtagagggatggtggcaacaacggcgaccactagctccaccgaatcctaaaggagatgaccggatctagtggcagcaggcaaggaagactagctccaatgatgataggtaaggggatgacgttcatcggtgcggccatgaggagcttttcggacattcgatcaagcagtggcgagtgaggggacactaacttggtagtactccctccctccatctaaaagtgttagacgtaggatgttactcacaattaatcttttcattagtgtagaatagatatggcaatggtgaattcaccatcgggggttacacccgcgtccccgtcaccgcggtgaaaaaatttcatcgtccctgtccccatcaaccacgacggggctacaatttctctggccccgatcaccacgtagtgaatttttcccgtggtgaacccgtccccggttaaacaacatattgacagtcacattatatcaatatatatccaaaatactccactcaacaaatcaacaaattatagatcacaatcacatgaagacgaataactcgatggagaagaactagaggtagacgtctatcgagtacagagaagggattagggattgtagcatgctcaccttgcatcgtcgctgtcgtaggctcgtagcttagggggggggaggccgaagccatggtcggcggatggcgtgctgacggtggacgacgtgcggggctatgggcgagtgaagacggagggcgctggcggaagtcgatggtggctcccggtggcgcggcgacgtcagctcccgccggctcccggtgaagacggctgcaagcgccgcgcccggcgccgtgtcgacggaggctgtcggtggctcccagtgaagacggctgtaggcgcagcgcccggcggcgtttcaacggaggctgctggcaggtcctggcgatggcgtctgccagcgacggcggattcagtccatgcgtctcccggcggctcccgacggacgcccgtgccgtgcgagagaaggcagcgagcggcggtgcgcctggtggctggcggattggaggtgcatggcggcgtgcctggctcctgacggactggcggatggcggtggtggctagcacgggctgacgggcgtgctgccgtgtggatctagagggaggattggggattttggatggaggatttggagtttgacatgttgatttagggttagcttttatatatgcctagtaaatgggcttcaatattatgggccaaaacgtctaaaaagtctaaatttagtcctctgtacagtaaaatcgagtcaccgcggggtccccgcccccgtcatccctgatggtgaaaggtttttaaccattttattccccatggtgaatacatattaaccatccccgtcacctaacaggtgaattcaccgtggagaaacggtgaacggagcctattgctatctctagtgcagaagcatttttagtttggtcatatgcatgcagcatatacttgtataggtcttgcatcgtggcatctgagaaagtgcatggttgtacgtgtgatatgtgcgtgttgagagctgtgtggatgcggctgcacaagaggtgtcaaatatctgcggggtggcaaggcttatacttgtactcctttcgtccaaaaaaaatgaatctagaactggatgtgacataatctagtacaatgaatctgggcagatgtatgtctagatttgttatgctaggatatgtcatgttcagtactatgttgattttttatatgacggagggagtatgtatctacgtgatttagttcgtggctagagaataggtcctggatcgtggctgtgttgcgtcagtctcgccgaagttgattggctggtttgttattgctttggggtgtgtttagtttacgccaaaattagaagtttagttgaaattggaacgatgtgacggaaaagttagaagtttatatggctgtgtttacttcacaccaaaattggaagtttggttgaaattggaacgatgtgatgggaaagttagaagtttgtatgtgtaggaaaattttgatgtgatggaaaagttgaaagtttgaaaaaaaaactttagaactaaacacggcatatgtgtaggaaagttttgatgtgatggaaaaattgaaagtttgaaaaaaaagtttgcaactaaactcggccttgctcgtatgaatctatataatgagaaaatgatgagggttgttgtgtggccatatcaaccaaaagcatgtgtgatttgttcagctgttctgttcgtgtccaccgactaaacaaagctacggctgtgtttgtgtttagttcacactgaagtttggaagtttagttgaaattggtacgatgtgacagaaaagtaaggagtaattcccaacataggagtattaatatttttatcattaagatcaagaaaaaattaactcatccagtataaaataaatagtaaatagtgtatacatacatataatcaatgagtattaaaatgagtactcgtattttggtcaactatttaatttatctctcattacattttgaatatatgcagactgcaaatataattatcttatttgatggagggggtactactggtcctctttgtctgaaatcgacgggtagcaatgcacgctgcacgcccagtgaagacgacgacgacgcgggtccacggccgaccaacagctgaaaagaaaagttaaacaaagagcgggaaaacattaaaaaagcgagcctaaatttcttatcctttaagaaatttgttgtaccttatatacttcctgtctcctcccctcctcctcgccaaccacaccacatctcaaactctctacacacgtttccatgtagagatcgatcgatcgatttctttgggattcttgagctcatccatccatggcgccctccttctccatccggtatgtagtttgatgctttgtgttttcttgttttgtttttttaatttttggtttcttgatattcttgtttcttggtttggtgttgactgacacgaaaaagggagtacgcggcgagcatgaggggcacggcggggttccggcacccggccctctccgccgccggggacttcccgccgatgccaatccggaggttccggtggtgggtcgacgagctacacgccgcggtgagtcgtcgtcgtcgtcgtcgtagctcgccggcggcggcggcgccggtggccaggaagacagcaagcggtcggtctcggacctgttcgccgccaccggtgaagcgccgaccatggatagccggcggcggaagaatccgaggtnnnnnnnnnnnnnnnnnnnnnnnnnnnnnnnnnnnnnnnnnnn

SEQ ID NO: 27495 - DNA, 17236 bp, Oryza sativa
  unsure (1)..(17236): unsure at all n locations
aagaagccgaggtcccaagaagacgacgatggtgtcgagaagatgaagaagaaggggatcttcatctcctccacaccaaatgctccaaaggtaactactagcacggtgtgcgtggggtccatgatgtcatcgtcctgtagctcggcctagctttatgaaacagtgcatttaaagctcctagacttttcttttcatggaaaatttcatttctgatcctagtagtagaatatatctagattagctttctgctcttgttagactcctaagcaagataaagttaattttagtatagatatagcttggattagtgatgggcgtgaagctagctagcagtagtagtagtgaactagtgattgattgctgctgttttcatgtttgggttactggggtgcagtgtgttccacttccaccaacacactagtggcctgaaacttgtgcaatctgaggctaattggcttgattgtttgcgtggtttgattaattagtacacatgtgtaggtgcagacatgactttgtctgtaatcttatcttagggagagcgttatatttcatgtaacacgtgctactccctccattccacttaatcaccctatagtttttttagttattctcaaataatcatcatattaatattattttccaagtctattcattatatgtacataggagtaaaaggatattgatatatccatgcacataaccctttataaaccaaaatacaatgttttgatttgtggtttgctagaaaatagtatggatgcatgtatacatcaagtttgttactgaagttaaatgtagtatgaaaagttattatcttttcttggactcggccaagaaaactcctctacccaaaaattagttttttttttgttggaacagactaattaacttggagctgctaaatacgcacctctacgtacggattatgcagtgaataacgtgttaagttcttggatcgtacaggagcataaatacttaattgctgccattattattccatgcttaatagtagtactcctgtatttagtttgcaggagatcgatactcctagatagtactcctcgaattaattataattactccttgttcacagtagaggagaggaatcgatcgaattaagttcacagtggcactctgcagagtcgtactaacgtggcgctagctgcgtgtaatactgatggatgataggacagaaggcagtagctgtacatgacaagtagcagtcctagtcttcattggtactagtgtgcatgcgtacctttgctgtaatgcatcttgatcgaagagttactgctccctaaatttccgtgtccaatgtttgactatccgttttatatgaatttttttttataattagtattttcattgttgttagatgataaaacatgattaatactttatgtgtaacttgtctttttaatttttttcatattttttttaaataatacggacggttaaacgttggatacggaaattcagagtttgtcttttttttttttggacggagggagtacacttgtgagtagcattaattgttttatttttcttgttttatttcatctttaaatctttttagtggagagtcccttgatcatagaatgcttctagctaagtacccatttggccatttccatagggattctctccctatttttacatacagaggattagaggaaggcatataaatagagaggtatggagtacaaaatatagacacatgactgaagtagaaaataataattttggggtcagatttttacacttggtactcttaacaatttaagttaaaggcgacgctgaaaaatagaaagcgatgaaaaagaattctaaatttggcaatttagatcctctacagtactgctcagtgacatatgggcctgaggatctatggacccgcatatcagtgagaccttcactccaaatttggtggtgtcttataagcaaatgagttggtaagtacccaccattcattctttttttggtattgttttataatgctgcaatgtaacacttgaaatctttaacacactaatatattaaattgttaaaatttgatatgtaaaaatggcataatagatttgtcataaaaaaaacttccatgcaattaataatattataaaatataattattaaaagtaatggtacatatatgtattatattggagagattgtcaatgtaataaacgatgagtaactacaaaatggaggggatatgtggacactccatgcattaaattttcaagttattggcttaaatgagaaatctcttgcagttggctaaataaaacagtattgtcgctttttagatactaaaagcgagtctagaggaaagtgagctgggcatatctataaacaatatatgcaacaattccaataagtgggttagtgtgtgaagcactagtccttccatgcagtcaacctttcaaaattttttattactcatatttatttatagaaatacctgaatttatccatgtggatgaacagcatatatataataatctgtaaaagcgttcccatgtcattgtgtgttcaacaactttttttaacatataatataactagaaaacatttgtggccaacggtgtgtattagactgtgccaacgtcactactatagaaatggtcttcggaatcggtggcaggtaatggagttgatgggccatttgttgtactggctgaaggagctctagagcggtgatgggccagttgtggcttatatataggtgcagctgtgctttaggcccaaatgctagtggctagcgcatgtaaatgggcgaagtctaaagaccgaagaggtcatcatgagtcttcacccattttatctgaacagctccattgggggtatttcccggtgggtaaatttcttgattttctcattcattggacttttggatctgagatgtatgtggatatccaggtatacatacatctcagattgaacagtgcctacatgatacatctccctgtattatctagcggttatagcatcattaatccagatttagcaaatgagtagtataacttatgttattgacaagattgacaactttgtagttgtcactgtttttatttgagagcatttctgcacccggaaaaacatgtattggactggacttcatttttggagctctctggattcatgcaaacttgattcttcattgtttctctttgggagtcctagaatgcatccatcccacgtgaaggaagtataagaagcaattaaacaagattctattaataaattgtgcaatgtaagtgtcctaggaaatagatattgatcagtttcagtttttttctctcaatgaaacaatgggaccggctgatctgactacttaggtacattacaatagaagttgcagaaaatttacaggaggaactttgtatgaatccacttcctagtccattctgaaaattgactcaaattgagctcacttagtttgcatgacaagcagaactaagcttctaactctattgctgaaaatggcataaaaaaaacctggttataaataggcaaaatttgctacaggacactgaaagattgcggtctttgctgtgagacacccaaagatcgtgaatctttttgtggacactgtaaaaaagtggtaattagctgctggacacttctcccattattttattatttccggtcaaaatggagagggaaagagttgtgtaagtaccaaaatacccctgctctcttttctttcttttccccttcttcttcctcgctgagccgagcagaggcgcgacacgcgcggccggcctgagccgagatagctcggccacggcggggcggcggcgcatcgccggggttcaccaccgacaacgaggatgcacggcggcatcccggcgcatggcgcggcgatgcacggtggcaccgagctctcggggagctcggcggcggcgcaatggcgaccgggccggcagggatacggcaggagctcattgatagcgattagggtgttgttgatgtagcagaagccactggccttgcacgcggacgcgtggtgcatgccgccggaccagttgatggtgatttcgaaggcgccgtcgacgagcgcgcgcgccgcggcgagcgacacgccggcgtagccacaacaatacttccatacttccagaggcggtcgaaggtgggcaaatcatcgtcgccgccgagtaaaccaatgccgtggtcatcctccgccttctgccgaagcgcggtgtcgttgacgtagctctccggggtgaggtcgtggaggaggtccgatgtcgccgccgcgtccgacgctgccgtgaccgccgcgtaggccgtcgtcaggagccctgtgatgagcgtgccagagtcgatgaccatgccgctcgagaacgccgacggcgggatggcgagcggtgccccgccgacgctgatgccggtgagcgtcatgacgtagaacgtcggcaccgaggggatgcagcgcatcggcgtgaacgagaagccggctgctgtgttgctaccgttgggcgcgccgagggcgaggaacccagtgccgccgctcgtcggcgagaggcagtacgagaagggcccgccgaattgggaggacgtctcctgtctccgacacgagcaactccggcgtgccaccgagaccgaggaggctgtcgaaggtgaacatcggcgccgcgttcttgaacctggccacacacagcacgtcgcccacgcagtagcggtacaggccggagtaggtggtgacgacgagctcgtactcgtgtccgagcttgacgtcgacgaggtcacagtggtcgggctccggggtggcgacgtcgttgccggagttgatgaggaggaactcgaagtagaacactgttgggatgagggtgtaggcgacctcgctgggcttgcacagggggttgaggttgagaacgtgctggtggtcgacgcagcactccagcgttccgctcggcaaaagcgtcgcgttgctgtcgaagaagaacagagaaagagaggaagaagaacggagaaaaagagattgacaagtgggtccatgggtaaacttgtcttaaaccaaaatttctctctccgttttcatcgaaaataataaaataatgcgactggtgtccaccagctaattaccacttttttagggtgtccatgagtaaatacacgatctttgggtgtcttacagcaaagaccgcaatctttcgatgttctgtagaaaattttgccttataaatatagtgctacattttaaagtttcaagtgaataggcaattctgacaatccgacaagattgaaaagggacttccaagtgattgcatcattgtaatatttcctgacctaattatagtgaccaaaacaaccaagtctgtccgtccatgcagtttttaagtttatgctgtgtaatgatgcagtgatagataccatatataaagatatagtgactatgttgcaattatttaatctgcatatatgacttaaccctcatggtcgtgcaactttccaggtttcagtaaacaagttacatcctccttctccccagacatttcaggtacatgaaagacaaaaacacatcaacatcgagaatatgaagatgtatgattttgaaatatggaagccagagaactctgctaaggtcccgaagaacagcattctgagaaagcatacaaagcgctcctctttcactgtcagcatcaacaaggagaaatgcagcaatctgaaagggtcagaagccatagagctaagccacaagttggggaagcatgttacattctcaggggtggatgacatacatattagaaacaagctaagttccacgttaccccaactgcaaaaccactgcaatgtgtactcagacaagtctaatgaagctgacagattagtatctgcaaaaattagttctcatgagaacaaggaagcctcaggtagggatatatacgacagatggacttctgaatcaagtggtgcaaaggacccaattaacttgattgatctgaatcgcacgctcccatgtattcccgattttaatggcgcattcatttctggttcagaggtgcctgatcttgagcatacggagaatgcaacttctgatctccaaatacctggtgatgtaagagaagaagctgttcttaagcacaatcaagacctccattccaaatcaccgcgatcgcagtgtgaacttaacagttgtgatcttgggagaatcattaacttaagatcaatagcctcactgttgcctgatgaagcaattaacatttctgacagaggaatgattggtcatccattgaactcaacagaagttaataagttttatgctgattatgagagaagttcagtaagagatgatactatggaaggaaaggctccttacatattgcctcagcatacagttcagtacacaagtcagtttacggagaattggtacaccaatatgaatttgggcaactttcatcatgctggaagagaattttcttcttgtccatgtgaaaaccagctgaattctgagaaacccatgttacattctgaaatcaatgtgcaacatgagcatgcagttatgtcacaacgtaccatgcgtctgatgggaaaagatcttacagtttccacaacaggtggcaaatgcattggtgagacagcaaaggtgcatgtgaactcctctgtcagctgccatcatactactaatattttcttagagttgccacgacaaggtcacccgtttctgtcactgcaatcccgaagtttttccaatatacaggtagatgccccaagcacaagccatgattatgttggatacaaaatgcataatttaaagcgtcgttttccggaagctgatgttttctctgggaatggaatcgaatgcgaagataggttgagggacttttcatatttgcactgtggccaaaatgcgcttgctggattttcacctcaaggaggaaaatacaacacaagatctgatcaaaactcactgtctgctacaacattcttgcctaccttgataccacatgccaagcagtcagcagtttaccgtgccaattcaacttggaaacataatccctatcctgcaaacttactagttcatcctcctgatggtacaaattttagaaaggatcaaaaccagataatcagaggagttgcagagatcccaagttctgtaaacccatgtcaagagatactgtttggaagacgagaaaaatagacgtcgacaattctaacatttcttctggtgtcaggtatatttcaaggtctggtccggtgaagctccgccccggggcgaagcatgttttggagccgagacaagacacagatgatggcaattatccacctatgtattcatgtgtaccgtttttcgttataagaaggggtggaaatattttgtctggtcagactaaaagtcatagaaaggtctaatttgtagcccatcagatgaatcattcggattatattttgtcccaatcaatggttatggctcaaacttttctcaagttgatgaacagtgtgcagctagttctggtcttctttgacccatagtttgctgtactagagccctgtgaaaagaggactcaattgatttgggaggttcttacttttgcgtcgacgcatcaagcattacatccatcaagtttacttcaacagaatcctggtggcaagttaccatttccatgtaagtaattactaatgagattgcaaactttttcttgctctgctggtactaacttggttacagaattttgcagcttgcctgatgccctgatgaccctgcacctgctatcctctgtgcctctctggctatatcctcctctgaactggaggtttttgtgttgaattatttaggttcagagatttagaaacatttatggattgggatagctttggcataatacaatttttgtgtagtcatttcatggactgattgatgagtgcattgtcatctactctctccgtttcacaatataagtcattctaatatttttcacattcatattgatattaataaatctagacatatctatctatctagattcattaacatcaatacgaatgtgggaaatactagaatgacttatattgtgaaacggagaaagtactatgttccttctcaccattttccaaaagttgaggaaatatactgtggtggtagttcactatctgtcggcctatttctgtcattctctacccatagctatgactccattgcatactcctttcctttgccaaggtgtgatctagccacatgcctggctaacctgcatcacttccaacttattttccctggaatagttttgtacaggtaaatttgtggttgatcatgtctgaaatagtggtaagctggtcggaaaagatcagattcgaaaagctatttgagctcgctccaatgctctttgagatcaaacagcttgttatacaagaactctctccgattataaatattagatgtttgggacaatatttgaaactttaactatcaataatttgtcaaatatttagtttttttaaaagaaaatggtatatgtagatttgcgttaaaaagtactccctccgttttacaatgtaagtcattctagtattttccacattgtctagattcattagtatcaatatgaatgtggaaaatgatagaatgaataatgtcataaacttgttaaattttataaacttattctaatatagaacaagtgatgaaagtttcaaactgtacctaaatcttgtcctatacgttcgatatttaggtaatttttccatcctggagtctcaagtatcagggagtaccatattttctagtgcaaaatttggtacatccaaataataagtatcttgaggtataaacaattttaatgtaaaaatttagatactcgagattctctctctaggatcatcaaatttcttgaaatatttatgatgagacggactacatcacagcttgcgtaagcaatagtacatcacatggtttggtttctgccttctttcctgcatgaacgctgcaaagaaatcaagttaaggtgcattgagccaatggagctcccttggggtgtgaaagctgaaaggaagaggaaacaaatttgtatttgtgaattggcagggaccagcaggtccactgctgccattgatgtgtatgtgctacatcagtggcatatttcaccggattttatcaagaacagcactgaccaaatccatgtcctttcgccgtcgacccggctgtcatcgacttccgtgccaccaccgttgattggcggtggacggccgggaagacgggcggggtggccgtggcagaatagatctttgaacggtgactttgagttgaagtcacgaatttctgatttcagactatgcgcagttgatccttaccaggagtacaatagagtcgaagccggcacggagatgctcagataagcaagccctagaagaaacccaccagtcctggagccagttgccacgaggaggagagagggcagcccaatcagaaggcgacagtatacggagccagacctgcggagcgaatgcgtgttccacatgttgctggtatacgcaagagaatggtagtcaatgtgtggggtatctgattattctcgtcaatgcgcgacattctccataacttaactaatgattcactattaacctttaaattatcgtaaatctatagatttaaaatgatgtatcaaactatagatttatcaataaatttatcataaaactatatgtttaagactaagtatcacaaacttacagattatgtagattaagatttggtccggttcttttctccaacaagagttggatgaagattaagatttttgtagtacgcttttcaaactgttaaacggtatgtttcgtgtgaaaactttctatatgaaagttgctctaaaatatcatattgatctatttttgaagtttgtaataattaaaactcaatcaatcatacgttaatacaacatcgttttacgtaaaaaacttaatcttcatcttcatcttcaagagaaaagaacattagtataataaaattatcacaaaactacatattctggggtctaaatcctcagcattaatgaatatgttgttttgtggtaactttgttactaaatctgtagttttatgatattccacattaaatctatagttttatgataaatttaatgctaaagattaccgccttgtttggtagagctccaaacttcaactcctaactctaaactccaacttcaatgggagctggcttctatagtagctaaggtgggtacaaaaagtgtttggctagatttatcagctccatgccaccacgtgccttgtagccatttcgttgaacacctggagagcgtcaccttgccgccacggtagcaaccaccgccgttgccggtcagcctgcgagctgccacaacatgtgtgtttccctgccgttaacgccaccgcccgggtcatgcctatcgacatagctgcccgcgcatcgcctgccgacgccgtgcgccgcctatggacgccatcgtcctactgccttagccaccgcccaccgcccaccgccgctgctgccgccgcctcccgggccgccacctgtcgagaccgccgcccgctgtcgtcgggaggaggatggggaggaagatgaggaggagagagaacacgaggagaggggataggaaggtgtagttcaatggcatatcacgtaattacatgaaaaatttaaagggtagtgggtattttgggatagagtgcagctgtgaagcagcaacaatctagctccacctccgtagtacaaatttgtggagcagctctactagctctgctctaaaaaaatggagaatctgtattgtttggcacagctccagctctatgtaagttgaacttaggagctagacctgtgctaaacggggccgtagttttatgatacatcatattaaatatataatttggtgataatttagctaaagcacttgtaatttgatgaaattttctcttaactaaaatattttgactattcaatttttaggtagtgtccggtactactagttctgtaatagttgccacatattttgcctttttttttcccatcttcccagggccacatacggaacaaaaacttgggattgggcctagaaacttaggtccttttacacataaccagattgccacatgaagaataagttcactttaagtcccttatcttgacttgattttgaattgcattcttaaaaccgcaatacatgatataatttgtttctcaacttctaaaactagtgtaaatgaggtcatagtttgaatgatagttttgactgatgtgatgtctacgtggtttgtttgacttgatccttattctatatggcactagaaacaatattacagaattaaacaaaatatatggtgcccatatatcgatcaaataaaaagataaaaaataatggaaactgcatgtgaatcggtcccacttcctccaactaaccatgtctcctctctatctcctgttggcgtgccaccattcccttcttctgtctccctacctagatgccggcaatgggtggtgggagaggagctgggcggtgaccgcgcaggagatggctacgggcggtgcctctctttcttccatctcttctgcaggcatgggtcggcagcgatgctccagtcctatttgtgtgagctctttcggcctcctccgctctctcctcggctccacctagcctcttccgctcctgctgctcctcctccacccaacctcattcccttctcctgacaccaccactactagagaaaccatctttggttggtcgaccaaattccccaatagtctcggttgcaataaaaaccgttcaaaaggttagaactattttttatctttagttccgattgggaacactaaccgggagtaaagatcatttttagtccctattcaaagaacagcaggcggtgtcagacccctctattatctttagtcccgattggtgttaccaaccgggaaaaaaagatcagtatgcgcggcggagaggccgaggcgtgcgcgagatcgaggaagaggtgggatcagttaataagttctatctcctcctccctcacctttatctcttcctcctcttcacccccatttcttcctcttcctcctcctctcctcactcttcctcccctctcctccctattctcaggcgcggccgggcggcggcggcggcggccgggccgcggcgaaggtggcctcgtgccgcggcggcggcctcgcgcggagggctgcgcccggcggctgcgtggattttttttctttgtttttcttttttccttaatgtgtgattcgatttgtgttgaatgtgtgattcgatctgtgttgaatgtgtgattcgatctgtgttgttgttgtaaatgattttgagaatgaactatattgttgtgaatgatttggggatgactattgctgtgaatgatttgggataaactacattgctgtgaatgatttgatctgagatgatttagggaaatagcaaaataacattgaaaaataaagagaaaatgaaaaaaaaaagaaaaaccctccaaccaggactaaagatcgggtatttgaaccgagactaaagatagcgatctctaatcccggattcttactcctagttggaaaaccgagacgacttagggggttaccaatcgggagtaaaaagggtttctccaccagtgctcgttgctctgtccaaagtcgtgctggggagccctgaaccgcccccaccttccgagctccactccttgccggcgtgctcgatgcatcgagctccagaggaataaggggaagagatggagagagaaaagagagagaagagagaaggagagtgaggatgatatatagggtacatttcacataaacgcctagtcagcatgaatggattggattaacttaccatgttagtgaaactagccatctatactatgagaggacctaatttaaacttgttttacaaaacgaatggattaagattttaagatgagagatattattctccacatgaatgaacaagtctagtttgcaaacttgcgaagcataaacgtggatcacacaagaagttcatgtgatagaaagaagagcagtttgatttggtagccattattgccctacaccatgtcatcgaccatcaatctaccgtccatccatcgtcgtgtcaatcacactccagcccagtcccaagtacgtaccggagtactataatcgagagtggtgtgacacgcgtcggtcgcaacatcagctgaccatcgcacttgagcttatatatttcagtacacaagattcgtactactcagggcaaaaatataaggtattttaggtataaatttatttataaatattaagaattttagagtattacttgtcccatgcaaccgcactcatcattaattttcttttctctattccttaatctctttgtattgtctggtttataaattattgacctatgaactttctgaagcagcatgacaacggacagcaccatggcaatatcatcttgattgaaaagacgagcaaatgttctgctgatagaggtggccgtaactgaatatccagacatcctacgttttatatatcttcataaggactggaaataagcactggtaaatttttcatgaaaagaaaacatcgatttgggacatatgtttgggttggatagaatttgtagctagccaaataatcccaaagaaagagaaaatgaaaagagacggtttctgaagattaggtcaacaatataagcacaaacgtgtagtcgcgcgcgtacaccctctgttcaaaaataaacccatttctgaatatgaatgtagacatacactgtatccatattctttatatctagaagtacttaatttttactccctctgccctaaaatataagtatttttggagtctaacatggtctttgagatgctattttgaccaataatatctataaaagtaagatgttttaaataaaaggagttacatataatgatgatagtttgtctaatgatgaatgtagtaacatcaattttacatgattgatttttttattattaatagtcaaagttaaaatattttcacttgtcactatgttaaaaatgcttacattttagaacggatggagttttttttttaacggaaagagtataccatatctcatcacctcatacttgacggtattaattcgacaggacacgtaccaagataggcttcgatcttgccagttgtcacaacatggacaaggaacaatcaaccggttataaatctctgggcgtttggtgtgcatcgatcggatcatggatgtagtataccttacctactgtccaatgtggataacactgctctgcataaaaagattgcattttatgacttcactcatgcatcatgatccattcatgctgataattagtactagtactgctctctctttttaatacatgaaggcattaattttttgaaatatgtctgaacatttattttattttcaaaaaaatattattataatttgttttgttgggacttaattaatttatcattaaatggtatttcttaattttttatgtttgtagaaaaaaatcaataagacgaatggtcgttaaacgttgattaacaagttaatagtgtcatgtattaaaaaacgaaggtagcacaatgaaccgtcgccacataaaatgctatgattatcgtcccagaagactttgttttttctaggagtttggatagactttttttggacgaagggaggaatcttttatatttctataattcattgggctcatgacttgtataagtactactccactggcctggttacatgcatttaatttcacagtgaattttatcttgaatagggccatctgacatgcatgcccacctgccatgctcacattgncatgtaggggtggcagtatgttgcactatgaatggcacttgtgctgaatgtgttcagacattccatttgctatagtcagaaaattgctgggagaccgagactattaatttagcttaagctattagtaggttttaagaaagatatgaaagtggtagagatgaattaattaaatgtactgctaaacatagatatacaaagcagtcgcagacatgcacaaaaaaaaagttgttacgcgcacaaaattcaaatttgaacacaatcgtgtgctttctttgccaatttgatctttctacctgagttattcccatatagacatgaaaatgtactcctaccatacccatttcaactctcctgcatctgctgcaaaaaggagatgatttttcttaccagaatgtgatatccaacctccgcatgcatataccatgcaagtaaaagttaatttgcaccaagaaatccgcattatattcattcttgatctatacttccacatgtgaaaaacagaagtactcacagatgcagtaactggaggagagcttgcattgctagttagttgtaacatatacacatattcaagccttgatggcttccttgtaccaaccaatcttgatcaggagctatcacctgatgccaaagcttcatagcctccaacaatccggccagctacactgaaatttcatcaatgcacagttagctggccattgatgctactcatcaaggtatatagccagctagcacgcacgccaagaccgatttttcgacatgtcacgaccggttgttgatcagtgtaaaagggtgcatatatatacatctatttatgtgtatgtatatgtaatttccctatctatgtgtaaatgcatgtgtatatatattgtcgataatcggtcatcggtgatgactggcatgaattgctgattggctggttgggcccaatatgccgggaggagaagggactaacgaaggggagagttcagagttcagaattgtgaagagttgtactactccttatccttagcatccattggcatgcatgtgtgggtgtgtgtccagcaaaaatgggaaagggtttgtgcaggcctcacatgggcaggccatacagtcatacagagatgtgtgagcctttcagcacttgtattttgctgggagatgaaactaaaacacagtaatgtaaaatgtaaatttcaacaatgtgctccaagttgtacttggctagattcgttctgaaaatagaattggctagttagcttgcagcttccatactttcactttaattctggtgatttggagtgatgtgtatatgtagagttgtgactgatgacaagagcatcttcagactaacagcatggttggatgtgtctaaatgtaattcctattaggattacgtacagtcctgagtattattgcacacaagaaatttattactccatccgtttcataatataaggcacaactacttttttcaaatgttccataatataaggcgtgcatgcatacatgcaattaattagtacatcttctctattaaaatatgattttttttaaatcctccaccctcaagatctctaattctattgggtgcatgcattttatttattagagtgatacaaattagaaggtgataataattgtttcttcgtctttggagtaagggtggttgtgcctaattatattttggaacggagggagtatgtgttttaacatgtttggcaatttatttctaatgtatttttaatttacattcttgtttcttgataatgtactgtttaatgaaggacaataatatatagtatgccataatggtgcattggtgcatacccaattttattttattattctatatttttgcaatgggactttttcatatttgtaagcatgcactaagtctactcaactgaatcacatttaattactaccgtttgtgcttttctagattttccgattgaccatactagtataagattaatcaagggacctatgcattaagtgccgatgcacagtacgtaaaccgaaattatcattttttttggggaaaagagaatatattactcctcacaaactatatgtgagatgaaattacaactgttctcgggccaaaattcagacatagactcatatcgtgccttcttctttttagagtattaaataataataatgtcggttgacatcgtaaccaaaattgtgtaaaccgatattatcatttaatactctaaaaaacgtaaaggatatctacgtgcggaaaacctccttgaaggtggactggaattgtggctatcaatgtaagtttcctatggtgcttccatttatccttttggaggatgcatgttatggagtatattgtttttgctcacaagatctttaactaacatctgcgtgttcgagaaaaaaaaatctttgactgatatttataaactacaaattactccccccgtcccataaaaaccaacctagaaccggatgtgaca

SEQ ID NO: 27496 - DNA, 5529 bp, Oryza sativa
aatatgtcacatccggtcctagattcgttttttatgggacggagggagtacagcacaagatagttgaaggacattagtattatatattaaaggagcacactcatgatcctaggcagaatttaaatatatattttttgtgaggattaacagaaaatatatacccacaagttcaattagctagtatttcaatgttacaagctaagttcagcaatcaagtatctttccagtttctacctactttcccaaagcaagaactgcagagaacagagaccaagaaataggcctgaaataatttccctagcagtttgcaggtcgaagcccacaagcttttgtgaaaacttgccccaaattacaagctaatggtgcaatgccatgaggtaaattaacctgtgcagtgatgtcacacaaaggtaggtaaaataaggcaaaagaattgattaaaccccatgcaattaatggttacaatgtgcaggtaggccagccaagaggggaaaggaggaaagttcaggaggaagaaaaacaccaggggcaatatatagatggactctctccacagctaccaccactccatctcatctcatccttccccaaccattctcttctccttgaacacacccctctcttcctcattataatctcttctttgattagagaggaattagcaaacatgcacatatacaaagagcaggaggctgaaccatccactggcctgatggtaattgtttttcttggcttggaaactcctaaatttcctcttctctttcagtgtcattttgcaagagggtttggatttcttttttaattgtatgcatatgggagctttgggaaagtagaaaagtagaatcatggctgctagctgatgtgtgagaatagctagatggccatgaagagggagagatatagctagagatctttagtctttaagcaaaacaagaaaaagaagaaaaaaaggtgaaagaaaggcacaagatcaaggagattgatcaccacaggaccaaagatctctccttttttttcccctcaaaaaaagatctctcctttttccttcgatctacaagaattatacaactcacaaaagggggctgtagttacatatattgatttttaagagagatgatggccatgatgtctccagcacttcttgattttcttgccaaagatccatcttccggtcttgcaatttcttgattatgttggctcatgctgtgctgctaagttcttacatagaggactgagtcatatctctggaattattttgtgactcaaatttagatgccagagccagcacctgttgcttcccccggctccggtggctcaggtggctcaggctcggtgggagctgagaagattgggagcaggggaaagattgagatcaagcgcatcgagaacacgacgaaccgtcaagtgaccttctgcaagcgccgcagcgggctactcaagaaggcgtatgagctctccgtgctctgcgatgccgaggtcgccctcgtcgtcttctccagccgtggccgcctctacgagtactccaacaacaggtactgcattcctcttcctctcttcagctctagaaacctaaattaatccatgtgatatatgttatcttgtcctaattggagcaagttagttgctaccttttcttgtgacaaggaggaggcatatatatggtgatgtgcgtccatctcaccttcttttctgttactacatatatgtgcttcagttaattaactgtcttgttgttacttctgtgctttcttgggggtagtagcaactagcaagtgagaaagaaattgcaggagtttctttgtgtgtgtgtgatgatctgtgtgcttgctgatgtggtgtgcacatttctggtttcttttgtgtttcctgtgaggtgagctagatgtgtagatagattcagcacaatgcatactttgtgaagcaagcatgagcatgtacatgcattcttgtgagcttttctatgtgtgtgatgggtgtctgtgactgtgtgtctgtgtgtgttgctttggcttggtggtcctgttcttttattgctccatttatggttctttcctttctctacctctgtctggttgtgatgaggcttgctttagatccttaatacctcactgcatatagcggtcatatattatattttctctattggctatgcatgtgtgcagtaacttgtaactactagtaactagtatgcaagattgtgggcatgtgaggtttgatgttttttttttcagaggtaaaaagtggtgtacacgagtgatgcacacattgatcattcatgattcttttgcatcatcttcttcaattggaggttagttagggttagggtttcatcacatcctccatctctctctctctctctctgcagagtgctgtagatgttactgttttcactagtcatttctctgttcatttacagccatgtgtggtttcctgtattaacaggatgccccatcacgagtgctctgggcccctagctacctatcctctctgacaccggcactgtacttctcatgaggtaccgaacacagtgaagtcagcagtaaataggaaaaacagtgcatgaattacccttttttttctccatctataaggtttggactttcatatgtatttttgttactacctaaggtttacagattagtaatttgtgcaatatttttagtagagaatcttaaggatttgttgtgcttctttttccttgtgcgattacagaagaaatacacgcacacatgacaccacacacgcagaccacactcacacaagtgtgtgcttagttatgcctatagttgttcagccaagaaaggataaagagtaatttatactatataatcaggatgtatgccatgataatacccttatgttctaaatcctaatcccatgtgaaaaaaaattatgaaatgtgtgatcccctgtgagtctgtgactacacatgaatgaactactagtagtagagatgagtaactagtactagtagcaaaaagatctagaaaaaaactctaaactagatcatgtatgatttgtccttcatttttaaaattacgttttaataacccgtcttggttaagaaaaaatatctttacttaaacaattaaacttcatactccaaatgttaataccctgcacaacactatctagcttagactctagtatcatatatatatatatatatatatatatatatatatatatatagtaaatttgttatatatatactcctgtattatcttgttggattacgacggactggtcaatacgtacgatagagatattttttgtgcatttcttaaaagtgatttataggactcccattaatttaacagtgaattttccttgttttgatctattgagtaataaaaaaattggtttaacaattgacgacttgtttggacaagaagcaaattctttgcacagcagcagcagacaaacacactctctcagtacgtgtgcgtgaggctgcaagtgtaaaactgtacactgtactgtgcagaagcaaaaattaaccaatggcacggtcagtagaatacgtacaaatggcagcgtttgcatcgggagactacaaagagaaaaaggctggtttacccggtcagaatggttaaggtccctgtctgcctggctggctggctaggttggaccgtagctgcttctctctcttgcattggctctctctttctctctctataagccattggtcacttgggtactcatatgattcactgtttgcagccagccaatcatgatcatgctggctatgtttagatccaaactttagatttaaatttctaactttttccatcatatcgacctgtcatacacacataacttttcagtcacatcgtaccaattttaatccaaactttcaactttggaaggaactaaacacagccgctgttgtcaataggatgctcgaagatattaaggttttgtaattcgttggtaaacattactacaagacaatgctaataaaatattcatttaggaagaattttagagaagtgttgctacttgttcacacatgctccatgttaatttgttccaatgagcttgcatctttgtatttttctttaaaaaataaattgttaagaaaatcattgttggtcaaatttgcttggaccatgatttcttcacatgttttttcttgtttaaaaatgtatccaataataccgttcctatgtgtgtgagagatagacagaagctgacttgcattgcttttatattggctcttgggaatagttacttggcactattatacgtatgtgacgtgacatttgctctgatcttgcctttgagaattcatgtttggtcttgacgaggaaagggaaatgatatgatagttttcttggttagatttttgtatggccctttattgcttatgggcatgcctgagattgacaaagtgacaaagtgttggagtacgaaatgtggccaaatgatcttgtctgtcaattttcagcaggagtacgtctttctataggaactttgtgatatcctctttggtttgtactctgtagtagtctcgatcagataggggtgtaaatgattaacccgtgacctcactcataagtaaatatataaaataagttacttatatgtcaaaataagctgtttattttattgacttataagtaggtttgtggttagccactaagtacacccttaatctaggacaatatcaaaggaaaattagttacacatattttgtactatttcaattagatgatgaacgtatatatactttgcgtatagtagtagtttttcttgtatcaagagaggaaaggacgttactctgagtcctttcttgaaacgtgtacaagatctatgatcaaggcatatatgcatagtttttatgttgttagtagaaaaaaatggctaagtaattttgcaaaattttttttggctaaaataatgaagacaactagaaaggtagcccgcgcacatgcgcgggcatcttctcgtataatgtgaatgaaattttattatgaatatttatatgcaggtggctttttattaaaatttcttgtattatattctaaactaaaattaaacttattttgtgtgctttgaaagctttttctatttttataattacccttgcaacatataaattctaaaataaaattacttgagatcatgtggttttgaattgatgagaaactattgtgtcgaaacaatggaggtggttcctatgataaaatttagggtattttaaatcgccaaaaggatagcttacaacctcaaaacaaattcaataatatcattttttttgtttgattgtattttaatatatatatatatatatatatatatatatataatatattcattctaaccgtccttgtaaaatgtttgaatttttctatcaagtattggttttaaatccaacaaaatttgttcaattttcaatttatttcatgcccatttttattttttttcttttggatagttttattctatgaatcatccttgaaatgatttgatctttgcaatttgggacaaaaatatcagaacacataacctagtatggggtaaagg

SEQ ID NO: 27497 - DNA, 12166 bp, Oryza sativa
tatgaagtattaaatataggctaaaaaataactaattgcacagattacgactaatttgcgagacgaatcttttaagcttaatttctacatgatttgacaatatggtgctacagtaaatatttgctaatgatggattaatttggcttaataaattcgtctcgcagtttataggcggattctataatttattttgttattagactacgtttaatacttcaaatgtgtgtccgtatatccgatgtgacacgtcaaaactttacacccctgaatctaaacacccccgaacagaacatatttatttctcatataatttgaaaaaaatcataaatcacatctgagcatgcaatacatgtatggctactgggcctctatggctctatagagttgagaaaagatgtcctcggtaaagcgcaacaactgtagcaggtagaatgacttgtgatgtaaaatttgtactagactcctgttcagactttttcaacctctccccggaccggtggatttggcattgttcttggagacaaacagatgaacacaacaatggtatatacagtacagtgtttgtacagtactatgacactcaatcttactggcttcctgatctttttgcaaattttattagcaatgactatatgaaagttagggggtgtttggatccagggactaaactttagtccctatcacatcggttatttgacactaatttgaagcattaaacataaactacttacgaaactaattatataaatgagagctaattcgcgagacaatttttttaagcctaattaatccataattagcacatatttactgtactatcacataggctaatcatggattaattaggctcaatagattcgtctcgtgaattagtccagggctatgaaaggagttttgtcatttgtctacgtacgtttaatacttttaattagtgtccatacatccaatgagatatatatggactaaaaatttttagctccatccaaacagcccctcagagtgacatttttttacaaccaaacaatgctttagattaaacattaaataagatcatgccacagttgttttattgtttagaaaatgaaaggtggcccaaactgccactaactccccttttttttttgttgatatccttcaggaaaaaccccatgttagtttgaagatttgaacttagacatatgtataattggtgaaaaaaaaaaattctagaagaaacttctataccgtggccaaaacttcgtagttattcttacttccatggacgtatgtgtgcaagtaaactaactatttatgtgtgctactatgcacaaatgcagcgtgaaggaaactattgagaggtacaagaaagccaacagtgacacctccaacgccagtacagttgcagagatcaatgcccaggtaacatcatctgaattctcaaacaaaaaaaaatcatctgtcagtacaaatgcagcatgcagtagttttctctggagcttttatcattcagcaacaatgcaacattccttgtaattaaccaatggtttctatgctgtaaaaaatgagttctctgaccaaaatcttcagattggacatcctgaatagaagctacagtgctttacacaatggaaattccagtgatgctatatatatagtagtagtatatagttttgaccaacagacatactcctatctgtgtttgtccactggacaaagttcttcatgattccatgcttgaaaattgaaatggctcactgcatgtttttggcacttttgtcattcattcatgcatatgcatgcatgcaggttgattacacagtttaatatggtatgatttgatgatgcacatttgaacaaaataaacatgaagagtcaaacattccagttagcaaactgacacaacttgtcatgattttaactaccagtactaaaaaaaaaatcaaattacaaacttgcagcactaccagcaggaagctgctaagctgaagcaacagatcaccaacctgcagaactccaacaggttcattatttcactcagctgcttagaatttttttcaacttgacaaagtagttcatctggttataactaaattctccattaattaatgaattaggaccctagtaggtgataatatcaccaccatgaaccacagagaacttaagcagctggaaggcagactggacaaaggcctaggaaagattagagcacggaaggtatattaattgtgtgctacatttacatagaattccaagttgaaaagggcatattgttaattaattcatctaatttgataagcattccatatcctgcagaacgaattgctgtgtgctgaaattgagtatatgcagagaagggtaaatactatcagcaaaataccactgttttctttctggcaaaattatttggtctagttaattgacatcataagataacagcacgagtataatcttttcaggaaacggagctgcagaatgacaacatgtacttaaagagcaaagtaagtattctgttctacattgcaaaaaaaaaagaatgagattcgctttcaaaaagagattagcctagctacatggtaaatctgaattgaagttactgaaataacctacatatatagcaaatcatacctaattgactgaaattctacgtcatcatactaattaattataattattattgtgaaggttgctgagagtgaaagaggactgcaaacagtgaacatgatgggttcagcatctacgagcgagtacgtgcaaaatatgatccattatgatccaagaaacttcctgcaattcaacatcatgcatcagcctcagtattatcctgaacaggaggaccgaaaggcctttatgtcaggtaaaaaatattctcagtgtaacatagtcagagttcatagttcaacaaatgaaatttgaatgttcattaccttctcattgtaagcatctgagtcgtagttagagacatcaagtttttcaaaataaaaaaataaaaaataatgaagagttttcttgggaggattatattgcagggtcagaaatgtgtagggcttatctcacattctaggtattgtttggatttgcttgcaaccataagaattataactcaaatttcccttgcatcaaattatagaaggaattcggaggcataagttatagacaaataatgtggtcgagacaagtttgtgcaagtacgttcagatgcaacgcgtaactaattttgttttactgtttacattccttgcacttgcagatgaaagataaatatggatccgtatcatgcaactatctcaatcatgcatgtgccttcttcaaggagactgatcagttagatattacactgtgtcagtagaacttttatgtgtgaactcttgtatgcatgaataattaactttatcccataattcaggcttggcactatcaaggtgatgtacctaagtattggttcaacctgtgaaattaaaatacttcatacccttcctatgtttatatatgaaatattggtgataatatcttgtgtatacatataagtgctgtttcgttagctgcggttttttcaggaatcacttcgaactctgaactcacgctctctgaatttgctcgttctgactcttttcttttcagacgtaaacagtaaactgaagaaattaaccgaaaacagaaagaacagggcaaggcatggtgttgtgttgagctcgttttcagtattttcttctctttttaattcaaacccaaaacttggctcttacatgaaattatattggtggcctacaaaagcaccagttcatcaacttcatgccatcccatgatcgggcaaagacgcgaagaagcaaagacgaagaataatcactgcctcgatcattgtttctggcgttaggggtgggcagaataagaccgaaccgaaaaaaccgagaccgaaaaattcggtctgtaattcggtctcaactactaaaagaccgaaatatgttcggtttattcggtcatgggcctcaattaaccgatttgaccgaaataaccgaattaggcccaatagatctagttggcccaataagcccactaataaaaaccctaggggcaggtgcgtcacaggcatcgacgcatcatttcatccccatccatcctggagcggcgccgtcccgactcccgtctccatcccatccgcgtcctccttcgctccatcgccgggcgccgcttccgcctccagtcggtgcgccgcctccaccgccgggcgccgtctccagccggcacaccgccacctccaccgccgggtgccgcctctagccggcactccttcgcctccaccgcctggtgccacccccagccggccctacgccggctccaccgccgggcgccgcctccactaattgttgatttgctttgcttttgctgtttttacatatagttttgttgatttgctttgtttttgctgttagttcggtctatgaccgagaccgaaccgaactaaccgaagaccgatttgctcagtcctaagatttgttggagaccgatcggtcttgagattacaaagaccgaattttcaaaaagaccgagaaaccgaaccgaatttttcggttagaccgaatgtccacccctatgtggcgtgcgtgcatgtgttgtgaagaggcagaccaacactagctacgttgatgcttgatgcgggatgatatgttggattttcacaacttgctatacctaattttgatggcccatcactactatgaggaggacgaggaggagagaggctgggggggggggtgtcccaccctacccaatggatagatccgcctctcgttttaattgcacaatggaaaactaaattatgcaaataataaaatggaatactgaagtgtgtgcaagatcacaattttcactgttacgattaaacttgaattaagcttaggatagcttattagatagacatatgttgaaaatgtaagacgctacctcgccacggtccacgacggcagggtgcaagatgtccccaatgaatcagcttcgatggccgtggtgctagcaagatctatgtgaacggttgatttataactcagttaccgtccgacgttatctgccgctttagttcggcactagtcattaatggtgacgaacgcgaaatttgatcggcacaatgatcagctgctgatttgagaaatacaaggactactatgcacaactcgctagccactgtgcagatttttgccaaccatagatatatagaaatttagcaataggtgttatctttgtctttaggctggtatttaagtagttttattgtttttaattaagttatgattttgtaattcacagtcgttcaacctgtaaactctataataactggttatagctaggttcttacaagcgaagatggataagtctgttattaagaaaaggaccacgtaacacatatatgaatttaggaaagaaactgcgatcttcatttcaacatatagtaatttaggatgggtctaacaacatcctaagttgctacattttgaaacggagggataccaaaagaaaagatatatagctcatatatatttttttatataaacttctttaaaaaaatgtagtgcttattagactatagtgcttgaccacatttacaggtgtgctaagttctatactcggctgagttctattatctatatttttcatacgcacgtttcccaaactactaaacaatgtgttcgtcgagaagaaggacaagaccaagcgcatgtgtgtcgactaccgtgctctcaacgaggtcaccatcaagaacaagtactcgctaccccgcatctatgacctgtttgatcaattgaagggtgccacagtgtttctccaagatcgacctacgatccgggtatcaccagctacgaattcgcgaggaagatatccccaagacagccttcaccacccgataaggtttgtatgaatgcacaatgatattctttgggatgaccaattaatgctcccgcctttttcatgaacctgatgaacaaaatgttcatggaatacttggataagttcgtagtagttttcatcgacgacatcttgatatattccaaaacagaggaggaacatgagcaacatctgtgacttgtgctggagaaactcagggaacatcagttgtatgcagagttcagtaaatgtgagttttggttgtcaaaagtgaagtttttggaccacgttatctttccacaaggagtggcagtggaccccgccacggtcgaagcagtcaccaagtggaggcagcccatcacgcagatccatagtatccttgggctggcagggttttaccgccggttcatcgaaaatttcttaaagatcgcttggcccatgacccagttgttgaaaaaggaagaaaaattcatgtggaccctgcaatgtgagaaggcattttttttgactgggatgtgagaaggcatttcaattgctcaaaacgaagctggcatcttccccggtcttcgttctgctagatgttaacaaagactttcaggtttattgcgacgcgtcccgtcagggtttgggttgcgtcctaatgcaggaaaggcatgtggtggcctacgcctcgcgacaactgcgactgcacgatggcaactaccccacccacaacctcgaattggccgccatattgcatgctctgaaaatatggcagcattatctcatcgggaaccggtgcgaagtttacaccgaccacaagagcttgaagtacatcttcacccagccagacctgaatctccgacaaagaagatggttgctgacggtcctcaaatcataatatctgactgtcaatacttgcttataatgaaataaaatatggtatccaacttagtactagggtttattactaatcatttccactagtattggtgaaatatgtgtatgcaggtactttaaggagaaaacacacccgttatgcaacaaaatacacctctggacaatcaagacgtgtttacacagattagggggcccatacatcaaccaaagccacttagaattggtccaaaaaatagtacatgatgttgcgggcccattaagcaacctcccgaccaaaggagggccgggaggagggttttttggttcggccgaaccaccagtccagccgatcccgttctggcatagttgatcaccatttttacacgtgtacgctcctgattacttcctgatgacagttggaggacatttatgacatttcacatacttgtaaccgtcatttggagcctataaaaggaggtctccttcacacttcacaacacacaactttgagctaaattacaagaggctctattgtatcttttatacattagaaatatttagagggtgaggggaaactctggaggagtgcccggaggtttggcactttctctgacttctacctcgacgagtgtagctttctaggaggaattctagaggagtaccggagttgtcggtacactttgctccagcttcggagaaacttcttctattaaataagcattcgtgatcctttcttatgttatttaattacttagtctaagtgagatagaattccatctttgcgtgttcattgtttagttttcgtactaggtgctctagtactaggactttggataaagaaggaagttcctgcgctagtattagagtagtaattaaaaacttaggtgtggtgtctacgttagagattacctttgtttgttgtgtatctcacggatttgtcagaggtaggcgacaggtgatgacagccctgaatcccgtcctagtgatcctccatgttcggatacattatagagccatagacggaaccacgctggcagactagcaggagtcggtgcccgaagcaataggtaggaaattaccttcaacttagcgtagataattaaaatatatagaaagtcctctctagccttgctagcctactaacggttgttgtccttggatagtcttagccttaggtagattacacacgttccctgagtttgatatccttttggagtcactcgaaggtgaagtgctacaacgtattccatgctcttgcggatttgtctgtggtcgtaagaaataccaacaatggttggaattgatcaaggattatgatgaacaggaagagtgttgacggtccttaaatcataatatctgaccattaatacctgcatataatgaaataaaatatgatatccaacttagtggtaggggttattactaaccaattctactagtgttggtgaaatatgtatatgcagatatttttaaggagaaaacacacccggcatgcaaggaaacacacctccggccaatcagatgcaagcacatggattggagggcccacaagtcaggtgaaaccgcatggaatgggtcataactgtcataagcaccatcagggcccaccagtcagtgtccctgccaaaggagaggccaggaggtggggcccgtggtttggccgaaccaggggttcggctgaaccgccactggcacctttgatcctggccttccacgtgtacgctgtggatgacatcccaatgacggttgtgagcgttatacctgaagaaaccgtcatgcacacttgtcaagagaagagaagagatgctctttggatgcttaagcatctccacattcccagggtatctctagacctataaatactctctcctctccctcattcacacactctttgaagcttgagctgaattataagtggctctattgtactattttgtatgctagaattagggagagagtagagtagaagaagtcggaggaattctggagttgttcgtagtccttctctcgtttctgataagtaccctgctttaattgaatatcattccgagtatttaagatttattctgtgagagttacctcttagttagttcctaatcaacgtacgggatcactgatcactataatccattaatatatagtggttgctttagtgtttagctagcattaaagtagttattaaactgcgtagacgtggtgtctgggtagttaattttcagtgtttgctttgtatcccacaataggtttgaggtgggtgtataggtagtgatatccctcaaaacactgaagtcctccctatccgggtacgttgtagagccatatctgggagcagtgggctggccagcgcccgaagtacctttttaggatcaaattgagctttctgtatacatcgtctctcactagtaaatcctttctaccgttagcctatcttagcttcgtgtccttagacgaacctggtgaagagctgacacacacgttccctatggaaatcaataccttggaatactcccgaatgaagtgttgcatcggtatctttcatgtgcttgcggattctatctgtaaggttaagaaataccaacaaagagctattgcaatatgactcacgcaagcccgtgttcagcaatgctatgcagggacatggaaaggttgaatcttcacatcatccaccaaggctctctgacaaccttggaggtgaagcctctgctactagatcggatccgagaggcaaaaaagaccgacccagacatgaaggaattgcagaagaacatgagaagagggaaagtgtgtggcttcatggaagacgaacatggcaccgtttggaatggcaaacaattatgtgtcccaaagacccgaagatcaaaaagctcatcctgctggaagcacacaagagccaatactccatccacccggggcagcaccaagatgtacctagacctaaaggctaagtactggtgggtcaacatgaagcgtgagatagcagaatttgtggccctgcgtgacgtgtgtcaacgaatccgttgatgcaaaaaacacacaccggcctgaaagatctgcttaacttcagtgcaggtccaaaatcttgcttttaggtttgtgagcgtgccagttgatttgatcctgcaatcaacaagaaacaaagacaaaataaaccacggttaaatccataaacgatagccgatcggccagccgccgatgacatatcatttatcttcaagccgatgtcatatgtgaatcgatcggcagttgtaaataagcaagataagactaaatctactcgatcggctgtagatattaacgctatataattcttctatcgatgtatatttaaaccaagtgatttggataaatcggtcaccatgccgagacagtataaatcacttagatcgaagtatacattaacataaagattataagcgcttatagcatagccgatcagatagatctagcatgtatcggctagtactccgataccactctacattaagatattaaaacagatagaatatatcaaagagaagcctaatatactttattgcggtaagatcttaatataaagggcagatttagcatatcatttaagcatataagacataaaactaaaccaggaaagatcggctgaaaccccgatactatctctgttaatgatcataaaacaagccagatatcacaattataaatattacttaatagatcgaactcaaccgatgcagcattaagcataaagacaagtgtgatatctaaacaggatgatgaaaacctacgagagatggtagatacacgatacaatctagattaataacaaaacgtaactttaccgattgtttcctaatgataagaaccagccgataacaagttatgtagtgcaactaacatagattgaaacatgtatatgataactcgacggattacataaacagggttaaagtatcataaagatggaagcattaaccccgataacgcaagccgccataacaagctttacctctagttgaagatcaaaatcgatgcagctcaacccgaaagtaagaactcgtcgaaataaacgaaagtaaaaagggtggcgatgcgccgagattgtattgaacgattgttaattgattacatgggttcgggtgatatttatacccgagatacaaaatatgtccttgccggacacgacacttatctctaacaaactctcagataccataagtctttgcggtagacttttgcccaaacatatctctaaggaaattatatgaaatatcctaattaatagatacaattgcctcatccgagagctttatctccatcacggcaatcctcatgaagcactttgaacgattcgggaaacagctttgaaaccatcttcatcggaatcggctacatcatctttatcggctgtatcggctgtcttttgtccgatccatctcagccgatgcatactctgttcttcgaatcgatctctttcttgaatctgcctcgatcccaatgtcgaacctggttcacaccttaccaaatttggtcgtcaatagaatcaaagcagaacaccagaggccagcagggctactgcagtcgctccgaatcccggagtgaaaatgggaagagataggaatggacttcatcaccagcctttgtaacaaccctccctcaagaaccgcgtagccctgcccaactgacgggcgggccaacttacacacaccaccccgcttacactttcgtccttgataaactagcaaggtggtactaaatatgcgcacacagctcacatgggccacacaggcttcatcctaattcggccaagatgtcatagccttccccgcactcaaggctgttatgattccatttgggtcgtggtgaaccatgtgaccaaggtggcacacttcattcctgtcaagaccacttaatccggcagtaagatggcataactctacttcgcccgcatggtgtacccaataacaggtacccagctcacctctatgttttggcagaaactgcaataagagcttgggactcgtttgaacttcaggactgcttatcaccctcagaccgacgaccagacatagagcattaaccagatcttagaagatatgctttctgcctgcttcctcgattttggaaagacctaggacaagagtctcccatacgcagagttctcctacaacaacagctatcaatacagcttgtagatggcaccatacgaggctctctacgggcagaagtgcagaacgccgctcctctaggatcagacaggtgagcgacaggttttcgggactgacattcatcagggaagcggaagcgaaggtcaagaccattcaaaacaactagaaagtggcccagtccaggcaaaagagctatgccgacaactgccgcaggtatctcaccttcgaagtcggggactatgtatacctgcgtattactccactccggggagtcagaaggttcaacaccaaaggaaagcttgcatgcctgcagg

SEQ ID NO: 27498 - DNA, 206 bp, Oryza sativa
aaaggaatatttccctggtggataatctttctatttattttctgcagcaaacaagttcttcctggctatagagctctatagtcaagccattgagctaaacagttcaaatgcaggttactgggcaaaccgtgcatttgctcatacaaagttagaggaatatggaagtgcagtgcaagatgcttcaaaagcaattgaaattgatgcta

SEQ ID NO: 27499 - DNA, 349 bp, Oryza sativa
tgcaggttattcactatgtttgctggaacgccttcaggatgcactgcgccgccgggacatttggcttgtaaacagtgatcgctggggagatcctcgcgagaagttgttgcaaggtgaagagtggcagactcagcgtattcctgtctgtcgggcactgggacatcctgtcgatggacgtaaaggtgtgcaacaactggctattcagctggatgagacctggaaagccggggcatcacgatttgaaaagaatgcggaagttcatatctgtaatgaaggtaaatatccatccctgactatcagttgtctggagaaacaggaagagccaccatcattgcttcgtctaaataat

SEQ ID NO: 27500 - DNA, 327 bp, Oryza sativa
agaagtacgcgtggctctcctgaagacgagcaatcaccgatcagcccaatccaagatccaacaagaacaaacaagcaccaccgatcgaacacctacctggcatatgtcgcacttgggcggcgacggcggcggcggcgcgagggcggcggcggaggaggaggaggaggaggcgggggagaggagagggaggcggaggtgcttcccggcgaggcggttggcggcgtggatgtcgcggtcgcagcgcgcgcacagggcggcctcgtcggcgcagcagaggacgctggcctccgccgcctcgcacgcgctgcacagtagcttcatgcgtgc

SEQ ID NO: 27501 - DNA, 906 bp, Oryza sativa
  unsure (1)..(906): unsure at all n locations
nnnnnnnnnnnnnnnnnnnnnnnnnnnnnnnnnnnnnnnnnnnnnnnnnnnnnnnttgagtaatattgtcatttcttttattccactttttgtctttttattgattgtattcatgctgcagcataaacttatctttatcttttagttacatgcccatgcatggttgtttgtcctgtcttgaagtgatgccaaattatggtagcatatgtatatacgtcatcttctgaattttttgccctggtattggggtacaccgacacgcacacacaaattcttcaaagtatatatgtatattattggtgaattatatgctatgaaattagctgctattagcagaaagaaattaatttatattcacacaaataaccaggattggtatttttaaattatttattattttattttattttgtacatgatcttggcgggtggcgaaacctaaaagatcagtaggtctgctctaatcaatggtacgtaaaaatcctactcggtactcgccatatgaataacttattcgtgttctacaaacaacttctcatgtctctagcatattcgttctagctgaaggcttatcgtctctttaggtagttccacccgaagggaacacttctctacggccacaggttattctgatgcctaagcaagatgcaggttaacaatgagaactaccaaagagttatcacctacagagtcccttacataagcactaagctaaacaaatagactgggatgtacaaaggaaattacttcatataaaacaaacaaagtttaccatttgtttacctatggttttccctttcaggaacccgcgagcttacaaatagagctgaagtattaccttcaagcccacacagaggtcgatctttttataactatattagttcaatctatgaccaaaattaagctg

SEQ ID NO: 27502 - DNA, 235 bp, Oryza sativa
ctctctctagattctctctctgaaatctctagctatgatcttatcctgttcttcctctactgctctgaacttctgaataactgaagataacaagaagatgcagcttggtctctactatttatggcctccagctcggtgtgaacatgcatgtgtccaactctttgctcggtttcctggattgaccaccgttttgtgcacggatataaggtgttcaaagactactctacttgcaaat

SEQ ID NO: 27503 - DNA, 675 bp, Oryza sativa
  unsure (1)..(675): unsure at all n locations
gaatatgaattcgttcatttgcatcgaagtcagggcctcctgtcagggttatgggtaccacatatctaatagtagtggactaaatctcggtagtatccaccacatcccatgtcctatacggaacaaccctgtggatatagaaggagttcggaataaggaaagacaaccagagttttacatgaaaacgacaaagactactcgaattgtatcaatattggtttcccaatttctacttgaacaagagaaatcttatgtgtataaatgcaagctcccttagaagaaaagggggtacaatcaacacacgaccacttcaatcaacacccaacacaatcgacatagaagccacaacatagaagcctacatacgccaagacacgccgtcggatatcaacttcagggataaacacggctagtaccctacggtgtctccggatactgtcagaaaagatgaaagcgctatctctgatctcgccgggcacggattcgaggtgaaaggctaccctgttgtcgactacgagtcagatcgtcagaccgccatgtcgacaacagttagataggctaccccaagtattgtactggtgtgattatcatgaataagagcaatactggcttcggccaacaggatgtagggttattannnnnnnnnnnnnnnnnnnnnnnnnnnnnnnnnnnnnnn

SEQ ID NO: 27504 - DNA, 707 bp, Oryza sativa
atgaagcatcgaagataaaaagaagaaaccccctacagaaaaaaaagaccaagctttcgattgagcgctgcattaagtaaagcaatcaacagtggcactcattcagccctccaaattaattacttgcatatataccaaattaccaatcgaccaagcaaactaggaaagcaatagcttcttcacttgacgaggccggtgatggcacagtccgtgaactgcagatgggaaaggagatgagggatattaatgtcatttgtcacacaagtttgctgagttggtaggaaagaatggtaaaatagaaagaatataaagagtcggatggcaaataatcaacattattcaagaaaagaaaatggcatttgagagtgcgccattaaagaagatggcaaatggttcaaaatctcgtggatggtgatattgagtgggtttaaccgtttgagaaggggtctgttctgcccaaattttcacaatttgactttttataaaatcttattataataatagaccgtgtcaaaaacttaaaaaaaaaacaaacctcgaccttagcgccagcgccatcgatggcactgaggtccaaacgtatcagtgacataccctttggcatggagattttgccacgtcaataccagaaatcgccacactgcctggcgctgaatttttgtgaagtatattgttgttcctatttagcaaaaaggtctacagtcata

SEQ ID NO: 27505 - DNA, 761 bp, Oryza sativa
  unsure (1)..(761): unsure at all n locations
ttaaaactacgagtgaaatactgtattgtcgagtagtcaaccgtgcatgtctgctggtgtgtacgcattgcaaattgcagtgctagtgcaagcaaaagccccagccggcatgttgtaagctgtctgctggactgctgatgccgcggtccggcgcaagttgggtcaggtcggcttcggaataaacctcgtgcctcatcagcagctcagcgccgtgcatccctcccggtcaattcaggtcatcaccgcgttatagattggcatcacgcgtcaccaaccttatcgacgatggttcactgcttcactgctgccgtgcctatacttccatgcatgccactaactccgttaattactctcaatactgactctgattctggaggaaactttaactggacaactaataattttcgtataataaatctatagatactttcctacatgtatattagatcggtcaaacttcaacaagttttaatctcgtaggatatcaagtagagaagaaatcagacgtgcataaatatatatcctaaaagaaatttgagaacaagtaacatcaacatggacgttttttcaagataatagaataacattcctgcctttactcaatgagttacaaccaattattacagcctaacactcaaatgaatgcacttcaaatataattataaaaataaaatggcaccaatcataaaaaagaaccaaaccaaatnnnnnnnnnnnnnnnnnnnnnnnnnnnnnnnnnnnnnnnnnnnnnnnnnnnnnnn

SEQ ID NO: 27506 - DNA, 739 bp, Oryza sativa
  unsure (1)..(739): unsure at all n locations
atggactttggtagtccatggttgatgatgagagcgccgtttgggctcatttgcttatatatttcagaattatatacttgctgtccataaattaaaatgatgctagagtaacttgtccttacttattttactcattaatttctcaataaaattagctttatgcaaacgttgaacctagagacccactataggctagaaagcttgcatacttctctctcccttatgtatatataattttgggtaagacttgcgagtacaatcttgtacttaacccggtgtctgcaatttcaggagaggattccggttatgagttatgcttcttgtgtggtcattgctctgctgagggtggcgagggcaatgagtgatctcttgcagcttggctcttgcccggttggtttgccctagtggggttgtggcaccaccgattttatcttttgcctatgaactctaattgagacttctgctgctatatttatgtgttgtatgttgggatcttggaccctattatgtgtcatgtacctgctgcactttaaccctattatggtacttgctatgtttattaattgcttgcgatgaaagtgtgaggctagtcgcattcctacggactagctaagcatgagtaacgggttttgatcgcttgagataatcggggatagtgccttggatcgagtcactggggtatgnnnnnnnnnnnnnnnnnnnnnnnnnnnnnnnnnnnnnnnnnnnnnnnnnnnnnnng

SEQ ID NO: 27507 - DNA, 687 bp, Oryza sativa
  unsure (1)..(687): unsure at all n locations
nnnnnnnnnnnnnnnnnnnnnnnnnnnnnnnnnnnnnnnnnnnnnnnnnnnnntttttatacacaaattaaccgcatgaggttttgaacccaaatagctttaaaacttccaacttttactaaggacataccccgatttccacttaagttgattaattaaaacttcaggatggtacaatgtcagaaggtagggacctcttggatcatatcatagagaacacttccttcgttcattgcgaaaccatcctggaaatcgaggatacacatgaggaaccatcgatggccgaatcagagaatacaacctccacatcccatgtttcgatcgttgaatccttaccggaacctcaggaaccgaaggtagaaaaaattcagcctttggaatccctgttcttatttgagggtgatctttttgaagattatggacacacctcaaacaattcctgccaaaagagaccaccagtcccacgtacttatcctgcactactcgaggagaatctcttcaaagagatggtgcaggaattaactaccatcatgagtgatgagtgattaaggtaggtggagctttcttctgaagtaactcagattagctcctcgtccttaaatattccatgtctcatgagagaggccatggtgcaaaatctttataatcccactattcatgcaaatattatgtttgcaacctttgcat

SEQ ID NO: 27508 - DNA, 705 bp, Oryza sativa
  unsure (1)..(705): unsure at all n locations
nnnnnnnnnnnnnnnnnnnnnnnnnnnnnnnnnnnnnnnnnnnnnnnnnttcgatcggtctcactcacgcgactcggtctctgcagccggtgcagcccaaagtcttgcggactttttgtttcggtctcttctgctgatttttgcctgaacttctagaacggtggattaattaattaattagctcatctaaggccattttcaacccaataactagaatggtgtctatagcattaaataagctgccagttagaatgaaaaatgatgtgtcaagtgaataaatgagaaaatagaaggaaaccatatcttgcatgagacatagtttctacacaatatttaaaacatcatgtgatataagtagcattaaatttaagtatggaataatgctgtttgtattaaaagagtagtgtatagtactagtttcttgatatagagtttatgaaaactatgtctagtgtcttagatagggaatgggctaaagaagacgagtgtttagttaaccttcccctggtgtctggtgcagatctcccctatgccactgatcaacgtcgtctggcggaccaccaccacgaacactgaggtggtgaaacacggcaccgttcttcgtgctcccatttgtttggtaagcaacgttggccgcagatacttcgtccgtttcggtcccgacggacagagcgactgcaacaggaaacgacaattgaacaggcg

SEQ ID NO: 27509 - DNA, 45277 bp, Oryza sativa
  unsure (1)..(45277): unsure at all n locations
caagcttgctagttggagtctgctctgatcgaggcctaacaatatgcctcactggtgtcactagagtatgtagcgctaacagagtttcctttgccctggcctttatctttgattcagtgctttttttgctttctgctgatgctccctctacagagctgcttgagcttgctgggataatagccaacgtttgctctgaaggtggtggtgagttagacagcatcagctgtattggaccagccgatgaaacaacgctgtttacttgcaaggattcttggttcttcatgaaagcatcctgtgtgaagctgatattccagacaaagctctggttgatgagggctgtgatttcgtctggaataaattccttgtttggtggattttggtcaataagagtctcaacaggtttacgtatgacacgctgtgctgttcttcaaaagagaataaacgtggccttgccagtgtcatcagcagcggtaagtaggatcttgtttctgcatgttaaatgaaagtattttaaagagtttcccgaagccatggatatagcctctcaagtatattctttaccttggcactggtatgcctacatatgagcagcttgtacatctatatgttgaaccatatggtttggaggtcctgtagcagagatcacatgaattataataccaggaactgtcgcctgctatgtctttgatagtcacattgactataaaacgttcttgctgcaacaaggatggcttcattgaaaagatagataggcaggataagaatgtattcagtagtaaatgggcagaaaagaaacctgatgtttatgtggattgagagcaaggatctgttctatggttttttcctatggaatgtcttggttgaaccccgctgcagcattttcgacccatttgataggctggaaatttgcttcaaagctagaaggaaaaagacaaattcataagtggtgtactactcctatatttgtaagcagaggattgcataggcactggagaaagaatgagggctgacagtactacctttgttttagctcaagcgcttcaaccatgtcaagaccaatataccatttgcatggtgaacttccagttaaggttagccctgtgtataatcatataaatggttatagattgtaaatttattagacggatagaatagcagttttatatgtttgtagacatatacctatgcctgtatagtttctaacaagtgtcccaacaaagacagcaacctgaggccttgtctgcccagccttatgcacttcttctgcattgaaggcagcagctgtctttccccagagcgtgatatggagtgttgaattgctgtttttataagtggccaaaaagttcttcagcttagatactgtgagcttggcaggatgactaccgtgcatgttatgaggctaggacagcttatatcaaaaggaaagtaagcgtatagcgtaactgaccttgcttcacagatttgaattgttcgtttcaagctattagtgttgcttgatctagggcgcacagtagctgtgtcactaatcttagttatcacacccatgacatctggtttgaaagcaaataagtttaataaagggacacaaggatgtgaaagaaacatagcaagaatacatgatgtaaagtgagcataccaatgtagaaagtatttttgtcgataagagatgggatatcttgaaaaggtgtcaatgaaaatgttatgccagggtagtcaccaagaacatcaatgcattcttctaaagttgtccatttggtaaataagatcattaaaagattggtgactggtctgtatgtcctgtttgcatatttgacagagaaggagtcaatgtagtaaacctttccttcatgtaggacagacttaaacctattcatcacagatggataaatctgaacatgtatgctgctgccctgcatatttttaacccaaaatactttgttagtgtgccacaagatatatacaagagtgaaagtaaaccaaagaagcagtaagtagacaacaaccatttcatccagcaggacaaggttggtgtggtagatctttgtctcatcattcatatcatggaaaatccatagcctggatacgcgagcttttatttgcttgttggtgtccccacagaaaaggcttgaaatatgcacatacgccattggaaatctggaagatgaaacactaaagatactgagtgtatataaacagggaacatcagtggaatgagacaggaagtcaagatgaagtgtacttaagtgtaacgggcaggctatgcagccataacatagtatatggtatatatgtgagcaaaaaagctattccaaaatgtatatacaagaggaacaatgttttgcttgcgaggaaaagcaggctacatctgaagcggcatagcctgcagcaagaaagaatgtccactatcacatgaacagcacaagacaagtggagcaaagacacaagaaatgcacaaacatagcgagagtatgaccgcttgatgcaccgctgcaagtatctcaacataaacaacatttcttgtttggtttccacatgatccatcatcattctggatcaatatcttgagccttgatcgacttgttgcccttgaaacagcaacataaagctggccatgtgtgaaaacaggttttgtaaggtatatgccaacctggtcgagggtttgtccctggcttttgttgatagtcattgcataacaaacccgaactggaaattgccttctttgcagtgtaaaaggccatttcagttttgatgtgcttaatgtgattctcggtatgtaaacagtttcaccgatgtttgatccagtcagtatgatacactgcaagattctctgacctaagctagtaactaacagccttgttccattgcagaggccagctgactggttcaggtttcggaggagcataacgacaacaccttctttcaagacaagtttgtgtgtaggaaagtttgttgcgttaatagaattaaggaattcaagtgggtataacatgtcaaagtccggtatttgctcagagcattttgatattgtatcgcagcttaagtacgttgttgaatttcctggaactaaaccaacaacataatcatttaactcatcaactactgcattggtagggcaaacaattgcacatgaagcaaggtatgttgggtctctatatgatgtaagaaagttggggtatacctcggtcacaatagctgcaattttatcgtcgttggtcataatgagaagatcatcaggaattgttatccacgtgggctgagcatcatcctccctcgcagtcataggcaatgttccgttcccaacagacaaaacccactgactaaattcatgcatttcatcctttttgttctgtgaaagggtaggattgagcaacctcatatttatattcaagtttaatagcgtgacatgtttccatagagttgaatttgtaattgatgcgtttacaacagcggcacgtgaacctttagggacaacaggtaatatctgtcggaagtcaccacctaaaacaacaggcattcccccaaaaggtatgatcgaattcgctggagaagtttcagagagaatgtcacggagtgtgcgatctaatgcttcaaaacagcgcctatgtgtcattggagcttcatcccatataataagcgcagtttcaatgaggaggttagctaacatagttcctcgttttatattacagatgctagtttcatcaatgtcaattggaatcttgaatcaagagtgagctgttctacctcttggaagcagcagtgatgctactcctgatgaggcaacagcaagcacaactctgttctgtgatctaagttttgcaatgatagcattccatagaaatgtcttgccagttccaccatgaccgcttacaaaataacagctaggctggtttgcagtcactgaggagactatagcgtgaaagatctttctttggtcatcatttagctgcgctatcagagagtcagcatgcatggacatcataagtggatcagctgcaagctcttcatcgattaatctattactgtcgggcatgtgtgcggtagatgtaggtactggcaagtcaaaatcttttatattaccgccactgtttgcaaaaacagttgtaagttcacgcaggaggagattgagcaagtgctcatgtggaatgatgcattgtggattatctagtgctttctttagcctgttatggatgtcatcagtcatgtaaagccaatacttatcaaacaatgatcgtacgttaccaacagagcaataaagaatgacagtcacacattgccattatacgtgcgtacatcagcataattttgcgcgcctttaacgatcattaataacattctcagataatatagctctccacaggttgggtgcacataatatatcctacctatcttcgcagctggtgttcgtgcacgccatgttttagatgatgagtcccatgaccattcctttggaaagtcacagtatgttaatgaacgtgcacttagatattttgcattagcctcaaaccatgcagttagcattgattgtttcgcaccagggctattcagcaccgctcgcaaatcagaacctggctcatatctaacatagtttttcccaggcaaatgcacagctagacgctcaactggtggcactctagagtgtatgtcaaactcaaatactcgatgaaacgcctcacatgtcgaaagaaatctaccatccatgtattctagtatttcattaggaggagcgaggtcatgatttggtgacatatttcatgtcttcgcagttgtctcaaagtatattttgcacggtcttgtccctttgtaatatacttgaataaatatttaattaagtttgacttgttacaccattcaacatttatgtgtgcctcgtatgttttaagcaacttcaggttgtatggaacaactgatctattgtccaaaggaattccatttttaattataaaccgtccattgtttcgtcgtctgtatattgtgaagccagattcatcaataatggtctcatcttgaaagtcttttggataatgttttgagcatttgtcgtttttcatgcaagcacattttttgtttgcatcgccacaaggaccatgcatcataaactcgcttaccaattcatatcctagtcgatcggtttcaatgtcaggaatctcagcagagatgaagccatctatcacagatgctgagatgtcagcagttgatgctgcaagccaaaccaagcagtgtatatgtggcagctcgcgcttctggaactcgacagtgtacagaactaaaaaggtttaaagaacaggaactataaggaaaatattggtgaaacactaaacagaaaataaattttggctgctacctgcaagaaatttcccaaaagtccttccctctctaatatcagtgatgaaatcattgactttcatgttaaacacgcgaacaattacatctgctctatcagatgactgctggccgggttcaaatcggattgcttcagcgatttcttgccacttagaattacatgtgaatgtcacaaataggtaaggcgaaccatagacgcgacagattgccattgcgtcctgataattcatgaccatatacctcctgcctccagtaaagctagcaggaagtatttggcgtttcccaactgaatctccatcggtaacacctctatctatcacatctacaatttcttctacagattcagcacgtaattccttttgatgatcgattataaactgtagtctattagcttcgatagtagaaaaaacatcaacaacagcttggtcactcagtcggccatagcatgtgaaaggattaggttcatttagcctataatgcattagatatctatgaaactccagcatcgtgagatattttctaccagtcccatcataattactatattcgatgcctagatggaaaccagattcaccatagggaaatagcaaaggatattgcaaagataggtatgatggatgcaaggaagaaacttgacgcattccgtggtctctatcgtgcacgagcagatcaaatttgtattctttcgcatcaaagtcaccaactattatggtagttatttcagtacttgttggaaggttatactggacatcatctctagcattacagcctaataagcgaagagttattttctcatcaccatgctgagaaagaaggtctctaacgtatctgaaattttgaacaagtctattgttgctatcaagcatgcgtgataaggcagcaatgatttcagggtctggcctatcgttgtcatcacggtcacggtcaaaaatattgagtcgattttgggtttcattctcaggatcatagatataaagctgtgcaaacttagggcgtgcaccatgcgatggtagaagagtaccaattctgtggtgcacaacaccgttaattttgaaaacataaggcgcatttccagtattgatcgatttatcaatagtcgctcccattgaagtgaaagcaaacattgaattgtatgatcgaatctgcctcagaaatcttttggatcgtgcatcgccatcaaatttcaatagggtagcgagaggttcaggtggtggcctgaaagcatgcagctgtattttgccacccttacaacataggttgtaaactttcttcctctttgacacagcagatagagtcttaattctctcctgaaaccagaagactgcaccacagtaggggcactcatgtgttggagggccatagtacgaccgtcctgggtatgatgctgcacaatacatatctgagaatgtatttcttttaaccggccaatataaattgttttattttttttatcagaaaacacggacctttcaatgattggatgtattccttatctgtccttgatgaactaccggaggctctgctgtttaaagctgcaattaacgaacattgcaatcatattttagtgccgtagcttctcatatatagggtaatgaacgctgttaggtgtgctttcagtacagtattaccattctgtggtgcaaggagaggaggcatctttgaacgcagcaaagaccggtgctgtctatgtagcttggatagctctggagtaaagtccatcaacgaacgtggctttttggctcgatgaatctggggaggttgggctggcaacggtatggcgctttctatgcgcatcgcagatgagcgcaacaaaatgttcgcggctcgtttctctcgactcgcgcgaactctctgaaccctgtccatacggtggtctggtatttgccgagactgatggagcaatatacgcagactaataggaataaataaagagtttcatggcatccctaaaacactgcaaagagataatctggaagtaaagtgtgcaacagaggcagaaggaatagcacagggaagacagaaaagatgagatggagaagaagagagcagaaaactaccttagccctataaagcctagagagaacagggaaaagaaattcgttacaggcagcaatgtttgaaatatgaggaaagagagcagaaagatagccatgtgcaagctaacgtgtgcgattgctaccaaaagatgatgcgctgactgtcatttttgttacatgccccaacagagacaacacatatgcataaagtctaagcacattctatcacagatcattagcacagattgccaggcatacaaaacaagcacttacacacacaatccatgcacgagctaaaaaggaagcacataaattcatatattcatatacaggaacaaaaatccaattatagcaaggagatagttaccttgcacggaacagtggaaaagaagactgcgatccagtgtaggcccagagacaacaacagaatatgacaattagccctgcaggatgtaaagaaacacaatcaggagtcatatacagaccaaacaattgataaagcagatacatggtattaatctacacaataagctgcaaaatagtatcagatctaagccacatatgatcggccatcatccacaatatcataaacagacaagccaaatcacaaggacggaggaaaaacctaataacctaaacagacaatggccatgccatgtaagcataaaggtcatttaatagtttaagaaagtacgcgcgaactctttgtttacaaaacagggcagatgcgctggcaaaaacataggatgagaaatatcagtatgaatgaatagcaaaacaaaggcaccgaccataatcgacatataacacgaaggagtgatgaaagcaggaaagcaacgtatctggtacccgcaataacaaattaaatactcgttaattcgccggaaaactaccctgcgctatacagaagagaacatagaggcaccaaatatgctgctcccagatcgcactgcagagattaatcaggcatacttcttttttcgccagacaaaatcaaaacctaacaatgcatatcatgtctttaaaatcttgcatggttaatccagcttgaaaacaattagtaatctcaaaccaaaaataaaaaaccaataattaacagcagatatcaagtttttaaaatcttgcatggctacctcaccctgaaaacaattatctatctcaaaccaaaaaataaacaaagggcacacatatcatgtgcgaaccatgcaacggtaagcctagtttgagtctcaataaaagatcaggccacaagaacgcaccatagtgcagcaatatctacaaggggatgaagcgagctaacagcatcaaatatataaagacagaaagagggaaccctggaacagcaactgcaaattaactaaagatgagaacgaatgcagcagaatcaaaagtgaggcagagggaaacgacatgactacaggctgtaaaggacagaatataaagaaagaaagcatggaagagaagcctgcggagttagttatgcagaagtaacaaaagccatcgaggtgtcccttatcggtacaataactgatgatagcgacagcagacatgcaacgtcctagacatctgacaaccaaagaaccgacacagcaagatacaaacaagcacgaaggaacgatatcaaaaagaaccaaaagacaatgtagaagagtaacaatgaataagatgaaaaaagaaatagtgagagggagcacacgacagatgaaaataccttgtatgaacgaacacccaatcagcaaagaacgcaacagaaacaagctgaccaagagtatccacagaggacaaagctgtcggctaagaaatagaagaaagaacggaaagagagagcctggctgaccctgcgcaagagaagacgaccattagcatacatgcatgctaaagaaaatgcacgatgaatacagtgaatagggcagtctatatgatggaaagcatacacaggatgaagaagctaacctcctcgatcgaaggagcagcaccaacgttccttggcaaaaccaatcaagaacccttgaaggatcgatccagctcatgcagatcccataggctaaaaaccaagagaaaaaccaaagaatgatcaggaggcataaaaacaggagaaacatcgaataaagatgagaacaaaatgagagcctcctcacaccctaccctgccatactgaacgatcaaagatcacagcaaacagatgcggactacacgtgtagatcgaaccaacgaaagaagcaatgaaaacgatagagcagtggaaacgacgatgaaagcttgagaaggaagaggagaaaagaagatggctgctagcacctgcaaacaaatatagcagagaagaaaggacaaactaaaaccacagcacatctaagagcagcaagcgcacctaccaatacgaaaggagtatacatggaccccatggcacccaaccccacctgaaagtcagacatcctaacacatcttccacgatgaaggaagtaggctggatcatacaccatgagagaaccatctaacaccacatccaattagaccccacaattcagtcaccaggagcatatagaccacacgcaccaatacagatcgatggagccgagaaaaccccacccaatcacagcacaccgccccaactatttgaacctgacaaccgcacttgcaagctaacctgacagccccactcccgccgatcggtgcacaagagtaggcatgcatagtcgtgtttccctacagtcgactctagctcatattgtggatgagacgaacgccgacggtaagggccacatgtcagcgatagcaaatcgatatctgactgtttgcatccccatgttcccaacccatctccctcgttttccacgcgcacgcttttcaaactactaaacgatgcgttttttgcaaaaaagtttctatacgaaagctgcttaaaaaatcaaattaatcaatttttttaaaaaaagttagctaatacttaattgatcacgcgctaatgaaccgctctgttttccgtgcgagaggaattagttcccatcactggaatccaaacacagccagaagaggcgcaccgagcagtgccatgaaccatcagcaagcgcggccacacgatcaacatcaaacgggcagggcagcaagaagcacaaacagtcaaagtcatcaggatcgtagtcgcggttgacctaggtattgagcagcatgaaagccggcggtgaacagtgcgagacaagcatgcgaaaggcaaattcagcctgtagaacacattgaacatatctggggaagaagagcaaacatgaacgggcggccgcgttgcatatatacctttccatcggcatccatccgccgcggccgccaccaccgagcccaacctgcacgcagcacatcagagttggccatcagctctaaagcagagatcagagacagaggaaaaaggtgaagaaagagagacaggcaacctgtggagctaaccaccatggaagaacaacaagggacgacaccatccgccatcctccctgatagcaccagccgtcggctctaagcgagcagatccgccggcaagcaaacggcgcccgacccatccagcacgtacaggctaccttccagcgggcgtcggcagcgccccaacaacgacagcgccaaaccgcgaccgcgccatccagcacccaccgcatccccttcgaggggggcgccgacggcggcgcaacaagaagagcgccggccgcgaatcctgtccgacaacacggcgcacgcagaatagcccccacaaacggcaaacagtagcgccacaggcagcagagcaggcagcggccggagaagccccaaatccaggagacaagcagcatccgacgagaaagatggaaggagcgtagcggccgcgttttttcccctctcacgcggcggcgctctcgcgaaggggagagggagcgctgtgcaaagacaagtttggggaatacacccccagcctgcacgatttagggcgcgcccctttttcctcgtctcctcctcgcccgcatcagatttcacataaaatgaaggggctaaacgaaacattgctgagccaaaaacagcacaccaaggatgaacaaggaaaaacgcacaaagaggagggttttattgcaaaaattccagcgccgacgcggcctcacgagcagtcgccaaaaccctcctcattgcagccacgctgacgtgccgcaacgcggccgtggccacgccaggccaaatcgctgagcgaggagcagaccggggtgacttttaatactttagatgaaggcaaacactgctccagggccagatggcttccctgtgggtttctataagagatgtggcctgaatttagggggatagttaaggaaatgttggatgaattgcataaagggaatctggatactgacagattaaattatggggttatcactcttttaccaaaattagcagatgcaaacaacattaaacaatacatgccaatctgtcttcagaatgttatccttaagatcttgataaaggctataaatgagagggtggctaaggtggccgagaagataataagctggactcagactgcttttattcctggtaaaaatattttggaaggttatgtgatcttacatgaaactttgcatgagctgaagaaaagaaaaaaagaaaaagggataatcttcaaaattgacgttgaaaaggcttatggcagggttaattggaactttctatatgaggttacgaggaagaagaacttcagcagtgagttcattggttgggtgaagaaaatctcgggggggggggggtaatgtcagcattaatatgaatggggatcaaggcccttttttcaagactttcaggggcttgaggcaaggggacctcctttcccctttgctgtttaatttggtgggggatgctttggcagctatcctgaaaaaggcaaaaacaagtagggttttagaaggtttgattcctgagctaattcctagaggtctgactcacttacagtatgcagatgataccatcttatttactactccctccatctacttttgatagtcatatttccaaatatgaaaattttatttttgataagcatatttcaatccaacaacctatcatcataatgactttctcggatttaatgcatgactctccattcttccacactagattggctacatggccattgaaaatgtaaatattaatgaatcgcatgtttacgagaaatgactagtaacatgtttaaatggatgataagtagaattacttatccttggtctgtgtactaagatgaaatatgactatcaaaagtagatggagggagtattaaggaaggagtttcaaatgtcagggtgttgaagttcttgttgttctgctttgagggtgttgaagttcttgttgttctgctttgaagagatgttaggaatgaagataaattatcagaaaagtgagatctatgtgatgggtgtagagaaagatgaggagttaagaattaccaacatgtttaactgcaaagtgggaaacatgcctttcacttatttgggtttgcctatgcatacagagaaaatagggatgagggagttcagacaaataactcaaaatgtggaaaagagattgcagtcttggaagagtggttaactcatctatggtgggagagaaattaaaatcaattcatgtctgtcaagtgccccaatgtatgttatagggttatatcaattacctagggagtttcataagaaaatagattctttgagggggagattctattgacaaggccttgggggaaaaaagaagtatcatatgatgaaatgggaaggtttgatcagaccaaaggattatggtggcttggggtttatggatactaaaacaatgaacttgttgtggggacacccgataaagtcatggtgccccacgaatacgtaactgcacaggatgttcagttacgcatgaaatgatataaaagcataaacttcgattatacaatacttagttcacaacacaacataaatacaaaccattacatatatggcctataaagccttatttctacaaacagataaattgctagactccaccccaggaactgcctgagcgtaggatgacctagaaaccatagctatcccactctaacagatcagcaggttctccacaagcatcttcctcatgatctgaacccatttatgagtacaaaaggtactcagcaagacatgcttatgataataaatacaataattgcaatataaaacatgcagtatcgagagctagaaggtttaaaccctaaccttaacagttatttcatagagcctaacttaataaacatttgatataaacaacactattgaacatttaatttaaacaataataacgagcataacaatataaatgttacttataaataacttgaatagaacgtcaagtaataaataagttaaccatattaattaatagccatttagtttaacttgtgcccataatctggaatcacccatagacacatctccattaaccgggagcacggcatattcgaatactcaacgactctgcagtgcctgcccagctttacccacatgatacccacagctggctaggctgaaaagtaacaaggtgtaatattgctccatatatctctcccttctaccagtaagttaaaggatgctcgggatgttgctcggagtgatccggtccgaggtgtgtaccaacctacctccgcatccacttatcattgttcgttactcgatgggcagcccagaacttcatgggcccatagggcagttctgaactctcggggcccatcgagcccacatatataaatcatataaacatgaaacatgtcactttgcttcacacacttgaaagctaatggccaatacaccgaaaggcatgcagaagtttaatcaattggagcaatatacggccaggttcgacaaatcgattgtgtggatgggcgaaactatgtcattcttcttgacacaagggggttaattattatatcaattttaaataagaaataaccataaatatatcgatatacccattatgaccataaacaggtccatgaaaccaaacacatgaactctatcatgtgttccacccgctcatatgcggtgtcaacaattcttagcatatagccataaatagttccataagcatgttttcatatgcaatgataataatatccatattaaatcgatagcatgctaaataattaacattttgtttaaatgtttatcaaattttatcctaagcttgttagactttaaggctcattaaggtatttataacaacaactgaaaatataatgcaataatagcaatataattaatttaaaagaatttgtgcagtctatcgtactccaaaggacaagtacgctactaaaataactctatctaccgggattaaattgttcaagggagggtgcatgtcttgcaaccttcgggcttgatgtagtcgtacaaaccgtctccttctggcgtggagatttcactcgtttcgactaccggaccaacgtcagcgttttctatttatgcaacaatcatcaccacaataaataatagaaaaacaaaaataaacaaaacaaatggtatcacaaagtgcaacaatgggtgaaaaggatttaaagaaataattttagggatttttggaatttcagtaaacggcaaaccctagggctaaaattagggtcgcgacaacgggtgctcggattgcaacgaaactgagacggatggattcggaataattctaggagtttggagtaggtctcggatttcgatttcgaggtcaaacggatggtaaatttttatgatttattaacttgatagaaagagaaaaaggatttttctctctcgctctgcaccggaacggccggcaacaccctggccgattgtggagatggccgattttgggcaaggaggcaccggttttgcgatctacaggatacagcgactccgttcccgtggatggcggcggcgaggctggcgacggcggctaggagctggaggcggcggcggccatggcggcggtgattctggcgaactccggtaagggcggcggccatggtgagcatcagtggagcaaggggagcgcggtggtggcggcggctcggcctggggcggccggcagcggcggcacgccgtacggctggcgacggccgaacagagcggcgacgtcgggaggcggcgccggcgatgttccggcgatggatttgaaggggaaagagaggggaaagggagtactcggcatggagaatccatttgtaccttcaatttcagaagatttgcaacgtatgcgacgaattttggagctcaatcaatggcgcaaaattagggttttggggatttttcctccggtgacgacgattgaggcagtgggagttggggcggatttgagaaggtgaaagaggtcgaaatttcggttcttttgcctccggtcttgagccttctagttgagggacgaaggagttacggaggcggaaagctggaggtgtcatctgggcattcgttcgtcgttcgtcctcgtgtgcgcgcgtgcgagcgtgtggcatacgcgggctggcacgagctgggcgtgagcgtgcgcgagcatggtgcgggatcggcgcgtgacaacacggggtgacacaggccctggctcggcctagccgagtagaggagacgaaagaaagaaaacagagaaagggaaaaaatatagggaaaaagaaaattaaggtggaaacagagaaaagaaaaacatgaggaagattaaaatagataggatttgaattgatgcggaatttagatagtccgacattcgggatagaattaaatttggatacaaaggagttatttgaagtgtaagatgcactttgcgacaaaattaaacgagaaaagaaacataaaaaaataagcatggaaaataatattttaaataaatgtctaactcgacggtcatatttttagagaatcaaagcaaactaaattggttttaaaaagttgtcaaattttagggctgttacagttctaccccccttaaaggaatctcgtcctcgagatttaccagttagcaaataggtgcggatatttcttttccagctcagactttctttcctaggttgcctcatcttctgagtgatttttccactgtactttgcaaaattcaattcctctatttcttaacctcctttcagtgacctccaatattttctcaggttcttcttcatatgttatgtccgtctgtaaagcaatgtcatccagaggtacttgttctgttggttttcttaagcatttcttgagctgtgagacatgaaaaacaggatgaattccggttaattctgctggtagttgcaactgatatgatacttcacctcttctttgcacaattctataaggtccaatatatcgaggtgctaattttcctttcatttgaaatctttgaactcctttaagtggcataacctttaaataaacaaaatctccaacttcaaaacttaagtctcttctttgattattgttgtaattcttttgtcgattctgtgttgttttgagtttttctcgaataatcctaacatgtgcttcagcatcatgtgcaatttgtggaccaatcaactgtccttctcctgttttagtccaattaagtggtgtcctacattttctaccatataaagcttcaaatggtgccatcccaagacttcaaatggtgccatcccaagacttgactgataactattattgtaagaaaattgggcgaatggcaaacaaatttcccaaactaggccataaaccaaaacacatactctcagcatgtcttcaagtatttgattaactctcagtctgtccccagtttgtggatgatatgctgagctgaatcccaactttgtacccatagcttcatgaaaactcctccaaaatcttgatgtaaattgggttcctctatcagagacaattctttttgtactccatgcaatataacaatccttgtgaggtacaactcagcaagcttgtttccatcatatgtttgcttaactggcaagaaatatgctaccttagttaatctgtcaactataacccatatagcatcataacctcctttagtctttggtagacctataataaaatccattccaatttcatcccattttcattcaggcaggggcaaaggttgcattaatcctactggtctttaatgatctgcttttaccttttgacatacttcacataaattgacatattctgcaatttctttcttcatattagaccaccaaaatattttcttcaaatcctgatacatttttgtactcccagggtggatagaaaataaagaatcatgtgcttcttctaatattttatccttgatttcctttttatctgaaacacatatacgcccttggaattttaaaactccattattttctgtaaatcctggggctttgttctaattttaggagaaatttggacactaccagggaggcagatctgaaggatttaagaaatctattgaataaacatgccctaggggagggcaaagatattttaatatggccatacaataacaaaaagatcttctcagctagatctatgtatagggtgattacttttggggtataagagatgttgaaaagatgaagatttggagaagtaaaattcctttaaaaatcaaagattttctttatatggcagacagaggcaggcttccttgtgcatcccagttgattaagagaaaatggcagggaggggatgaattctgtaaactgtgtggcaagattgaatctactaaccatatcttgtttaaatgtcttcttgttgtctttactggtgtgtggtgagagatgttttgggtctaaccattagtcctatgaatataagagattgtttggggttaatgaaaagaaaaaatgtccagggggtgtgggtgatgctctttgctagtgtgtgctgggcactttggctaattaggaatgactgggttttctcaaatattttggcaaagtctcctttgcaaatcacttataaagctttgtcttttattcagcagtggtgtatcatgctaaaggaaggagatcaagctactatgaaaggatggtgtgagctgctgatggccaaactgcaacaattgaagccatgtcgtcttcctgtgacaatttgagtctacttttggcttcagttttttgctgtcttttgtaccaggggttagtgcctgggggaatgtgaggtgttatcaaggtatggaatgcttctgagagaaccagtgttatgtgccgactttttttttaagtcttttgtttcgtagctttgttttctgtgtttgtataagactctgtatactgtttgggctttcttccaaagccgggtcaatgaaaatttgatctatttcaaaaaaaaaatgttcaattgactaaattttataaaatcgttttacacgtctaaatgtggggaaaaactggctaaattaatcacatgattactctttcattaatcacctttatacacgtacatgctaacaggttaggacaaaaaagaaaaagaaaaagaaatattttcgtggatgtcatcatcgatccccatcgccattgacgccggtcggcgaccttcccgtctaccgtgctgccatcttcttccacatcccctctatccccatccccaggccccagccatgccgctccatcccctccgttgcttcactgctccatccatccctccactgctctgctgcttgctgtttgtcacacctagaaattcactagtaatttttaacttatttatgcataaaatcctcgtccagaaatcagccgaggtacacaaactgacaatttaatatacagattcatcataatagtaacgttacatacttacaaaagaaaagagaaaacagcaacggataaacgatctagcgaaactccggctccactcccacaggcagctcaactggggtataagccaaacgtcttctcctttgggacttctcttcaactgaggtttgattgattattacaagatgattacatggaatactccgcaagccacacagtaagtatgcaagtacacaagaataccaaagaatggcataatatagggctcatttgcaaaagcagcatttagcaaacatttgagaattgtaaaccagtaaagtaattaatcatcaatattaatcaacactgaacagcacacccatgctgcacaggcccaaccaaacctgaacaaccatacccggctgtacagatctatctccaaaccaggaatgtaccattccaaaccaggagctaatcaaattattaccagttatagcatcatttattatggtgagaagtgtgagactaatcacgaaagacattgttagacctgcccataaccgcgggcacggctattcgaatagttttactctggccagatgtgtaccactgtacccacaagacatgattccacacatgttaccatgctccgaagtaccaccatggcactgcaaagggggaaatcgtgacagtacccttcgcacaacacaactcaaagcaatgcgtcgttcctggatcataatcacccccttataaaacaaggcatggactccccaacgatccccgtgggcttatctccaccacttctcagtctggtgccccgcaatgaaccatgctatacaaaaaataaagccgttgcccatgctagcttgtggttggcacggttaatgtttcacaaccgaaactcgtgaacctgtccttaattgtcatgagcacgaccatcaaaaccatgtgctcacaacccaccattatcaagttttaattagttggcaaattaattaattaatcaatcacgattaaccatcgtgagctaccattaaatatccatcattaagtaatagtgaatcattagttatcccaatcgtgtgctaatgtttctaagcatggctaagcaattatatctaaaacagttgaaccaatatataaatccaactagtcaaattataacccaaggtaatcaagaaatacggtaatcattccccgaaaaaaaaagaaagagtaatcaatgcaaattggccataacaaaggaataagttcacaccacccggtgacattcgaaaataaatacacatttaaaataaatagagaatcaacatgttcaaaggatttgtgtttgggatctgtgtgacttgcaacaatgggtcttcaataagtcttcttgaaaacttccgacgcactcacgatccttcgaaacgacggaaacgacaagttaacacgcaaaacaaggaaaaagactaataaaaaacaaataaacagtacatataaagtaaataaacaagtagatcataatttaagatgaattatgagacttgaacggcctcattccggtttcatatgaattaattatgaattttacaatatttaattccaattaaatctattaaagaaaacactattccaaattaattaaacgatttacaaataatttataactaagataaaagattggaaacatcctctagaaatagattagattatatttggtagatgacatatattaaacagaaataatatgccactgaaaagagagaacggatttatatcgattttggacggctgagattaatcttgaccgagtcgaccaagatcggatgacttggattgatctggaaagcgagcctcacgacatacaaactcaacgagtcaattttacgtgacacaggatcacccaaatgatcaaccgaaaccggcaaacagaaccggcggctctgaactaaaggaccactcaacacggatgaacgaacgaacatggggaacaccttgttcgaacgaacgaacgaacgactcaacaacggctgcgacaaaaccggtgggctagacacgattcacggtaaagccccgatacggcaaatgataggccggttgaaacctagggttgcacctacggctagacaactcgactaccgagcaacgggctaaagcggtagctaggttaaagcggcacacagctgcgacacagcgacagtaaagcgactttgctcagctaggcggcggcggctcggcggaggcacgcggctagggttaggataacggcacagcgacaacgacacacatgtggcttacacaaacatctaccctaggaatcggagagaaggcctcaccaggaaacggtggcgacgggagaagaagaggccacgacaacggtccgacgacaacacacggagacgatgacgacgctagggccaaacaagattagattagatgggattaagaccctagtgataaactacaccggtgaacgacgtgggagagaggaaagctcactgaggggtggcgtgacgatggatgacgacggcagacggccggcagcgaggtagaggcggtgacggggtcgggtcagcgatggcggcggcgtttcagcgttcctcgatgaagaaaaaccagtggccgggcttcaccttgttcctgcgaacccaatggagtcgacggcgaccgaaggcgacgacggatgacgacgaacgtgcggctggaggcacagcgacgacggcggcgctccggttcacgacgacgggctacctccggtgggatttggcacaaaataaccagcggctgggatttgcggagccaagagaggtggcggcgcagagcggcgacgaccgaggcggcagcgcacggcggctggagcggctaccggcgacggagagagaaggcgctcgcggggagaaggtttccggcgacggcggagagagggagaggtggcggccgaaagaggagctggagggggctctatatatagccatgggagcccaggatcgagcccacatcgacgggaaaaacttgggaaagtttaggatcctcgccgggaaaaggaaaggttgaaccgcgaaatcggaaaggatttccataaaaacttttggggatttcttggggattttgtagaggagattgagaggattccattcccgcaactaatttggaatgaggagtaacggggaggccggatttggaaggaggaggcgccagtgcatgcgcacgggacagaggcggctggaggttgaagatgcactgaagcgagggagcaaaaacagacttcggctgagggagcagcacgggctgtaggctgaggaggaaagaaaagggaatgggccaaattcggcccaatactaggaagaggaaaagaacttctttttcttttaaatctatctatctatctatctattattaaaacagctttgaaataagacaccacgttcactgtgggggctagaaaatcccacattaatcggagaaaaagaaaaaaaaagaaaaggagagtccaagtaaaaatacgatttaaaaatatcggaaattcggaattaaaaataagcaatattaaaagaagtttccatataagaacccaatacgagattaatcataattcaaaataaaaataaaataaaatccaaaactagaaaaggaaaggagagtccaagtagaaatacgatttaaaaataactgaaattcggaattaaaaataggcaatattgaaagaagtttctatataaaaacccaatacgagattaatcaaaattcaaaataaaaataaaataaaatccaaaattagaaaaggaaaggagagtctaagtagaaatacaatttaaaaatagctgaaatgcagaattaaaaataaggaatattaaaagaagagtacatataagaaccaaatatgagattaattaaaattcagaataaaaaaaatccgaaattagaacaagaaaataaaagaagagttcaagtaggaatacaatttaaaattagctgaaattcggaattaaaaataagcaatattgaaagaagaatccatataataatccaatacgagattaattaaaattttgaataaaaaataatataatatcaaaattttgaaaaattaaaagagagtttaagtaggaatataattttgaaacaactgaaattgaaaataaaaaataaaaacattaaaaaaacacaatagggtattaacttttttaaaattatattattaaaacagttttgaaagaaggcaccgcgttcactgtggggctagaaattaccacattaatcagagaaaaagaaaaaaaaaagaaaaagagagtccaagtaaaaatatgatttaaaaatatcggaaattcggaattaaaaataagcaatattaaaagaagtttccatataagaacccaatacgagattaatcataattcgaaataaaaataaaataaaatccaaaacttgaaaaggaaaggagagtccaagtagaaatacaatttaaaaataactgaaattcggaattaaaaataagcaatattgaaagaaatttctatataaaaacccaatacgagattaatcaaaattcaaaataaaaataaaataaaatccaaaattagaaaaggaaaggagagtctaagtagaaatacaatttaaaaatagctgaaatgcggaattaaaaataaggaatattaaaagaagagtacatataagaaccaaatacgagattaattaaaattcagaataaaaaaatccgaaattagaacaagaaaataaaagaagagtgcaagtaggaatacaatttaaaattagctgaaattcggaattaaaaataagcaatattgaaataagaatccatataagaacccaatacgagattaattaaaattttgaataaaaaataaaataatatccaaaatttgaaaaaataaaagagagttcaagtaggaatataattttgaaacaactgaaattgaaaataaaaaacaaaaacattaaaagaacacaatagggtattaacttttttaaaaaaataaattctgaaattagaaaaaagaaaaataagatttcaattaggaatacaatttataaataactaaactttgtgataaaaataaagactattgaaagaaaataccatataaaacacatgatgagataaaattaagtaacaggcctataaaggagtaaagtggtggcggttgatacgatatataaaaattgttaataaaacactaaatagaatcctaatgacgattaaaaggagggacgtcaggcatgccgtaaagcaaataagtaagacggttgctgggacttctagaaaattaaaaaaaccatttataatcatattcgatttttaaaatctcagtgataataaaaaggagaagcagcgggcggggtgtataagagtatagttgcagagccaccgacggttgatgggacttctagaaaataaaaaatgaattacaacgatagttatgctcaatttttagaatcacaatgacaataaaaggtaggcatgagacgagctgtagagggacatagtggcatcgtttgatgggacttctaaaaattataaaaaataaaactacaagtccaatttttaaaggtttagaacttttaaaaagtaaaagaaaaaaacaatgataatcacgttcaattttaaaatcttaatgacaataaagaagggaggcagtgggcgagccgtagaggagtacaatggcaaagctgctgacaatttggcgggacttttagaaagtaaaaatgaacccaaatgataataatctttgatttttaaaatctcaatgacaataaaaagaagagacagtgaacagaccgtagaggagtataatggcaatgttcaacgggacatctagaaattacaaaaacgaaacccagcatgacaataaactctaaaaactataaaatccaatttttaaaggttccaagaagaatgaatagaaatagtgatagatcgagtaagcaaataaagaagaagatgacataaggggtagcaactggtgtgacttttaaaaactatataactagaaacacgaggatgataagatttggtcattcaaagtcttaagacaatgagatagctatttaataaattttaagtaaaatcatactaaaagaatatatgattttgtttgggtgctagccttgcaattgcgcgggccaaccagctagttaatcactgaaatgatctttgaattgttaaaaatacttccgatgctcaaataatttcaagaaaaatcctgaaaatattgggcactcaaagtacttaaaaaaatgaaaccagctcatttaatgattaatttaatatttaaataattgctgaactcttctttgtattattacaattaggatttaagctctaaaaaatctgaaaaaaatccagatagtataattaatcatggagaatttaataaaaattaaatccagccatgctttatatttaggaaattttatttcccacatttaacttcacttgtattttaatgaacatttaatataaattctattaataatttataaatccgaaacgaaaattcaggctgtgacactgtcattggtggccagatccagctgctgatgaagggagagaggatcttggcaatgactcggactacaacaaaggtggcggcagtggtaaagaccgtcgggccgtgtgattttcacatatgcaattgcagccgctgtcctctgggtgctcctcctgccagatctatccggcagcgagctccacgccgcttggtcgcttgttgccgcgtctacttggccgagcgcaaggaggagaagaggacgagcctcactgatacctctagccacccgagcccgaggaggagaagaggcggaggatagcagtagcaacgaggaggacaaatgagagagggttcttggggtggagtggttacccccaaggccgtcgatgagggtgtgcaaaatgagcgaccgaacaccccaaaatttaggggccctaatttttttattctttaatctacgccaatgcgttccaatatatttgaaggcctcttgttccatttttataaagtttcacttttactcatttgttcattggctagaacaggcttattttttttagctccgataagtgttcgatggcaatcatggctaactcaaagagctatagctcatgacgatgatatgaacatgcgttctaagcattaaagattccatttttccatataataaaaataaattactacatcataacataatatttttctaacatttatttaaaattttcttctcactgagatagagctccactgctaatttatttttgtgtctttcctacttatattagcgttaaattgtgtttcacaccggggcctcgaattcgtaggtacggccctggttaccccaaccaacgagctgtagccgcgggtgcagcactgcttgcgcggatgcaaacgcgttgcatcgagcgggccaggctcgtgagcaaagctcgattctcgcgtttctctcatcctgactatggtgatgcaattttcacaaggcggcggtctgcggaggcgatggctagcgtcagtggcagcggcgacggtggtcgtgactgtggaggcggtggcgacatcggcggcggggaaggagtcgggtgcgaggtgaggatggcaacggcgaggtggctgggcgttcggcagcagcagctgtggtggtggtgaccgtgactgcggtcaccagaggcatgacggcctcggacggctacccgagggcgtgggagacggctccatctgaccgtcgtggcatcgtttggtggaggggtcggagacaggcttggcgcagagaagcgcagccgatggcaacggaggccggctcggcgcgagagacgtgggcggcggagatggaggccggcttggcgcgagaggcgcggccgatggaggaaggccggattggcgcgagaggcgcggccggcagtggaggagacaacctagatgtgagaaggagttgccggtgggtgtggcgcggtcttcggcgcacgaaggctgaccggcgggggacgctggtgcaggggtcccacatgtcggcagagcttgtgtggtggtggagcctcggtgcgtcagccgtggattcgcaggtggtgagcagcgggtgaaaacccagtccggccttggccggaccgacaacgatgttccccctcctgagggcgttgtcgtgctgtctcacccctcaagggtgattaccgggcgaaagcccggtcttgtctcctttgagtcccaacggacggcagcggcggatttccgtcgcttctcttcttgaagacgtcgttttggcatctcctaaatctcgtatgtgtccctttgttggtctagtggcgattggtcacgcttagtgacggccggtccggtgctagccttctcctgggcttgtgtgttggagatgtcggtgtgtgggtggtggtatattttttttctttttcctggttacgacccttcagggttgtaatcttataatttttcccttctctatcaataaaacttcgcatcgtctcgtgtgagtcgttaaaaaaaaattgcacaaggtgaaacaggctgagagggtagtacaggctaccaacttaggcaaggggatcctttatcccctattctttttaatatagtagctgacatgcttactctattgattaagagggctaaagaggcgggactcttgaatggggttattcctcatcttgttgatgatggtgtgtctatcttgcaatacgcagatgatactattatctttttggagcatgacttgcaacaggcaaagaatttgaaactgattttatcggtatttgaaaagttatctggcctaaaaataaattttcacaagagtgaattattttgcgttggtcaggcaaaggaatgttatgaacactattctaatatttttggttgttagttaggtacctttccttttaaataccttggaattccgatgcattttaggaagctttctaataaagattggaaacgtattgaagagagaattgagaaaaagcttagtagttggaaaggcaagcatttatctgttggtggtagactggtgttgattaattatgttctttcaagtttagccatgtttatgatatctttttttgaggtgccgaaaggggttcttcgtaaaattgattattatagatcacggtttttttggcaaggggatgaccataagaaaaaatacaggctcactaggtgggatgttgtttgtcaacccaaggaccagggggtcttgcgattcataatttggagatacaaaataaatatcttttaagtaaatggttgtttaagttaattaatgaggatagggtttggcatgatttattgaagaggaaatatctttataataaatctataacccaagttgacaggaaacaaggtgattcccatttttggtctggtcttatgaatgtcaaaagtactttcttaaatatgggttcttggattgtcaataatggggaacaaatcagattttgggaagatagatggattggtaacttggcttttaaggataaatatccatctttgtacgcaattgttcggaggaaaacatcttctattgccactgttatgggatatgttccgcttaatgtatctttcaggagagctttagttggtcagaatcttgtttgttggcatcagttgtgtgcctttatagtacatattcagttgaatgatttgtctgatagttttagatggaatttccatcagaatggcttgttctcggtgaggtctatgtacctagctttaattaataatggctatatcgagagaaacaagtgtatttggaagcttaagttgacacttaagattaaaattttcatgtggtacctgcttaaaggggttgtgttaactaaggataatttggcaaggtgtaactggaatggcagcttgaggtgttcttttttttgaagaatgagtctattcaacatctctttatggattgtcattttgcgaaatttctatggagagcagttcagttctcttttggttttaatcttctagttagcatatctcatatttttaatgggtggcttttgggagttgataagaaaatgagtaaactgatacttgttggagcttctgccatttgttgggcaatatggctgagtaggaacgatatggtttttgacaaatcaccatcattttcctatatgcaggttattttcagggcaactcattggctccggttttaggcacaactacaaaggtgtgatgaagatgaagagtttctgaaggttgcataccaaaagttggagaccacggttatgcaactatttgccaattatggttgtagattcacgtaatagacttcaataattatgatctccttacgttaggctggtttcaataatagtgatcttcggtgtgttctattcatttagatttacactatgttcatgaaaactactatgtaataattggctgtaactcttttgagtaaaggctgggatattatattccattattaaaaaaaaaacaaggtggtgcctgcacggcgggtgcgagccagccctcgtgcaggcaacgaaatagcctgcaagtttcccttcatttgacctgctgagcaagcgggtagcgggcagcggccatcggagaatgcagcggccgccagttcgtctgtgggccaaatttgttgggatgggccgagccacgcctgttcattgtcgtttcctgttgcagtcgctctgtccgtccggaccggaacggacgaagtagctgcggccgacgttgcttaccaaacaaatgggagcacgaagaacggtgccgtgtttcaccacctcagtgttcgtggtggtggtccgccagacgacgttgatcagtggcataggggagatctgcaccagacaccaggggaaggttaactaaacactcgtcttctttagcccattccctatctaagacactagacatagttttcataaactctatatcaagaaactagtactatacactactcttttaatacaaacagcattattccatacttaaatttaatgctacttatatcacatgatgttttaaatattgtgtagaaactatgtctcatgcaagatatggtttccttctattttctcatttattcacttgacacatcatttttcattctaactggcagcttatttaatgctatagacaccattctagttattgggttgaaaatggccttagatgagctaattaattaattaatccaccgttctagaagttcaggcaaaaatcagcagaagagaccgaaacaaaaagtccgcaagactttgggctgcaccggctgcagagaccgagtcgcgtgagtgagaccgatcgaattcggccggtcggtttatagattttcaggccacgcgcgcaggcgtgcaggggaagcggatcttaacgcgcgggacccaaaagggcggcagaaaagcatgtgcagtcagcgcgggaggcccgccacggaccggcgagctcaaccgtcatcgcgttcgtcacgctcgtggccacacacacgtttggcacttgcacgcgcccggcaggtcggcacctctgaggtcgttgtcgcgttttcagttcatttttcgggtacggatatctgctgaaacataccctatttttcataattctaattcgacctactttatagattttgacactagtccacaacattaatattatttaaaatttaaatattttatataaaatattttatatttttatataaaacaagctaattatatataattatatatgatgatatttgtttccgtgttctgaaaaaatggtttccgtatttgtgtccaattatatttgttccttattcatatttaaataaattgtatttatttctgcatctgagttgttcgtattcgttttcatattcggcaaaaaaaattataaaaacgaatatgatataaacattatccgtctacatccgttctgttttcatttttaggtgaggagcattgtacgtacagcttgcgtccgcgtcagcggcagctatagtagattcaaagtttcacctctgtttcgtcagcggcagctatagtagattcaaagtttcgcctctgtttctcactatcttcagccccccacgctctgtccataagtatgatttatttctagcgtttaacaatttatttagaagtgtaagcatttttggagtactattttcccagcgaatattgttcacttctagcagcatgctcgagatagagtaggtgacgaccggaaggccaccgctatccgcaagtgatcgtcggcgacctctgtaggatgaagtcggcgtcctcactgctattactacttctcctgcaccgacaatacgcgaggtggttctgcatcctttacatttactccggttcaagctagaacaatgcaatggcttcaaacaacagtcagttaaaccctaattccacattagggtgatctacaggattagcatatgttttagtagatcgaaaatctacatgggtgcctaatggcaagttttatagtaggggtagttgccaataattttatccatgtaggatatgaggtgatatatacaatacaccacatctatactacttctagcatactaatccaaatggttttattttattcgtgtgtccaatcccttctttctttcatctttttttctttgggtttgttagaggttgccccttgcataagggatgggtcgtcttctctttcatcacttatttcttacacctcatcatccaattatatgtggcaattttagaggcaccacatcaagcattataatcactgctagggaagtggtctttagtcccggtttacaacccctcctttagtcccgggttacaaaccgggacgcccaatccggaactaaagatggcagcaccacgtgttttgcgctaccatctttagtcccagttggtgttatcaaccgagactaaaggtttttttttcttttttttcattggtttttactgcttgcatattgatttcctcaaattgagttgctccctacatccccaagtcacatataacaccacatatcacagataacatcacaaattcacagatttacataataacatatcaaatacataaaaaaattcacagattcacatcatagatcaaatatgacagggttatggataccacatacctaatagtagttgactaaatctcggtaggatccaccacataccatgtcctatacggaaacaacctgtggatataggaggagttccggataaggaaagacaaccagagttctacatggaaacgacaaggactactcggattgtatccatattggtttccctagttctacttggacagggggacacctatgggtataaatacaagcccccctaagaggagaggggggacaatcaacacacgaccacctcaatcaacacccaatacaatcgacatagaagccacaacatagaagcctacatacgccaagacacgccgtcggatatcgacttcagggataagcacggctagtaccctacggtgtctccggatactgtcaggagagacgaaagcgctatctctgatctcgccgggcacggattcgaggtggaaggctaccctgttgtcgactacgagtcagatcgtcagaccgccatgtcgacaacagttagataggctaccccaaatattgtattggtgtgattatcatgaataagagcaataccggcttcggccaacaggatgtagggttattacctgaccgttcaggggcccgaacctgtataaaaatccctgtctccatctcttttacctcagtctcgcgtataccctagcaccgacgatcctcataccatgcaaatactagaaccgtgacatcaaacgtcgacagtggcgcgccaggtagggggattttggtgcttcaaggtttcgacgagatgggtttgagagatggattctccatcaacaagctactcgacgacttcggctttggggagatccaacctgtccaagtacatcttgcgactagatcggaaccatcatcgtcatcgacaacttggtctatcgagatcatccaagcctcaagctccgcggtgtaccaaaagatgtcagatcacatgatatcgaacgagtacgcagcaaggtaattggtagattggttttttaaattgatctactaatttcgtggatacatccggcatgtatctacaaaagtacgcaatatttcatatgcaacttatcgtacctattcagatcatacaacattgtcagatccatgatttattatgttttcctagagcatgtcttttatacaatatctattgcgcgaatgtccccgatgttaaatcgactacggtctaacgctgggggctcgctctgttctcttctatataaatcatgcttgcttacagtttacataatgcatgatatttacatctgcttgttatatcctgataataccagaagatctatgtagttttttgagtacatactcgatattatctgctatatatcttgccttctagaaaatatttttcaggaacaattgagcactcgagtaggtcgtggtcaagtacaccgcattatcgagaacgatctcgacaaatgcagagtcgtcatgcccaacctaccaaagaagaccgacgacctatctcatagcgccggccatcgctggactactcgagaaaaggttgttaacggataatacctcgcgaacgtcgtcggcttgatcacccgacatgattgcgaacgaacattcagatatgctacaagttgggtgtgtgagtcatgctggccacatgagacgcacatgtaataaaccaactttagcacctccgttggtgttcgagagataattctacacactcgctggttctcgaaccagcacgtagcaatctctcgcaccgcaaacttccattggtgtccgagagataactctactcgctcgctggttctccaaccagcacgtagcaatctctcgcaccgccaacttccatcggtgttcgagagataattctacacgctcgctggttctcgaaccagtacgtagcaatctctcgcaccgccaactttcatcggtgttcgagagataattctacacgctcgctggttctcgaaccagcacgtagcaatctcttgcaccgcaaacttccattggtgtccgagagataactctacttgctcgctggttctcgaaccagcacgtagcaatctctcgtaccgccaacttccatcggtgttcgagagataattctacacgctcgctggttctcgaaccagcacgtagcaatctctcgcaccgcaaacttccattggtgtccgagagataactctactcgctcgctggttctccaaccagcacgtagcaatctctcgcaccaccaacttccatcggtgttcaagagataattctacacgctcgctggttctcgaacaagtacgtagcaatctctcgcaccgccaacttccatcggtgtccgagagataactctactcgctcgctggttctccaaccagcacgtagcaatctctcgcaccgcaacatccattggtgttcgagagataattctactcgctcgctggttctcgaactagtaaaacgtagcaatctctcgcaccttaacttcggatggtcaaggtacgactacaacaataacgcagcggtcctcgcaccacgacttcaaatgatcgagagacacctactcactggttctcaaccagtcaatcatagcgaactctcgtacatttgcttctagtggttgagttacgactactacctggtccccgatcagaggtgtagcgattctcccactacctttacttctagtggtcgagtttagactacacctggttctcaaccagcggtgtagcgattctcccactatcttcactttaagtggtcgagttacgactactacctagttctcgaccagcggtgttgcgattctcccactatcttcactttaagtggtcgagttacgactactacctggttctcgaccagcggtgtagcgattctcccactatttcctcttctagtggtcgagtttagactacatctggttctcgaccagcggtgtagcgattctcccactacctttacttctagtggtcgagtttagactacacctggttctcgaccagcggtgtagcgattctcccactatttccacttcaagtggtcgagttacgactattacctggtcctcgaccagcggtgtagcgattctcccactatttccacttcaagtggtcgagttacgactactacctggtcctcgaccagcggtgtagcgattctcccactatctccactttaagtggtcgagttacgactactacctggttctcgaccagtggtgtagcgattctcccattacctctactccaacaaagttgatatcaggtgcacagtatcgcctagtgttttacccagagatcccttaccataaaagacacctagcgttgaaacctatcctaacgtcccacgctgtcttgacaaagcctctgaggaacttaagggaacttcggctgtggacgcccaaagcggataaggctttgtcggatccttcagagacgaaagaccatgtaagatctggtcatgtaagagttctcgccgtgcgtgttaatcaagccgtgtaatcggaaattggattttccaacttcacggctgggggttaggatcagtgcttgttcaactgaggcaggtcaaaggtccaagagccttatcttccgagaacaattctccgatgacaaggctgggggctagggagagtgtataactctacaaactgactgatcggagtcggtaaaagagaagacgctcatatacaaaacactggtttataaatttaattcatcttcaatttttccagacatattataacatgtcacccttcgagcgttcgctcggggactatttctatctaatattcttttatgagtattgattttaggaaaattctatttgacattatcaaagactccatgtctctatggttctacaccaagatcgactaaggcgggtacgacaaatattgacaaggctccgtcgcagactctgcgccttctcgatcgctcgagaacggttggtggatatcgacaaggaatacggaatgaagaaatggtgtacccgccgagataaaatttcttgacttcaatccaaattctcgattacagcaagacgagagacttagtcgtatgctctgtactttcttggttgacatcagagattgactcagacaaaccctttaggtgcccgcacgaggctaacaaaggaagtctaacgttatctttaaactcaccgagaacggtcacatgagttcgataacagttactccaatgtctgcgcgcggttgagaatatgaattcgttcatttgcatcgaagtcaggggctactgtcagggttatgggtaccacatatctaatagtagttgactaaatctcggtaggatccaccacataccatgtcctatacggaaacaacctgtggatataggaggagttccggataaggaaagacaaccagagttctacatggaaacgacaaggactactcgaattgtatccatattggtttcccaagttctacttggacaagaggacacctatgtgtataaatacaagctcccctaggaggagaggggggacaatcaacacacgaccacttcaatcaacacccaacacaatcgacatagaagccacaacatagaagcctacatacgccaagacacgccgtcggatatcaacttcagggataaacacggctagtaccctacggtgtctccggatactgtcaggagagatgaaagcgctatctctgatctcgccgggcacggattcgaggtggaaggctaccctgttgtcgactacgagtcagatcgtcagaccgccatgtcgacaacagttagataggctaccccaagtattgtactggtgtgattatcatgaataagagcaatactggcttcggccaacaggatgtagggttattacctgaccgttcaggggcctaaacctgtataaaaatccccgtctccgtctcttttacctcagtctcgcgtataccctagcaccgacgatccccacaccatgcaaataccagaaccgcaacatcaaacgtcgacaaaatacatcataaattctcaagaagaaatacatcacagatcacagtctcacagatcaaatatatcacaaaatctcaaaaaaagaagaatgaacttcttcctccatctgccgcacggctgcccgtcacgccgccgcacggctgtgccgacgccgtcgatctaccgtcgctccaccgccacctgggctcccatcccgtggcctctcctcccggtggatctggctgagggggagggtgcctccgccaccacttccgtcgctcggccgccgccgctgcttctcccgcccggctgccgcttccgcttctcaagagagctagagagacacagagagaggcgagagtggataaggatgtgtgagacgtgtgatctttacttgttgggggccgtgagacgtgtgatcttttactcgttgagggcctgacacggccagacagctattaaactggaactaaaaatgatctttagttctcaccaacctaaattaaaatcagaaagtgccattgggcttttaaactgggctaaagctgatctttagttatgacccctatttgaaccagggctaatgtgattttcgcatggtccgacaaaaatcccttctccagcgtagagcacttgcacttacccgccaacatcctggataatccacgatgactaggacaccatcgatcgaaggattacaagtagcgatgcttcgcgtggtgctgacgtcatcggatccgatattacatcacggcgtgcgacacaaactccattggcagcaacggctgcaagcgaccccggctctaatccagcgcgccgcaccaccacacgcatcacccgcccgccacccactcgcgacccgccacgtgtgcaggacctggacatccccgacccgccccgcctcaccggtcattcgcagcccaccaacctccaaagccggtctactgggcccacgcgtcggcgacatgtggcagggagggtggtgtttttcacgcgcggtccccttccatgttggggtattttaaaccggctcccgcctctcccagctatcgcctccccccgtctcctgctccttcctcttcctcggcagcttcgcctcctccccaattccaccgccccgcgcgtgcggcgagacctcggcgccctctgcccctaattcccgggccccgtaggcacggcgtgtacggcctcttgccctagccttctccccccttttcggcatcctcgctcgcgccgccggcgagcaggttttgaggggcgcggcggtcgtcctccgtctcgggttgagtcgaattgaaggtacaggttagcctctcctttccctccctcctcatccgggtcgcttcatgagccggcacagattatagcgagttcggagttccttagtagtacgtcttaggattttatgctggaatcgtcggtacttcgtttgcagttactaccaactttgctatggaccaatcgtccgcttaagaatctaacgccatggtagagatcataaaggcgatagggatacgctgcacacgcatatttgtccgtttccttcccttcaggttattaaattattttttaaatcgtgtagggaatgactggctgtagaagagtccaagcctccggctatcagctttactgccctgcttggagttgcctggatagctggattgcaagcttgtgtccacgttaaagtcttgttcttttcgaggtgaatgcgaaatttatatttgtttttttccctcctcctttcagttcctatttgaacagatttagttgtaatcatctgtacaaagtgtatgtcagatatccttttttgggggaaattagctcatcaccacccatcagcgattgtgcattgccaaaaaaaaaaagaaaaaaaagaagaggtttttaaaaacgaccagaatacccttaggtatttgttcattgtttcattttcactaaggccaagtttgattttgactcttgcccctcccatcgagaacatggcttctttaattgagatggacgaaggctttattctgttcattttgagttgtgtcatttccaaactgaactgtttttctagtattgttttgtagtgatgctcattttgaatactattttcgtggtcatattggtgttgctgagctactcagccatttccttttttgtattattaaattaataataaaaaactgatttacctctacaagcatgcatgtcccgtttttattctgtaatgaaagatgcagcggaagagtatcattaatatcctagaaatataatataataaacgattacaaccttttataactataattttcttggagttacttttgaagttaagcacagtagctgtctttctgtcatgcagactgctgtactagtatatcaattgatcattctttggaggtgttaggtattcagtgaatatttagcataggaaagttgtttgattattgtcagaagtgacaaacttcatcatgctcataatttcagtatccaaacatgggctggaaaaggaagacacatcatggaggatcatgtcatcaacaacaatcctgtccttcacatggtaatgaattgtctgcgatagatgaggaggtttcccatcttacgaggcttaaatccgagccatgtgagaggactcgtgcatcccttcatgctggaaaaaagaggcatatctcaacattcaagttgttgtcagggagagaatccaactgcttagggattggtaggttctcttcagctgattgctcttatgctcttcgtaaacacctaccagtaaaaggcccatggtgtgttgatgacatggacagtgaagcctacatatctcaattctccgcagatggttcccttctcattggtgggttccgggtatgtcgttgtgctattatagggaaaattataaccattaccacatgagtttagcttttgtttagataccttggctgcacaaaatgttgtgatatgggtgactgacaatcctttatgccaacaattaatcagggtagccatatcagaatctacaatgctgagaaaaagtggacgatacataaggacataacctgcaaaaagctacgttggacagtttcagatattgctctttcacctgatcaacgatacctagtaagactcttatgcattgttctcattctttcttttcttttgtgtgctgtttactcattgacatctagtgaactcactcttttcaggataacatatatgattccattttttgtaaataaaaattcgcatcaatgtgcttgaataatatttattacagtctgactatttttagttccatagtgtgtttcttttttccccttcatacatggatttgagccctttgtttgggtaatgcaagtttgaacctattgtgcatgaagaaaatatgagtgttctctgagttagaataacatatttgattcctagatatactaaaatttgcagattaccaccttcaaaatccatgcaatctgcatatttttataagcattttggctccattgctgtccatgttatgtaccctataagcaaggtggactctgagtaactcaacatttgattccccttttttctaaaaaaaatgtggtaaatagaaatatagaccatgaaaaattgaccagggaactgacagcctctttagggatatatcatgatagatttataaattccaaaacaaatcatggaccatatggattgtcagttcccctgggtactaagactgtactatatggaccatagctttaattattacagtccactatgattatacaacaaactgttattgcacttcatatatctcatcaaataattgttgcttatgtttgtatcttctggaccttttctagtagcctgtccctacagaacttatgatacatgtgttctttgagaactgagtaagattagatagactaatttctacatgtaatttttcaactttgcacttctttattttctttcactagcttagaagtatttacaagagttcttcctataattcctaacaagctacctttagatgtctccctaagttctattcatgaagttacacttgagactagttcaggtctttttgtatatttgttttatatcattaactaagtgttactcgttctttttgcaggcttattccagtctgtcacctatcgttcatatggtagatatccagaatggcatgagagaatcacatgccaatattacggtatatcctctgatgataacaaaaataggaaatttggagtctatttgtattgtgttgcagcatgtgctgactccagaggcacttgaaaaaacataccatggttttacttatatttaaaaattctagaggcgtttttatttgataagaaacatttatacataattaaaaactataacctttggagttggggcgcattatggttagtgtgcaaacatgaaaaataaatcaacactattatacagacctgccagcccattcaggttgtcacaaaaattactctattctaccccttcaaaataaaaccacctcctaaatggatattttaaataaaataacccctgagactgtttcggaggtagttttgccattgtgacagctggcgtgcctatgagatgatgagggcaattttcttcgtgctatgtcttcttcctcagttactgactttcactgtggcccaaggttcgaaaaagcggtatccagttttgtgtggtgaccccaccttgtagtgtttatgcggcataattggatgcttatacggtataatcggacacttatgtggcttaagtgtacaaggttggggcacctgttccttgtatgcagccttttagaccttttttcagaacactgctatgcctagagtgcaacaacgcccttagttgccaccaaccaaagccaagcccaagtgagtgaccattttcttgagtcagttcaatgtcaacagtcatggtggcaaaaccaccctgaaaaccaccataggaggaagaacgcctggtttcatacttaggagattaagtaggctgaccataatattcgagggcgttaagtagactttttccttgtcaaaatagtatgtactagttgttagcatatttattgatggttgtgacttctatttctactgttttctttttggaaataattgtccttatgtacgtttttacatattctgtttttatttataatgcagcaagttcacgaaggcttggagttttcgaatgatgatgatgggttctcctttgccatattttctgttaagttttcaaaagatggccgagaacttgttgttggaaacaacaatgaatcaatatgtatttacgatattggatcaaacaaagtaacagaacgcattcacgctcattcggtatgaaacagatgcatgactgagctacatgcttttattgtcaatgtatgactgttttctgtcccaccaattgatatctgcacattatcttttcttccgtgcatcattaccattttgaacaagtggtatttacaatgtaattagaataacaccatttgtttctttcttagataacttgataagattaggttcttagtgtagcttgatgcgtcacactaacacagtatatacatatgggaggaatttaagacaaaagggattgtaggtcaaggtcactgacaaaggtttctgccattttattctgaagaatgatgatatatttaggaagctttgatccaacaaaactggaaatttgcacaaaagaatcaaaatttgcatgtttatcaaatcatctggtgtactaaaaattctcattctgggtataatagacaagttaatgaacatgcttcagcaggcaaaaatatcatcagctaggagcagatgtcttgctaaaatttatttttgtcacatgtcataaatgtggagttattgaagcagtagagttaggcactgcatcaattcctgccagtttcctgaaagtagtagtggactcagcccagtatgttcgaaacatatactgacataaacaactagaaatatgaaatcaaacatttcagggatgttgagtgaacttgaaaacttgcccttgtccagaaaccaccttgatagtgagatctcaaacagtagatgggactatctgtaacaagacaatgtaacgtatgtgctacattttatattgttggattaacttaggtttggaacctttcttgataatatatttttcatttctcttttgtggtagccattgtattagaaaaaaaaagttatgtttcttactaaatcttattttctcaacttttggtctttaaaggctgatgtcaatgcagtcacctttgctgatgaaggtagtgatgttttatactctggaagtgatgatagcctctgtaaggtgagactaatatttcccaatttcatttactctttctttaaagatgattctatttgcatttgctggtttaagtcagacagcaacattgcaggtttatctggctgatcgtgccagaagtccagcagtgcttgaatatttggtgtaaatacactgtctacactaagtcactaagtcactaaccaatatgaaacatgagcaatgagttcagcctctagaggaccgatttgtgtagccgctagaggaactattgttcagtagtgcaaactctaacaccagtctgtttggtattaatgcatgatcagtctttttgcttgcctaggagatgtgaaatctgtgaagggcttcctatcatatcgaagttctgataagtcacccatggaggctttctttgactgacactgttatccaatcttcaggtctgggataggcgctgcaacaagagaggaaaacaagttggtgttttgacaggtcatttagatgggattacatttattgatagccgtggagatgggcattattttatttcaaattgcaaggatcaaactattaaactatgggacatcaggaaaatgtcgtccactgtgaaagagtaaatacagctcttgcttttgcatgattattcctctaaaccaaaccactttttatgcttgaatcttaaacgcaacatattgtaagcaagtaggaaatgctaaaatcaaaatctgcctttgactagatctgcttggcctgatttgtccaagatcttgtctacatgcctgacccaaagtccaaaatataaaataggctaaagttattcgacagaaatactatttttacttgtagtttgtttttgcagctgcacaccaaaagcatatgaatgggattacagatggatgacatatccctcagaagcccgatatttcaagcatccatatgaccagtccctgtcaacatttagagggcattcagtgttacgtacactaattcgttgctatttttccccaatacacaggttagtttagatatgctaaataatttctctgatatatgttactgatgtgtcattggtctcgagattttactccaaatactggaattttgtgttgttccataaccatgggatttgatctttagtaaataaataaattcgtaggcaggattagttctggcttgttgttttttctcctctctgcaatatcacatccccttaaatctggcttgagtgcaaattcccatagcctatccttgataccatggtacttccttattttaccctgtcaagtacctcctcagttacactattgaaattgacttgagctgaaaatggatgcaaaggcaaagctaacatggccatttagatggatgatcgtcacatgatgtacaccagctctgtgcctcttgcacaaaacagtctaaccaatgcacctggaaggctaggatctaccaagtttttttttttttgaccaggaaaactgccagggctttgcccagcagtgtaatttaaataaagaaaatatttacaaggttacaaagattacatgcggttcacacagagatactataaggtttgtacccaattaaaaatagtttgctttaaaggatcattcattctacacatatgcagaagaacttctttgatgaaaagagatctccatgcctggaaagagggttgaatgttctgaaatatgaagccatttctttgtttccagatgtgccaagctgccaaaaagaaaatttccaggaaacccttctgagaaaatttgattcttgctagggagatcatttggaaaaactccaaattgttattccactcaattcccaggtattgccaacagctgatgctgaaaggacatnnnnnnnnnnnnnnnnnnnnnnnnnnnnnnnnnnnnnnnnnnnnnnnnnnnnnnnnnnnnnnnnnn

SEQ ID NO: 27510 - DNA, 2986 bp, Oryza sativa
aaaattccaagcatcccccatccctgattgtaaattcaaactgtccagaaccccctgaagttgcaagaattccgagtaagcctcatccgagaggggtagagcaaaagaatcttctaggggtcttgaacacatggccttgactgaatcagacttatacatagtcacaaaaaagagattggggtagctggtgcatttaaaatcatcattccatagatcattccagaaaagggcagttcttcctgtcctgatttcacattttgctatcccctgaatatgtctacaagagttgtgatgtccctccaccaaaaagaacccttattcatcgtcaggtgtggaactttagagacatagtatgattgtgagattaatttcacccatggtaaatcagcaccattatagaacttgatcatatgctttagaagaagggctgtgttttgaactctcagattgatcactcctaagcctcctttctccttaggcatgcacaccctatcccaggaagctagagatttccttgtcgaagaagggttattacctctccacaggcaattcttacgagctgtgtcaatggccttgatgactgtaactggtagctgcaatgaggacatgtaataggttgcaatgaggatctaccaagttgacctttcaacctttgacctgactggtaccacatccaattcagttctcttagatttatggtgcaatccatgggagtaaaaggctttttctgggggcctatgcgtctaactcttgtgtttttattattagttaatactgtttctgattcttctctttttgcagcacgggtcagaggtatatatatacaggatccagtgaccaatgtgtatatatttatgatgtggtatggaccttagatgtttcccttaaactgtgatattgtactgtgattctactatttgcatactatggcagtttttctgcacacagggtgtgtatcccatctgtgaaaactgaaaagtcaaaagctcatgctgcatctatgcaaaaagaaaaatcatagatgtacacatgaatttttttttcaatattaaatatgtccatgctttcaagaaaccaaaaggcattccctgtgtaacctttgtgaaatctattttgtaataggggtccaaatgccagggaattttgcataattttgggcttgttattatcattgtggtatttttggctatctcctctatgtcctccaatttctctaatacacaaggattatattatgataatcaagttttttattcataggggattacaatctactgtaggtaactttggctagacaatttcatgggttataatcatttctgtgtagagagatcataattggaagttttagtaaaaactgtgagaaattaagccattaagattaaattatgtttttggatcaagaaagacattttacaaacctgaaaccgcaccattgattctgtagatcatattatagatgttataaactgtatttttttatgcattggtgtaaaccttgtttcaccctgagaaacaatggtagcaacgtctccatgaagcacggccttcccgtttattcggtgttgtgtattcgtattctccagcttaaagttggcccctatgtaactccttgtgactgaagtgaatcaactctctctttcttgcaggctactggaaaaattgttgaaaaactcagatggcatggatcaataatcagagattgttcctggcacccatactttccaacgcttgttagctcttcttgggatggctatctagtccggtgggaagcaacagaggacgacaaggacccctccatgctcaagaccggaaagcaaagaatgcatccagagggatacacattttcgtttgtgttttagaaattcagcagacggcagggtcctcaatgcttggaagatgtattcacgtcgatgctactgtgtcggattagtcattttctctgctttctggttcaagtagcaacgtattcagccgtatagaaattcaccgaatcaaagtacaacattacaagttacaaaggtagagtagttcaatcagtcatttacaaatgtatgtctttgcttctctttttctcccatttgggatttcgacggccttgactagatagatattggtgacgggcaccttgctcgctagtcaggcttggagaatgctccaaaatttgggtacaaatatgtacagttcaaaagatgaataaagtgaggaatcttcaatgcattgtgtttttgttcactcgaccccgaattccaaaatagcttttggcctcctagtccctacggtaaaacatacatgattttaactttatttatttattttcaacagtctttgagctacgattgtgatcatgatttaatactagaacaggttaataatttaatatgtttatgagattatgaaagtactctacatacacattcaatttttatattttcaaactatgtatagtcactaatagtcaaagtgtcaaaagtttgattggattttgtcccaaattcatggtcaaaggaagtatatatgtatctcttgtaacatataagttaagcgtcatgccaaatggtatatcttaaaaactacaaagtatttgttagtatatggctagaattgtaaaaaaaacatgggtgtgattggacgcaccacgaggcataaggagaaaggaggtcatacaagttgaggattctctataatatatttgtatatacagtaaccgtactaacatatgagccaatgctatatatagtgtcattatcctgttgtacatgatgtggggacaaatatggtgagccaaaaagaataaggttatttgtaggccttggtgatcatgagagtcaagtgatcattttgatgggtgtcctaggtagcacacatgttccatggctgataaaaatatatgcctatggggatgaggccgggtaatacacccattttaaggaaaaaaaactccattatatcgtatgcatgtcatgtatttatactatgacttaaa

SEQ ID NO: 27511 - DNA, 30149 bp, Oryza sativa
gaggatccccagtttccaagtttccactacatatgtagtttgcactacatattttcccgatgaggtaagagaccccattttgccttgtacgtctcgtgtccttgtactagggttttaaatctcggctatagttgccactatatatcttcagctattgttgtttgagaaggatataagctatttgctctcatgtataatttagctgctatagctcctttcagcatgctatagctgctgctatagctgtttgaaaaggccaaccactaaatactttatcccgctatttaaggcgctgtcttgtacctacatgagttcatcctcgatgaagagcaaaattcgctactcgctactcatgtagtaggcaaggcattttgcaagaatgaaaggcggaagcatatagcggtcaaacacgtgtcatctagatctacatcacgagtttactttggcaccctcaataccaaatgcacccctttgtttcttatgtaactagagggagtatcatagttggggacacttcaatttatgcaccttttgtttctgtgtaaacttatttgtaattaatcctgcttaaaactcaatgagatgaaatcacttcactattggagaaatatttttacccatggttcgcaaccccctgtagtcccgattatacaaccggaactaagaatccgggactaaagatctttagtcccgggtgaaataaccaggactaaaaatccatctttagtcttggttggtgttaccaactggaactaaagatggtagcgtcagtgtcggttgatcactattttttttcttttttttttcattgtacctttgctcactacaaatctagaacaagcttgttgtaaagaagaaaacgatgtaattcctgcacgtgccaaatctacaaactacgggtattaatacaatatatataatgccattcccaatagataatggcaagcgacagagccgcatgctggcaaagcccggatgactagtgaccgaccacatttttcttttaagatatgaatgacaattgacgatgaagaagcaatggtggagtttcggcgaccgtatgacaagtccaggagttgactatggtgtttgaaattcatgtagataaatatgaatatgaagattaagtgttttatacaaaatcaggtggtattaacgtataattaattgagtttcaattattacaaatttgaaaaatatacttatatgatattttagagcaacttccatatagaaagttttcatatgaaacgcacagtttgaaaagcgtaacacgaatatctaaattttcatctaacttttttttagagaaaagaacgggaaccagttcaaattgtctcaattcattgaccaaatatatttatggtgtacactgcacacgaactaatattgcatatatacatatatgtaaggtgttaacttcaaatttattttattttaacaattggaaaaaattgtgacaactttaagagcatatatttgttagaattttatcttgtttgtaacggctaaaatataatgattttcaagataaaactttgtagtatataggtgtaatattattaaaagtactatacaatttttttatagattctttttaaaatctattagttgatgcgtatgaaatttatactgtaagtttgttggcatggaataagttgccaaaaatatacatactctacttaaaatcgagtgatgcaatataaatttaggtgggcatataagtaggtataatagatctatgtaaacgctaccgagcacatgcagctttgaaattacaaacatataacggcatgtttggttcgggggagttttttataagggattgggagtttagaaagatgatattataactgttttatttagttgagagatataggacttttggtggaatatggatggggaattgtggaagaaactccctccttttcaatacccaggtaggggtggtaattgggaggaaatgcctcctttactttgcctaaacaaatctcaaccatccgtttttattaatgacctaatctccaactaaactccctaccaatttacaccacctctaccaaacaagaaattgggattaaaaatcaaattcccatattaatatcaccatcaattccctcatataaactcgcaatccccttccctcgacttaaacatacaaaaccctcatttaactatatggcaagatgctttgcctcctaaatttaaatatatagacatgatgcttgcctgcatgtctaacaaactagggttaattagatccatgccattgcaaatttgctggtttaaaaaaataccactacttttcgtgattttgggtgtatgccactgaaactttataaaatttgaaccgtgccactccgtcaccatttctgttagtacctttcgtcatctctaacaggaaacgagcactggccgatgccgccgccgagcatgagacggcgatgacgaggaggtcgtcggcgagggccaggtggtctaagggtttggcaacgatgaggtgcagctcggtggtggcggtgacgagctcagcacaagattggggtgccacgagcaggcatcggtgatgtcgaggatggtaacccggcgagctcgggcatcgagatccagcaccggtcgtcggtgccggtggagaagctaatgccgttgctgagcacgactccctctcgcagctccaccctctgcgtcacctcctccctcccttccctttcttttcttttgccggctgccgcgggcgtcaagatccagcgccggtagtcggtgccgacggagaagctgatgccgccgccgagcacgactccctcccgcagctgcccgcgacggcagcggcggcagtggcggcaacgcctgcgctcccctccaactccaccggtgacgtgatgtcagactcgtcggatttggtggctgcggtcgccgctcccttccagttccacctccctccaccaggtgctaagcttgctaccatcgccggatttacatcgccgccgcgtgcctcctttgcctcgctcgccgaagttgggcgcggggaccagcgttggtgtgggcaggaggagaagcccacgagttgccgcccctgtacctcaagcccacaagctgccatcgacaagaccgcccacgagccaccatcgacaagccccctccacaccgctgtccatgagcccgagaaccgccggagatttgtcgcttactactgtacgtgccggagctggagaagaaatggaggcaccgatggaaatgtaccatcgcatgctcagacggaaatcttgacgggagtggtacggttcaaattttgcaaaatttcagtgacatgcacccaatatcatgaatagtgatggcattttttcaaaccagcaaatttgcaatggaaattggaatggatgcatttaacctaacaaactaacaacaggccattcagttgagtacttgcatttctggaattacatggcgacgaataaaataccgcaacttgctgtcttgccatcaaacctcattttcttcttctccatcgggctgtcctctgccctagctaatcctaacgtcaattcagatgttggcttttattttgggaattggaattgcatatagacggtttgatttctttacagttcaaatctaattcatccggtaggataaccaaaatcataatttgtgctaagtgctaacagtcttcatttgttttccatagcagcagtggtggatcagcttcaccttcacagggagagaaaaaacaacactactcaatttttaatgggagtagcaatataaaaatatttatagcgccatattttttacaaaaaatagtcagcatgtatttacaatataagtccataaattacatatgtaaatttagtgtatttataatgtaagtttcaaaattatatatgtaagtcttaaaattacatattaattacatatgtaagtggcgtgtaagtagaatgtaagtagatgtaactacagtataaatttgtataaagaatagcatgcatgcgtggaaaaccatcgaaagcttgaactaatgaagatgttaagttttaattaatcacagtcgcaacgtcagttgccacggcaataacacagatcttatagcaacatcaaccgttaaaaaatctgactgtaaaacaaacaaatttgtggcgacacaaatacaacctttccgtttttgatactagtgtatattaatctcttggacactagttaagcaaacagtacatttgtttcgttaggtacttcgggcatcagatcaatcggattgattgttcacttgaatatgttggttacaacttacaaatagaatttgatacgcaaaatctaattgatgctatgttatcaatttgacaacatggcatgcttagatttggaattccagagctgcatatggtcggtgagctttcgtttcctgtgttccccagtccggtcctgtatataaaggccacctggccacccccgaaaagaaaagaaaaaaaaagagaagaaaaccaagaaaggcgagagatacgcggagagcagccaactcctcgccttcgccttcggcttcggctcggcgccgcccctcccctctcggttagctgctgctcctgcacctgctgctgctgctactgccaatctgccattctcccccattcgacctctcccccgtttcctccgatcgactcgcttgcgcgcgggggaggtgtgatcgatcggttctctctcaccgcattgtgatcgatcgtctaggtcgtacgggcgctcgatctgcttcgaatcctccatttggttcgtagtttttattccccttgatggcccggacgacgcatggtttggaatttttctgctctaggctgggtttagtgtgggggtttggggtttttgttttttggttggggggatagcgtgttcgttaggtatttgcgctgctctgctcgttcggtcggtaaacgatttcaacggggtgatgcttcggtgtgttagttcacgaagttgaagcgttcgggttgtcggttctactaaattaatttattttcgcaatgaggctgaacaaacgcttcagtttctttaaataatgttatgttttgttcggatggggattttcttgttggaatactttagtttataatccttatgttggaaataaagaacctgcataatcaatatctgaagttaccacgttgctgaaatgtagcacctatcaagtggatttactactgtctactgtactagatatgtacccttttttttctaaaaaaaaaatctcgttgctaccaatgtcttgtgaaattgataaattgattacagtttagtggttcttaagaaatagggattgatttatcaattgtcattcctctaatttgatttaatgttgatttctgcagctatgatgagctcttcttcgtcctggtctaccccaagctttgggttagccagggaatcctcttcattgttgtttacacctggccttgtgcaacacatgggtcctaatccatcgtcatcttggtccacccctgctcatccagtctctgatagtcccacgttttctttccccacgccatttttctgtaagcaaccttttctttcatctttctgttctccctttctttttgtgctctttcatacctgccaactttataaaaaattaacaacatgataggtgcaagttcttacctacaaacagctcattttcctgtttatgcgtgtttgtgcttgtgaattcctgttcttctctatagtacaaatttctattatgtgttctaatgcttcaagatatcatcaagtagtttttttggtttggttatagtatctgtgttgcacatcaatctataagtccaattaatgtaggaaagcctcgtaatcactacagttttgagcttcttggtacatattttttttagtttgtctggtcacatactatatttttattaatcagaacgaattgatgcttcatatttctaatgtagtcgtccaatagtttttgttgatgaatgtcctgtggtaatacatcttgaatgctcaaaaactggctggttttttctaattgggccaggctcaaaaacatcttgatgcaaacaatttgctgaaccccagaataaaccaccgcagtattatattgtattaggcacctattgtcttcccaaacatccatagtgaatgttcaaaattgtagttaactgttatcttactcaccttggagaacctctgagctagtagtactgatgccaatggtggatgatgccaccctgattaccaatatttgatatgcagtggttgctcctgtttagagtaccttatgtatgtctatctttgatgtttatccttggtcgcacagacccttgtttagcttgggttgaaagtgctaatacactggaaggatttcacctactttatgtctctgagcatttgtttttaagattgtgaggaagatgcacatgcacatacctgtctgagtgtcccccttagcacatacttgaacttatggaggttagggatgaatctgtctacctcacaaaaaatgtattgaagcgcgcaagtgtgcacatgaatgcattcactaggatttgaaccatggtaggtgagtcatacaccttctccacctctgtgattggttaattgattgtaaggcaattttgatactaatctattttttcatggtggcatggcttaaaatttgacatgttccatttttttcactttgtaattttcttctcccatttcacttcatctagttcacttcatttttttgtatttttccatcgtaattatataggtgagcctgcgaaaggcagcagggtctatgcttataccaagactgctgatgatcttcctcataagcatacactatcaatttctgcaatgccagcatacataagcaaatcccatgaggagcttcgacatgaagattatcagagaggagacaaaggtataagtgtttgaagcatttttctgaactttagacttgtctatgaaatttgatgagttagaatttggataatgcgatctttaaagaaagcagtgacatgtcactacattttggagtaaactctttctttgttcctagaatttgattgcatcccttgtttgcgcttgcatcctttattattagcctaatgttacaccaaaagacaaattacatagctatttcaattgttatctagagcatctttacaacttactatctgagttcacgcgtccaattctctctagttatttaatctgaagcatctttacaacttattagcaagaatagttaactatttgatatttttttctctagtatttgcatgtagcaaattaaacagctaatgtgagcaataagcctatagttctaataatttatgcttagagttagtattaatggatcatttcctgtgatgatttatgtttaatattttgttggcacatttgctatatgtttgttccttttctatgtattaatctaattttatttgttaactctctaggcggtgatggcctgcagaaaattatggttaattcagctcctgtacctcccatgcccatgttatcatctgttggagctccagttaatatgatcaattcaagtcaacctgctttcagtttgaagtccaaaacaaatttcagtactccattttcaccagcagcaactgctgatcaacaatctgcacagctacagttctcaacacaaaatcactattatacttccaacccattttggcctgccccaataggattggtgcgaccatgttcatcaacaggactgcaatcttccacgccaggtctaaactgtaccggcatcacatcatttccattcctgcccacaaagcaaccgtctgtgggaacccaatcatcaactttatttcctaccacttttgtgcatccatccgtggagttgcaaaagaatgcctccacccactgtgctagctcacagactgctccttgtacgacacacggaggaattctattcggcacggctgcaaatacagtctcattaactacatcatctactgtaagttccttaaatcatggcttgtttgtgaacaaaacaaattggctctaatcattgatatttgtgttggttgacaggagccaaccacatcatcccttggtccaacctcatgccctgctactcgacatggagatgcaccttctactggatttgcatgtcaggaaaatgtattcagcaactcagcggcatatacatctactgtaagtgttgctgttgactgtagtatttatttgcggtgcagtacaagaggaactactatgcatgattattttccgttatctttgtttctcagaggaggcataaatcaaaacttcttcccacctttcaaatccatcgctcgtttttccagactctgctttatatgagaaagataatcttctttgcagataaatgcggatgttcccacgaataccatagatttgctacttccaaataacatccggctggtaaggcttagattttcttcaacaaatgatggtaatggaagtgttgcttcagaggtacggaactgaatctccatagtaaagagttgctctgcacattattatgcatgagtctttcataaaatgatctcttggcccctgtggcttctaaaatcatgttggaagctttgatgctttacatccttggtctcattactatttagaatgaaatgactttgacctttatgtctattcattctgatggtcatataataacataaccatgtccctttttgtaggttcattgtcatcatgatgctaaaacttcagaaacacccatttctttgtgcatatatcctggagagaaccaagagctgattatcaaatcaatggtgcagcctgctaagagtcacactgggaaacaatctagtccaactggtggtcatccagatgatcaaagtggtaattagtgtttgcatttcattccttctgatatatgtttcagacaaacagtttctctactctgactcatatgtacagtatgaatacatcatttatttattttattactccctccatcccataatataaggcatagtcaaacttggcacggtcttcaaacctaatctttgacttatattttctcatatactataagatttattgcaacaaaattataaccatcttaaagtaaatttaaatgtcaatccaaagatattaattttaggaaataaaatttaatttatagtattataataattgttggtcaagtatttttaaagttgaatcttggactgcgtgcatgtcttatattatgggatagaggaagtagcaattaaggagcaaaaatatgatcactgaagtgtggtgtaatttaatgttagggatatctgttgtgagtagtgaaaaatacattatcatttctaaagatttatctaaagatattcctataaatgtaaaggtatctcagaactgaacacttatcatacaagttcgatttttggttacttcaggtcgcagcaaagtatgcaacagtgctgctggtctgccatcgtcaggacctggtgagaatcagaaggggaatagcagtgctggtcacaagacaccaaagtctccactggctgctcctcgttgcgaagcgatagcggagtctgtactgcctcgcctgtacagcgccgattactacaccgtgccatctattgtggagctcgccgtgggagagagggacgagccaggctattgctcacatgtgaagggcttcacggtcggcaggcatggctatggcagcgtaaagtttgatggagaaactgattggagaaggcttgatattggatccatcgtggagttcaatgagcgtgagattattgtgtacagagatgtgagcaatacgccgcctgttgggcaggaactcaacaagcctgctgaagtcactcttctgaatgtcaagtgcgtcgaacagaagaatgggttgcagttcacagaggggccggcagttgataggtacaaggagattttggtgcagtggacaaaggaccatggcgcagaatttgtgtcatttgacgcggccaagggagaatggaagttcagggttaagaatttcaatatgtagagtcctctgagaatctataattctcctatcagtaggctcctgtgtctggtagaagtaacaacatagtaatcctgtaaaaaatgtgttctttttgtagttcggtcacttggtacggatagctggatacttctggacgaaataactttagctataaaaactgcctttgttgcgtaattttcaattttgcgcggttgtaatgattttgttagcgtttctgtcagcctggattgagttttagcatcaactctaaaatggtaaaggcagtattattttcttaaaaacaattacgtgtaggagtaacaatatatttatcctatgatctctactcctggaaatagatatgtagtcagtggttacaatgatttgagtaacatctcaagatcttgagtaaatctccatagtttaaattttaaaacttaattttagaattgtttcattttaattctatttttatattgatctttgaaccgttcataacacacatataaaagtattattcattaagttcttttagttgtttcattccttttttttccttttttttatcctataataaacaattatgttctaccaatattattctgaaacattcttttataacattcccactttgctactaacagtattagacaatatcttaggaacaaagtagccaaagtagaatggaggggggtagtttgcacgtctgtcattcagatagggagaggctgtgggcatgtggatgtggcctcaactcgtgcaaggatttaatactctgatgaaatttacattgcttatattttccatgtcctcaatatgtgggtacagaatatatgcaagattttagcagtgaagttgatctgaaatgctaatgtttaaacatataattgggttgcaccattttttttaacaatacaagtgacaatgtcaaggttgttaagcacagtaggataggatttgttatgatttgcaagatgtcaagttaccttgacaagtgagagcgcatagtttcttcctacgtaacacacgaacatttcgctagcaaataaataaacgctacatctcaatacatgttctaataaaatcatacatacagtgtattatgctcagcatggtatgaagtgttcgctaattgttaaaaatcaagtttctggctagagtatatcctatattcagcaccaatattatatcctcacaagggaaaacaaaagggttatttgacagcgatgaacaaagatagcgttcataggaaacacggtgatgctccatatgacaagtcacaggaattttctttttcagtttgttttttttcgtcaaagggttcccttatgggcaatatcttgatgttaagtgcaactctgcagtgaaaagaagtcctcggcatagcaccacttggaaggataaaaaacgtacacacacaattaacttacccgttctaatcatctagaaagagaggataaacttttggttttttatggcacgcttttcaaaatgctaaatggtgtgtttcgtgcgaaaattttctatatgaaagctgttctaaaatattagattaatccattttttaagtttgtaataattaaaactcaattaattacatgttattataacctcgttttgcgtaaaacacttaatctcatcttcaggagattcaaacaaaacgtagagtgtcaattgacttggggcgtatttactttcttaatattttcaactgtaccaaaaatttattttgaaatattttgacgttgtgttgaatgtgtttgctttgaggcttgccaaattttgatgttgtttttacgagagaaaacatcccgaattactaattcttttagggtggtaatgggaggctatgtttagtttgttagccctgaaagagaaacactaagagtaggtacaatagcaggttataagctagctataaacatattttaaagagataaagaaagagatggaagagcagcgggctacagatctgtagccagctatagcacggactacaagacgtaatgtgtgtatgacaggtgggaccaggtattaatagtatagtaagcaactagagtatgaattagttattacattggctatagatgatttggagctagtagtgggctatactattaaacttgctctaatgtcgtggtggtggagtcgtgggtgtataactttacccactagggttcaaatcctggtgtgcacgaatattatgcataggtaggtggactttcaacatgattttagtgaggttagagatatgtcgctggttttcgtctattagagcataggttaagagatacattcacggggtgtgagagtggtgttacgtctgtagtgaaaatggcaataaatcaaacatgccaattattggttataaatatgacttcttaattatgaaggcatattattttactaaacaaaaggatcgaagcttaaaatcagtttaagagacatcagtcaaacatggcacaaagagctataagatggaaaccaaactccaatagttcttaagtttctttttttttttaaaaaaaatctcatacattgattagtactctacaaatgtcatcacacctgttggtttcctggttccatagtgttgtattttggcttccaccacaagcgcaatttactcattgttttccatttctatatcttccactggcggcttattctcctccgctgcatcaacaaccaaaggtgagtccggctcatcatcctctgaacgaacaattactattaggcacaatgacctctaccggtgcaataacctcttccggtgctttgcattgaccactattgcaaacattatcctcttgcacgtcctctataggagtttgttctacctccgtgtgacttgtctcgatgattccaaaaatatatgttttcttctgcaccaatattttcagactataccctttctcccttattctagccacaaactttctccaactctcaataaatgcaagctccattactctccattgtcatccatattcaccccttactggccacacaacctttatgatatttttttcaaacactggatcttccccagacatattatacaaccaccctaacacgtcgttcaaaaccaactgctccggcgcattcaggctagtatcaacaaagatcgaaaccaccccgctatcacaaagttgtacatgaacatcgctataatatacacgaacggccacatcacctgacatcctaagaaaacatgacagattatcttactacattactacccaataacatcacctgtggtacatttttactctaatgcaaaataactaaattcgtcactactaaaaataacttcatgttgatttctactaatctacatttatttttacttagtggacactactttcaaataacttcatgttaatgtgtactagtactccatgtttatttctacttagtgctcactacttgcaaattaatacattgctactcacctaaaaatatatgtactaacctagtactaacttcaacatactactaatttaatatatgtactaacattcaacaatgattaacaaatcattagtgtcgtacttagggattataaatttatacctccagcgttgctgctctcttctgcatagtcatgggcatcgcatccccttccagccgcgcagatctctcccgcgacgatggcagcccgatgagacacttggtggtcctcgccccctcaactccaaaaatgacccttgtcgaagggtggagagggggatttaaagccgccagtcgaacacccattgtttgataggggcagtcgcagggacctgttgacagccacagttcaatattgtgcgctgggacctgttgacattgcacactgtcagatgtgggcccagtcgaacactcgtagttcgacaggtccagtccaactccttttgttcgattgcttccacctgttgaagactcgccgtttgataggcacctgtcgaatttcggcagttcgacatggccctattttgacaattatttttgggtggccatcatttttactattttccattaaatgaatattatttctgaaaacaattccacataaataataagctatagagtttgtgattttgctatagcttataacaggaagccggagtaacgagataagatccagggggactgggaaagtgcgcaaccaaaacatccaagaaaccaatcaaatctcgctggaagaaagcataaatactagacaaaaaaattccatttggacgaacatatatattccaagaagttggtggagactgactttttcttgggtagaatatttatacatgttgttgcttttactgaaatatgctgtaaaggggatactgaatagcactacagctagctaggtagctcaacactagtccagagaacataatcattatatcaaacaactcttgcgccatatgttcatgtttgattgaggagaaccatatgattgtgttaataaacaatttttttggcaagtacgtacggatgcaactccttgagtactcacaatcaaaatattatcagtatattttaaagtaaaacgaaggattagtggattaattgacaagagatgagaagtgccgattaatgaaggaaagctccccaatgtttctctctttcgggttgtttgaatataatcctgtttcgtttcttccatagattttttttttcggcgaagacatatttatttcttccatatgcttgacatgacatatatatggaccggaaccacggtcagattcatttctcgactcttgaatgatctgtcgtgccctacgttgagccaggatttgtggtgcactacatgcacacgtgggtacatttggtggtaaaagcacatagggattagctatgtatttatcgttaattttttaagatttttaaaagttacaaataaattataaattataagttaacgatataatttatatgtaacttttaaaaatcttgtgataacatattatttccgtgaaacagatgtgtcataacggaatcctatatgcacgctatgatttttaaagtaaactaggaatgcgtcatacgccaagtttgaggtatttataaaagcgagatattaaccggagaacatctgccacgatttctccataaattctttttgtcagtattaattaattgtttaataatattttaacctattagcttcatattatatcatacataagtaatatctataagcaatcatttataatcttcttcatcatttgaaaagaaggcagatgtattttcttaagaaaacatgtcaacgaaagtaaagtaagtataaaatagaagcaatgtgtttttttaattgtataatatattatcataatatgttaaaagataaattgagtgggacatgaagctccacgaaatacatgggtttatatagcctaatattattgatatattttgagaggcgatatatctatgaacatttcatgtagagtggatgagggactccacgcaacctagtaggaatacgataacgacgaagtatcattgcacagtaatattttttaaaatgtcatgtaccataaataaacacttttttatatataagatagatctaacagatagaaatactggttctaccggtttaagaggcataggagtattttaaaaatgtagcttaaaaattatggttgtttttatatccaacataataaagtgagcgtagttcaactggttagatttcttgttgtgaaacttgcccacccatgttattaatcaaaaggtttaaactctattatgattttttcttaaaaatgcatggataagtgaacaatagctatagttcgtaaaatatatatgactaaaagtaatgaatttctttaataatatagttaatttggatcttcaattttaaattttatagtaaataatctaatagtgtgcacaaataaaaattatctatatgatttagataatataattgtttaaaatttgttatcataaaatattttttccatataactaaaagaggaaaacaggagagaagaaatatgtggggaggtaagtacacacatgcatactggactggacaggcggagaggatataggggccctttttttatcattttgtatttggataaatcataaaatattttttccatctaactaaaaaggaaaatagaagagaaaggaaatatatgggagaggcacataggcatgtacgcaagcatacgtactggatgggaggggtgggatatgtgggcccttctttttatccctttctatttggataaataaatctaatggtagaaaataatgggtccatagtatattagtaaaaatcgacggctaggtgattaaatgtcacgtggcagtataagagcgattgtaggagtgctatgtggcggcgatggtcggatttctcttatttattagagtgccacttggtgacttgagagcatttacaaggtgccacttggtggattgggagcgtttgtaggaagtttaatgggctcttagtatataatagataataaataaattagaaaggtagcccgcgcacatgcgcggacaccttcttatataatgtgagtgaaattttattatgaatatttatgtgtgggtggatttttattaaaatattttttattatattctaaactaaaatgaaactcattttgtgtgctttgaacgctggttattttttttataactaaccatgcaacatataaattctaaaataaaattatttgagataatgcggttttgaattggtgagaaaatattgcgttgaaacaatgcatgtggtttctatgagaaaattttgggtattttaactcgctagaaggatatcttacaacccaaaagaaatcaaataataacatttttttattggattgtattttaaaatttttctattaagtatgggttttaaatccagcaacgtttgtccaattttcaatttatttcatgtccatttttattttttttcttttggagattttcattctattaatcatccttgaaatgatttgatctttacaatttgggacgaaaatacaagtgcatataacctggtatggggtaaaggcatactttctaaattttctctcataaaatattaaagtaatggtcatagtgtttttagtgaatatcactaaagtggattgtcttgtaacaaatacacatttttagattgttctaagtcaagactttacaatggactgtagcaagttttacaaaaaataaaaaaatggacatggtctttaatttctatatggaattgaattgatttattgctaaggccactgcacccatatgcttatcggtatgatgttcaaccaaccacacctttattttcaacatattgtctatattgctatatgaatatttgttatgattagtgacttcatagatgatatgtgtaattcggacgctatgatcatctttcttaataatatttattgttctcctaaaagatcatcttaaaagtatcaaggtcaatttctataggtacgtagccctcatatgcatgttaagagaaatcaattaagttgataaagagtcgttagatgcctaatgggatataagtaatagatagaggtccatttgtgttttttgtttgcccatataaataactttaattttaattgtcaaggagataaaaaaaatagagagaaaagaatggtgcatgctgtacacgggcgggagggcgggaggtttgggatatttttataaatgattaatctaacaacctaaaataatgtgttagatttgctaaaaaaataatgtgtcagatgtttatgtcgaaaccgatggtcgaatgttttgttttctggtcagaaattttacaattttatctgatttaagagaatgatgtaacatcttaagagtgtttataacatgtgtgaccgtctattaacaccacatgccgcaaagaaggatggagggatggatgtttggggtgttcttcttttaaacaatagatctaataacctaaaataacgtgtccatctttttttatgtcaaatccgatggttggattattttttttttgcaaaaattctaagatttttctctaatttaagaatgtcatatagcagcttagaagcatttataagatgcttaatggattttaatgctgcaaggagatggggatggagggagagaggttttttcgtattagaaaactaacaaatcaatagccgaatgctttgttcttttttaagattttctagtattttctttaatttaattgcaccacctagcagcctagaagcattcgtaggatgtttagagtgacagagtgagagttgctagatctagcaggtggaggtctatttgtggttttttaatgtaaaaataattttgattttaatttctcatgaagatagctcgttggtgcgtacgtgacggggaagttccggatgcatgtatttaagaaaaagatctaaccttctaaaataaaataatggatccaccgatttaaatgaaaatcgatggtcggagccactcgacgacctaggagcgtttgtaaggtgtcgcttggtggattaggagtatttataggatgtttaatggagttttagtatataatattatttttctgaaatttctaagattttttttgatttaataatgtcatatagtagctagattagaggtgtttataaaatgtttaacggattttaacactacacgggggtggagagggatggagagaggtctaggattttttattaaaaaatctaacgacctaaatccatcaatttaagtagaaatcgatgatcgggtgcttagaattttttaatattttctagtactttttctaatttaatagcaccatgtaatgatttaaaagcttttgtaagatctttaatgtgacggagggagagctgctagacttagtagttggtctattttgtgatttttgactgtaaaagtaattttgattttagtttctcattaaatagaaaataaaaggaaggaactgaaagggaaactcacgtacgtacgttcggcaatatgatgccaaaaatattaggtatgttggttccagaggttttttttttttggcaaaatagttctaaccatccaaaataatgggtccaccaatttaaatgaaaatagattgtcggatttctcttatttattagagtgtcacttggcgacttgagagcgtttatagggtgccacttggcggtttgggagcgtttgtagaaagtttaatggacttttagtatataatagatagatagatagatataacgattcaaaaactatgtaaaagttacgtgcaaatttacctgtaattacattacaattatactatatttacatccgagaaactttttttaaaaaaataacgataaatatatagcaaaatcgaagcggtatccatgagacacgagggctatatatgcccctaatatcttagagtgcgctagaacgtatcaaccaaaattttttatgatttaaccatttgaaaaacttgttttaaatagaaactgcacaaaaactcgattgaaaatacatagcaagctctcagaccgattagcggacatgtgtgtgggtgagatgtgacgcatgactctctcttcatgtttttttaataaagataatggaaagttacatgtctccttcctcccttgcgtcgcatgagtaaccattgcatgattagcagtagtagcgtggagagagagagagatttaccaggtcattcatctctatttggatcggcacagctactacttcggttgattcaagggggaaacaataacttggattagtttctgaacctttttggcttttactgcatgtggctctgtcatgcaggtattcatgccataagttaatcctaatttaaaaaggcactagtgtcaatcattgtccgtataccgatattaaaactctaatctgattttaataataatacatgctccttctctttcaagcttttctggtgtgagcggatgcttttccataatttatccgcagtgtacttgtctgatcttgcatatctgtgcctcccagggtactaattgaattagagtataaatcagtgcttttcggtgattaatatttgtaatgccatagctccccaccatatcgttcatttgttccaacatcaaatttcttccttttctccactcagcaacactggagtgaaagaaaaaacatgcacgtcatgtcaagcaagtactacacacggctctcgctctagtatttctgcaggcattctttctctcttttctttttaatctttaatgacttaatatttcaattcgccaaacgataattgcatttctagtagtatttaaatattatcttatgaagagtgtacttttgaatactatattttttaagtactatagtacttgctctcatttattttttttctccttttatcccaaacaccctcctattcccaacagttccacctttaacgaggaccatgtaaatatttttttttcttccatgataattgtttttaaattctagaattgcacttattataggatagagtgtatcatggtatgttgcgagctctcctttttagtatctacactggctaatttagcttcctactttgtggctgtttttttaaggtagcatattctaaataaattattcatggataaaatctgatagattatctacttgattgtagggaaaaaactatatgatatgttataatcctaatatatagcttaaattaagtgatctaagtagaatcgtcgaataaataatccgtggtatagtccgatgtataaacataaaagaacaggactcttgaatgaatgagcgaagtgtagatattgtacattggtcttgatattcttacccaagttatatcttggatcaccgactcgacgaacaattttttcacttaagaccagtttttacaacaaatatttttagtttagactgatggttcacatgtcattcagtttagaccgatggttcacatgttagtgagattaggggataaatcggagagcagttaggagaatgctggcaagctgctgcttcttcttctaggcttctatgctggtctatatactcgagcggtttctttctcccactgtttgtcatatcccccaattttatatatgccaatcgactatcagatcaggatatttgtatccctaacgttgttagatagaacttgatgtcaccggcagtggtggacccaggtcctaggccatagcaaagggcctaggacctaggcatgagaaatgctccggtgcaatctacttgaagtattctactccgagtagaattaatctggaccgtttattttatagggtagattagtaatctcctaatatagtttaggggtaatttgcataggatgttttcttcgcttcttcgcatcaggtccgacgcatcgcatctcgccccaacgtaggcaccgatctctccccgatgtagtcgcttcctcccggcaggcagcggcgcgacaaaaatcgctggcggctcggccggcggcgctgccagcagctcggcgtggcgaaatcctcagtttgcagacgtgtttgatttggtaattgaggaatatagtcttaggaaagcatactagtaggctgcctgatttctctgttcagacagatgcttatatttctaatctgatttcactttacaggctgcgattgatctcaacaagaacgatctttccgatgaatgccatctgaacgatatttgagagatgatatagctttagttagtcaccttagcgacggacgggtgaaatagagtaatgtcaggaacaagtttgattgtcaggaacaacctagctttatactctctctttggatcagaccgtaatactatgcaaagtgagactggttacgtcgcagacaactgtttaatcacggtgcgattagggctaatcttttgcatctttttggtgatccgtagcttcgtggttttgcgattcaatagtgtctaccagatctttcccgtttccagatcgtcttgatggcttgttggtgtgtgcaatgatcaaatatttgctgtcaaaatatcacgtgactgaaaatgcagccaactctgattgctaacattacatcatctctgattagcaacaaagtgtgcagtttgtgacatcagtgtccatgaaagcttccaggctttcccctggttattgccaaaaatatagtcctatttctccttatctctagaataattttggtaagtttacaacgtttggcaggaggaacgcacaaagactgcatgagtgtgcaaaaaatctgtccatattttctctgaatttgtactttgtgttaggtactacatttgtgggcatcccaaatggccaaatgagattaatataaggtgtggtatttcttgtagcaggaaacacacaccaagtcaaaccaaacagcaaaccaacatgcttgtgctatattcagaggtgcagtatttgtgcactgaacaaaaggcatctcacatcgctgtcccttgataattcatggatgtcaacagtatttcacatctgaacatccgcgcgtgctcctccacggccatcacctccgcgccacgctgccgtacccacagcggctcgccggcgctgcacatcctggcgagctggtccgcctccgtgggggcaaggtggaccaccaactgcttgtcctgctcctgcaagggcgccatgatggcgcccatgtacgccaccgagccgttcgcggctatctgcagtggcacgacgggtggcgggatgaggtcgccgcagcccatgcgcggtgcatgctcggcgagggagataggacggcgacggaggcggggatggaggggaatagcgtcggtatggagagaaatgacgacgatacgataggataggaagagggtgagtaagatactaataaattacgataatacccctatgcgaattattatttctggacaaaaatgcctctccacatttatacttccactaatcctagtgggagtagaactaaatctcaaccctacaattaaagatgatcaacggctcagattactttctactccgagtacaaagcaccggagtaggactagcgtttttttgacaaattggtccttgcagaaaacttatttcgaaactagtccctaccaaaaactatatccagaaataggccgtcggatcagcgccaaagcggttggcgctgaggttgttcttatctgcgccaacgggactggcgctgacatcgcgccagcgtggcgggcgaggcgcgatgtggcagggcctcagcgccaatgcacttggcgctgacaccttgcacaccctaaatagaccgatgtgcggcaatgaattaacggtgtcgctcgtggtgcaacggtaagtttctttcttgctatatctgaggactagggttcgaatcccaggtcagccatttttgttttttttaaaatcatcaatctacgtgcgtacatattaatgatgatctccattttcgtttttgtcttcaaatcttcaatgtacttttttttgtttaaattaatttttattaaaaagaaatatcacatttagtacaaatttaaaaagtagaagaatggattaaaaaaagtttagagacaacttttaaaagaaatatcacttttttataaaaaagaaattagaagaatggatttaaaaaaacttgagtttttttttaaaaaataaacaacaagttgagaactaagggtaagttttattctaaaatgtcacgtgtttttttaaaattaaaacaacacttgagcttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaacaagtttagtaaaaacataaaggagagggttcgaaccctggtcactgtaacgccacctttcaaatacctaccactgagctaagccaaacctaattgttgcttttgcttttgcttttatttagccagtataaaggccagcgccgctgtagaacatatattctgatatttatatttatatatatatatttaaaaaacagagagcatcattaatcatttatatgtactaatgtacgcacgtagattgaagatttgaagaaaaaaaaagaacgaacaaggctgccgtgatagggagtcgaaccatggtgctagggtacacaagcaaatggtcataccattgcaccacaagtgcattgcttattaatggccgcgcatccttttaattagcctgtacaaggggtcagcgccaaatacattggcgctgaggccctgccacgtcgcgtctcgcccgccacgctggcgcgatgtcagcgccagtcccattggcgctgatatgaacaacctcagcgctaaagaggttggcgctgagccgacggcctatttctagatatagtttttggtatggactagtttcgaaataagttttctataaggaccaatttgtcaaaaaaacgggtaggactaaggcatcaaaccccattcagaagtcagaacaattcattttcaccatgtaaagacatgcgtcaaaccgcatttagatcaattcatttttagtgttgggtacgtttggttgtttgctaacctaagctatagcccagttgggcaagccacttcattgctgctttgctaggcttgccttgcctagctgtttagttcttttgcttctaacggtaataccgattgtcagatgttcgttttttccaccaagagattagcttaaaacaacaaaatatattcattttacagtatattgttacaacgtgatcacgggtaggcttgccttaccaactttggcaaaggtgcggaataaatctgtgactgtgattgcggtgaagcgaacgagaagtgttatgtgcggaggaatagggaaggcatgcaggcgacgataacataacgaaacatcgttggagagtgaaaattgttggagtcgctgatttacagcggcgcgcgcgtgaagcttgtcgtcgatggcgagccgaattcgctctccctggctagcgagctttttctcgctgcttcgggttagcttgcctgcaagagctaggaaattttgatagttccaaatggctggcctcaccaagttaggctagctgttccaagccttagatataaacataccgtaactagcctagctcagttcacaagcttaggtttctaatcctaaagcatcgctaaatatctatctatctattatatactaaaagcctatgaaacatccttaaaacgccctaagtcgacacatggcacccctaaaaacgctcctaagctgccaagtggcgctctaataaattagataaacatctaaccattgattttcccttaactcggtggacccatcagttttgaccattagattaaatttccatctctccaccctaatatacgatgcttgcatgctttggtcccaccaaaataattagttaagagtaaacaaacgtaaagaatcagttatttctctccccaaaaaatcaccgtggtattaattcttggaaagaaaaccgacgttgtagatttaatgcaggagcctgggtgtgtgcttccatcatccaaaaaattataccaacgaaaactttttaagtgaatatcacctttgcgtcaaaaaagtgaatatcactaactgctctaaactatttacagagtaaggttcagattcatgaatattgccctcaatagttagtttctgaattttcatgtttttgtttgattaccagggcctgatgaaattttcacggatgctaaatctcactacattaaattctcatctctcctccgtaatatatgacggtttcatgctttggtcccaccaaaataattaattaggagtaaacaaatgcagagaatcagttgtttctcacccaaaaaaaaaatcaacaaataaattttcagatgcaaagccataggaaaagaaagcaatgcgcctctagcttactttttcgaccaatatcaacgacatccatctacattttttcaggaacgagcagcaacaaccaaggttgaaacaatcctaatcgtatcaatcaggtgagtggtgcaagcagcaacttccatctttttattgtttgatctcttaacatagccttccacttctctatttttttaagcatataatttcgcttttttacctacaattttatactactccttggtgatgttgttcgtattctgatctgttgctactagcttctacaacaaagcgatatatcaaagttcttgcctcttggacaatatattcactaattaacatcgggtatttgggtgatgtcagtttatttttgagcacttagtcaagacgtcttgatgctgtgtgctttgccaccagaaatttgttaattgattttttagataatcattttggaagggtaatgcatgccgcttttttaggagaaacatattacaaacacatgagtttatatacatacgcgtacacttatccatagaaaacatattcgagagactgagccaatgatatatcttcaaattagtgaagtcatcataaacgcctcgctattgataggaacgttgcctactacaagaataattagccataaatataaggcccatgtcaagtctagatcttaaacctaggtgggtaagttcaccataggtaactaaccagccacactcactaattgcagataatgtggagcccctcttccctctccttaactccttttttccatatattatttgagataaatgtagtatataaataataaataaactattgtattttttaaattatatatagaatttttttattcgaccacaattatattctttagaattaaatcagttcatatcgatttgaccaattgcgttatatctcacagacaaaaaaaacacgaaaacatatgttatagtgtcatatatcacattataatcataaataactaaaattagctctaatatgtttgaaaataaagtttactaaattatattatttaccattaacttaatttatgatctatattaactatactttaatctgtaaaatataaattttaggtcatatttttattcttggtctgtaatccaaacggacatgaaaattataaaaaaagatgacagtatggagtatatatcactatatattctttatcggttataataatatgtaccattaaattagatttacaatataacaagaaatatgtcatatctttgcgctttacatggcatttgagaattataacaaaacgtgaaaaaacaatttaatgatatgggtaatatcatcacataaatatgcttactaggtagggtgcactctatttggcccatatcagttcacaaatatacgcgactgaattagatttacaatatcaacaagtagctagtcacatccgaggccttgcatggcaatcgagaattatgacaaatcatgataaaaaataacaatatggattatatgatcatataaatatacttatcatgtggattccaatctattcggactatacggggataatctaaaatgtcaattcaatttaccaaatcatgtataagttgtacgttttgtagactacaccctaaatattaagtaaaataacggatggagtacacatcgtgttttctcacctttgatttctattaaatacgtatggtgtgtgggtattttgtatatactaagttttgttaattaggggacataaacaatactaaagttatatatgagaattcaagcattaaaaatacacttcataacatgaacgtacttaacaaaaatgtactttagtctatggtgcttaaatatttataaattctctaaacatactaattatttctgctcttatttcaaactaaattcattttctccacataatataagagatcatatgagaaaaaaagaggagggagaagaagtaaatagaagtctgccattaaacagatagaataaagacatctataacatacaagaaaatttgttgattaaggtttataaactccaaatgtaagatatgctaatttctaaaaaaacacacacatggtacacataatagttccatatgaagcaacactattgttgtgaaacaatagtttctcgtaaattaaaaaccacatggtttaaataaatttgatttagaatttatataatgaaaaggtaattagaagaaaattaaaagcgacgttcacaacaatctcaaataaattattgataaaaaacatgttcagaatagagtaaaaaaatattttaagaaatactcatccacacataagtatttataattaaaattcaagcaacattaaataaggtgtcccgcgcatgtgcgcgggctacctttctcgtctagtgaataaccgacagctcctataagatttataatccaattccctttttcaaaaccaattgggactacctaaaaaaactgtcgtaagttttttgagaggaaaactttcaagagttatattgtaacttgcatataactatgttgtacctcctccgtttcatattacaagactttctagcattccttacattcatatatatgttaatgaatctaaacatatatatgtgtctagattcattaacatatatatgaatatggataatgttaagggttataatatgaaacgaaagaagcaactcatatgtaacttagagtatatctatgaaagacttacagctagcacagtggtacaactccggtctgcaaactgaagatcgtgggatcgaatcccagccacacgcttgctttgtttttcctcatccttgctcttgcacgaatctcggagcaagatctaatggttaaaaaacgcaagttttctctcctaaaaaccgtcgacaacaatgtagcaattccgaaccaattaagcacatataagaagatgtactttgcattgaaggagtaaaatctgaaacatgtgcttgattatgttgacatgttgaagaagtagatctatattagcaccttgcattggagatacatagggccaatcccacgtgaagaattttttttccacaactagtcaatgtattacaaatctagaaaatcagaaattgcgtcgacatcacacttagctgtgttggggtagcctgtatccaaagattttccttaaaattgattgtgctccaaaatggtttatccccctccagccctgcagcttgattagtccacaacttgtccagcacagcaataggccccaaaagtgtatagatgctcatgctctcgagtctcgatcacacacggacacagagtctccgccgcattttcttcttccccaacctccacactttcgtcctcccccctttctcctcccccttccccaacccacacccacacacacttccaagctagccgtctccaacaaccctccccccaccatcctccccatgtcctcctccctcccctctcccctcctcttcctcctcctcctccttcccttccccgccgcggttcgttcccagccggcggcggcccccgcgccgcagcagcaatgcccgctcaacttcaccgcgctccggcccttcctggcccagccgctcccgcccgacgactccgcgcgctgtctcctcgccgtgcagtccgttcgcctcctcctcgcgctccacctcgccgacacaggatccttcgtcctcccggctaactcctactgcctcccgccgatccgggccgagctccccttcgcgctcccgtcgccctccgcctgcggcctccaggggctcgacgcgctcctcgcgtccccggggtgcgccaacgtttccactctcggggacttcgacgccgccgtgccgccgtcctcgcgggcggacatgaacgccagctgcaaccgggacctcaccccggtccccgactgtaccttctgcaccacctcgctcagcaaggacgcggcggcctacctactcccgggctcccccaacgacggtgggaacaacgtcaccggctgcgtccagtaccccttcatctacgccggcgccgccgccagcccgcgcggcgccgacgacccagccacgggcaactggctctacctcctcaaggtgaactctgcttccaaggccagctccagcgtccctggttgggtctacggcgtcgtgtttggctgcgtcgccatggttctgctcgttgccgcggcggctgcctcttggttcctggtgcggcggcggaggaggcgggccggcgccgcggcgctggccaaggccgcggccgacagcaggagcaagcgctcgcaggcgatggagtcaatcagcgcgagcaccacgctagtccagttcacctacgacgagatca

SEQ ID NO: 27512 - DNA, 1922 bp, Oryza sativa
ttcggtgccggggaatgccagatgacgtggccggtgaggcagaggattgccatagggatggcgcgcggactggcctatctgcaccgcggggcgcagcccgccatcattcacagggatatcaaagcgagcaatatcttgcttgatgacgactttgaggccatggtggctgatttcggattggccaagtttgcaccggaagggatgacgcatgtgagcacaagggttgctggcacgctgggttatgtcgctccagagtatgcactgtatggccaattgactgagaagagtgatgtctatagcttcggagttgtacttcttgagcttctaagtggaaagagggcatttatctctcttggtgaaggccagaactttgtgctcagtgaatgggcttggttattggtccggagggggaagacagtggatgtgatccaagaaggaatggttgagcctggtcctactgaggtaatggagaagtatgtacttgtcgcagcactctgcacgcatcctcagctgcacgctaggccaacaatggatcaagtggtgaagatactagaggcagattcagcgtcaggtcctttaattattccggagcggcctcttccggtagtcgcaaacctggctgagattgagagatcagccagtagcagtggctcaggtcagctgtttagtccctctggtttccggtcttttactcatataaatgaagatgctgctttggagtctcctaaagaagaatgacacttttcttagctgagtagagaaaagtttatttctagattctctgtgtaccatattttttttgttagcttgatttctcttaatggaattactcaattgtgtagatagaaattgtacttttgcccccacccaggaaatgtaagattctttggtgacagttgaattcatttaaaacatatctgcttttttatttctttatcatatatttgacatttaaatatcattgattcattagtgtggactgtttttttctattggatcgtcaagatgagaaacaggaagattaaaacaattccctgttataaatttagtttgcatattgtagaacaaattgtgctatggagttcaaaggtacctttcacttctagagtcagataataagaataaatacattatatattcatattcttctattgaattgtctcgtatcttgaaatcggtaggcatagaaattctgaaatttttacattttggtcctttttgaaaacttattttacaaatagacccctgggaaaacttaaaccggaaatggtcctttttgggacgccagagtggctggcgccgtaccccaacatggcggcgccagccacactggcgccgtgcccgtgccaccgtggcaatagggctgtcgtggaggtcttgcctgggcagaaagggggcgccagccacaatggcgtcgcccctcataccatggcgccagcatagctggcgcgtccgtcctctgtgccttaaaccccgtgggccccaccacctttctcctccccactcccattttcgccattcccagcccgagcagcgagctgctgtttttttccctctctctccccctcacctttccacttcaaatccactcaatttgaagccgtttttcgcgggatttgttgtggaaatcgaagagaaaggtagactccttcattcccccttcttttttttcatttttattggttgaatttgtagatcggtgggtaaccctagaaccccttttttacccaaatttgtgatttttagcatttgttcttaggattggcttgttgtagtgctacatgtttgcaatgtactcattggtgtcatgatttttttaaccatatatgtggtaatgttaatttttggatggtttggttggatggatggatgaaaaattatggttgaggcatgatgaaggtttgggttgtatgatagagtat

SEQ ID NO: 27513 - DNA, 4209 bp, Oryza sativa
ccccctcctccccccataaaagcccttctgcctccgggcctcggctggcgccgccctcatggaccacggcgccagggtagctggcgccgccctcccccagcccgaaacccttctgcctcgcggcactggctggcgccgcccttcccaacctcggcgccagggtggttggcgccgccctctgcctccctgcaaattgaagatccatattgcacagatgtaccaattcacagttcgcaattcaaatcacaattcacagattcgtacagactaaaacaggttccaattgcacaaatcacaatgccaaaagtccatcacatagtcctcagatagtccatcacatattccacacatcaaacaatgccaaaagtccatcacatatcccacacatcaaacaatgcaaaaagtccatcctatattccacacatgaaacaatgtcaaaagtccatcacatagtcctcacatagtccatcacattttatatcacatagtgcaccacatatgtcatactaccaaccaatagattaacttcatacaaattacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaagttgtattgcgtgggttgcgtcccctgaggcgcgtcgggaagctgtgacatgtctatcttctcggcgtctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatagagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacattgcggagcgtgttctccgtgtcctcatcacccctcggagcttggagggcatgccccatttcattcacactcctgaggagctctctcgactgaaagcgtgaaaagatatatgttagggtctagggtgcaaatggaagtaactttgacaaatgcaagaaaacttacgactctgtctctaagtggggcgtgctccatttgatatccaactctagtccggacatcatagggattccgtccctcatcggagtcgcggtcatcctctatgtcggcttccgtccaagtagggcggaggaacagtctatatgtcctatgcagccaacgaaggtactctgagaaaagatgattttggtgtatagtctcgatgtacctatcgttccttccggctgttctccattcatcaatgtatctattatgctctagcccccagtctttcaccttctttgttctcaccctgtcatacctagacaagtagaaggtgatgaaacagtagtgagcatcgacaatggttaaatggaacaaaattgaacattgacaatgaaagcaaacaaagataagaaattttacttgtgtaattcaactccagttgagatgtcctcaaccggccaatcttgtttcttcccgaactgtcgcatgacacggtgtggaaggtggtactcaactgcccagaaacaaatcaatgggcactggtacatgaaatagtcagagtctcgattgcacatcgagttcagggtcaggcttgaagcctcatttgtgtggtatggtaaccacttaatctgcaaaagttgaagagatgtcgttggttagtatctcaattaaagaagtaaatgtctatctagaagtaatattggaagtacttacatgttgaggctgcaagcagtccatctcattgacataatgcttgtatgccacatcccggtgagcatgtgcagtgtcagtactctcaaaaaggtaggccactgtcttctccatgtctggctcattgtagggccaaggagtgaagctttgcctccacttaggccttccaaccggtagtcttaaccacatccacatctgaatcaacgagcatctattttgcaccggcgcagcatcaagttgaacgcatgaaggtggttttcttccagaaccacctagacccgagtccatttcgttcttgaatcgtttcgatctcctcttccctcttgttttaatcttcagataaacgtgtataagatgtgagcaaggcatatggtagagcaatggcctttggcaagaacatgagttcccctcacctttaactttgaaggctcttgcgccgaatctaacaccaccacacgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaatgtagtcattgcacttcatgaacgtaaatgatacgatggccgtcactggaagcttacgaacaccaactagcacgctattgaactgttcggccatgttggttgtcatgtaaccccaccagcggccatttctatcgtatgcacgagaccacttatctttatccaacaactcatcttcaagccatttacgaggaccttcgggaatacgctgccttagtgcctcaacatccctctcaaatatccacttctcgtcaatctgacatattcttaggagctcttttgtctgatgcttgtccgcaccggccttgtggaaattagcactgaagtgcctcatgcaccaccggtggtgaaccgatggcaatcctggaacaggagtcatcatggcattcattataccagcatgtcgatctgagataatacaaacctccctatgcggcccaaccacaacccgtcggacaagatcgataaaccagcaccaatctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaaggaccaaagcaccagaatgcacgcataaaaattttcttggtcactccatcaacgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacacagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagaccttttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccacctggaatggttctggcaactgatctaggttgatgccgccatctagtagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacatcaaagtaatcatctggattcacatattggcatgctacttctgtcgggtattcagggttgactccgtacgacgaccaatgaacactcg

SEQ ID NO: 27514 - DNA, 800 bp, Oryza sativa
ttttttttttgacaagaaaacttgcagggctttgcccagcagtgtattttaaataaagaaaatatttacaaggttacaaagatacatgcggctcacacagagatactataaggtttgtacccaattaaaaatagtttgctttaaaggatcattcattctacacatatgcagaagaacttctttgtgaaaagagatctccatgcctggaaagagggttgaatgttctgaaatatgaagccatttctttgtttccagatgtgccaagctgccaaaaagaaaatttccaggaaacccttctgagaaaatttgattcttgctagggagatcatttggaaaaactccaaattgttattccactcaattcccaggtattgccaacagctgatgctgaaaggacataaaaagaagaggtgtagccttgtctctctgcagttcgcattgcacaaaacacacgtgagatcatcatcttctttggcacaatgtcttctatccagcatatctcttttattaagtctatcacaaaacattagccaggcaaagactttgatcttcatgacacattttgttttccatagccaaatcatgggtctggggggttgcaatgcagaataatttagcttatagaatttcttagctgtgtacttatctgagccccagataaaattccaagcatcccccatccctgattgtaaattcaaactgtccagaaccccctgaagttgcaagaattccgagtaagcctcatccgagaggggtagagcaaaagaatcttctaggggtcttgaacacatggccttgac

SEQ ID NO: 27515 - DNA, 27264 bp, Oryza sativa
  unsure (1)..(27264): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatgagaaattgaagaaaaagaattacgcaatcaagttgcaggagttcaatagtatatgcagtacttgtcatatgagggctgaaaatgcttgccttggaactgaggtttgttaaatgatctctccaaactcatgctagaattttttgtggtatgttttttctacatagaatccgtattttagattgtgaacgtttccaccaacttgataaatttgagcatcggatattgggaacatatttctttcggtattccccatatttctttcggtatttcctactgtccatcttggcttctgagctgattttttcatgccggcaggcaaagggtgctcttcggtaatccctatcccaaaagttacctaatgatttctaaaataggaagtacattatcttgttcataaggctcacatcaactcgtataaactggttcctgtttcacagcaatccctactagtacagtagacttcattttttttctaattcaataaatcacatatatttgtactatcacttaaactactagttagtacaatattttttatagtgatagtagtactcgtaaattaagaatcgagatcatttctaccggtaataatactgatagtagatatattattagtagagggctagaggccacagcagaggtacttaaaatctacatataacctatcaaatagccccatccatttccatgcgtgtgcgttacgactagctaggaacacacgtgggtggacgtggacctgcgctaacacaattaaccgggttctgcgctgggataggccactacacaatgtcaaaacattacagccgggcggtagtcaggcaatatctttgtacagataatcggatgatataacttatcgacgaaccaacattcggcaattccaattttgttgaccgaaaagcagtaggaaattgtctaaatttttcctgataagctatcgatcggcatttaaacttcacattaatagccggttggcaaaaacttgtcgacaccagctcactcaacaaaaaaataactatagtcaatgggggcaaccgttggaatttctgtttcatacctaattcattccctgggcatatgatctaaaattcatagaactacactactattggaaacatatgacaagtgcggaatgtaggatcaataattctatagatatgttcatctcttatttcccaatcactgtgtctaacaaatctgaacaactgttcagtttgtttgtagtgatgtatacttttgcattgcagttgagtcagtacacaaagttctagttcattccctcatcattcctgctagagatttgatgccatgaaatgtgaacttatgtgcagattcaacgcctttatgcccgtgctacaaaccaggagactgaagcacaacctgaagaagtggaccttccattcccccctacagctgggtctcaggaaggagcaccactcaaccaagatgaaccagcaccaccgtccaagtaggcctcgttggcatggcttctttgatctctcctcttatgtccctgtggtattcccagtgctttttaacaattgtggctgcgtcaatatgttgatgaactatggaaataccaacaggagcagaagtgtgggggatcaggaggcttggccggccttagcctttatatttatgcaatggaattaaaaactagcaataaattcagtactatgtgtgtgccaatcccaaaataaaattatgtactacagttgagcacctaaactctgcttaattggaagatggtatatcttctctattaattacatttcggacatgctatatggtattccattttgctcgttcagttgaagtcgttttttacttcttttgctattgctaagtttttctttcgaggactattgctaattttttttttagctagctatgtgctaaagcgtttgctcttgagaattacagtagtccaatcctaccaaattatcactgcttgtcttactagtgttggcaatcttcagagataaacccagcgctgatcatcttcaagtttcagagtcctgtgttgtcacttacggcttgtttggtaacttgagggaaggggattgagagtttccacgagggaatgagattaagatgggaatttgatttttcatcctagactcttgtttggaagaggtggtggaaattgatatggagtttagttggagattaggtcattaatgaaaacggatggctgagatttatttaggcgaagtaaaggaggaattccctcccaattaccaccccctacccaggtattgaaaaggagggagttcattcctcaattcctcatccccagcccactaaaattcccatgtctcccaactaaacaaaagagttaataacttcatccctctaaactcccaatccctcctaaaaactcccccaaccaaaacgggccatgcgcgtctgttgtcgttccaattttttcgtcgtgtcagtttggagtctgttatcttcgtgctagttcacgccgggagtttgttgcgtctttgtagcgttgtacatgcaccacaatcgctcgtgtgggatggcatgaagtcgaagtgctcgatcgtgtgcgcgcgatcgttggccacttggcctctcggccacttcttcattcagtaacaaataaaaggagagaaaatcggtaagcagcatgcaagtttgctgcataaaacttcatcgtgagttggtaattcctctctcgcgtgtgtttgttttcgccttgggaattctccgctccaggtcgccggcatcaagggacgctggcaagatttgggatcagagccatgacggcccgacgccgaccatctagaggagctctcctcgacggcagcgtccgtatctctcgctctcctccacgccatggtcgccgcctcgctgacggtgatcagcagatggtggtccagcgcattttgaaggaagtgagtggccgactcaatgatgtgaccattactactattgatacaactattcctcacatcatagttcaaccgaaagacatcaagatcaaacagtccaagttcaggaatccaattcagcttcctgctacagtgctgaattcaaacggccatgaaatgtgcatacgagctccgttttgggtatctgagtacttgatggtaagctcttggagttctcttttcaacgaattcaaccttatctccgaatcatagaaacaatgtgttgcgtcaacattgtaatgggactatggacttataacttcgtctgggaccctggcccatgtagggtgtgccccaaccatttagttaagaatcgacacctataattgtggacataggtgccgataaattggtgtcggctaaaaaaatcattacctaaaataaattcccaaacagtacctatgtctgtttatatagtagtgagaggttgttcagcaactatgcctgtttctgcagtagtgagaggttattgggcatgctctagcaacggcaaagcgatagggtgtgtatacggttcaattcgaaatgaatagtgtagggaataatagtatacttcctctaacggtcatcaccacaattattttatcactaactacttcaatttaaaacttagggtgaatagctcaagtggtcctccaagtttcatccaaggctcagtttagtccttgatgtttcaatctattcatattagtccttcaagttttcattttagttaaacttatccttgaacccacttagaagccacatggccaaacataaccaataattcttttgataaatgactcttatacccccacattcacatatataagagaaaaaattgcatgtaataaatttttttatagataatgcatagtaatttatgtaaagcaaaaataaattacgaactcgcaagtgtatatgatagtcattgcttaagtttcatatgcacatattgaaataatgggaagtacatatgcgatattgtttgttcatcttagttttctcttttctagtgtatagttgtatacaaattaagggtaaaaggggcattttctaatgtaaatattgacaagaaatagacatatgacttattatgtgggtccaagatgattttaagccaaaacaaatacttaggggatctatgtggacaaaatgaaacttaaaggaccaaattgagccttaaatgaaacttgagggactaaactagctattcaccctaaaacttataaaaagcataggaaagttataatggttttaaacgtattttgaagaaaaattgaataattgatcatcaaactttgaacacatcaacttcacctattccaaagcatcacttattcatgatttcatggtgtaacactactggaatcagatttaatatgaatttttatcaattgccaataaaaaagatacttcctgcgtaaaaaggtattttcgaatggagggatggaacctgtaccgtaacttataacgctcccgatcaacactttggtgtggtaggtgccagcgcggcagcacgccaacgtaccaccaaccgatttgacgcagggactaattaagacaaatataattcaaatgtgtacgccagaaacacactacttaaaaaacgatttttttacgagaacccataatttttataaatggagcataactcttaagacacctgtataaaaaaattgatttttccatacaaaaatgaaatgagcccatttttgcatgcggatcacttaagagcccacatatgaaaatcgatttttccatacaagcgtcataaggagccatatgcaaaaataaaatttgaaactagtttatctcactcatatgaacttcaaattggattattctttttcctaattttttctaaaatcatgctatatcatgttattgtgttcttactgctattattttagccattttttcttgtgactttgtttatcaattaaaaatttgaatttcaaaaaataacaacttctaataatattttgaagcagtaaataatttcatttgaaaaagtcatgaatataaaagttgtagaactcatcaagatatacaacttttatttttatcatttttatatccaataaagtgatagtaagattgtttacagaatttgcatatctctcttttagtttataaaaccatacgagatatacgtaaaattcgtgaacaatattactaccactttgtaggatgaagaaatgactaaaataaaagttacagatactgatgagctttgttgttgatgactatttcagttgaaattatttagtattcaaaaatatagtttgaagttgtcatattttgaaattcaaattcaaattgttgaaacaaagtcatatagaaaaatgaccaaatcaaaacttgtagatattgttgtgttatacaactttgttgttgataatttttccatttgaaatcatttactatccgaaaaactatttgaatttattatattttaaaattcaaattttatatagttcaaccaaactcggatggagaaatgaccaaaagaaaaattggtagatctcactgagttctacaactttgtttttaacaactttttcacatgagttcatttagtattgtaaaattcgattcgaagtctaaagagccgcatgattttttttgcatgcggaccacttaagagacccgtatgcgaaaatcgatttttacatactagcctcttagagagtcttctacaagtccaacttacctcctatttccctctcaatagttcaaaaattttcaactctcctctctcttcgccggccaaccttatattctcgtctctctgactcgcctcttcacctactatcctttcttctcgatctaagccggcggtgggcagtggggcgcaacagcgggcagttttggctgcgagcgacggctgtgccccgcacggaggccggtggaagaggtgcccgacgactcccccgcgcggatctggggacgacgggccttcccagcgcggattcggggacgaccactcttcccccacgcggatccggcggaggtgccctcccccgcgacgacgatgacctcgacaacgatgacgacctccggcgacgcggatttcggcggcagcggtgggcgagggccacattgagggcgggcgtgggcgacggcggcggccctcccccgcccggaaccaccgaccaccgcccttccccgccctgattcgccagcggcggtccttccctgttctaatctaccggccgccgccctgccttgcccagatccgcaggctgtcgcccttccccgccccgattcaccggcggtggccctcccggtgccctctcgccatgatgcgagagaacgatgacgtcgacgatagcggcaacggctcgaggacgacggcgaaggcgactgaaacttctatttttttcgcgatttttcccttttcgcatgcggccggcttaagcggccgcaagtaaaaatcgtgatttttgcagaccttttcacgcacgcgggccgcccaaccaccgaaaatgcttcttgcctgtttgcaaaaacggttttcattgttgtgatgagaagctcttttgatcctttctatcccacgaaaaaccaacttaatactgaatatgacacatattaatactatgaatctgaacatatttatctgaacatatttttatctagattcgcgttgtatttatcacgttcggttaaaaatgagtatagaattaaacccggctctatcaatatataacacaaatttcttgccttctctttaaaaaagcatatatagaatttactttagacttgtattgtacataccaaagggatccctaccgtatacgcgtaatatactcgtactgtatatgtctaccatgtaaaatgtaaaatactatgtaattacatctggtcgccacataccgctgcgctagctcattctacaccgccgtcgtccgagctcacggccgccgctgttacctgtctgacttgtctccggccacacaataaaactgagccggtgacctcaacgcgcgcggccgcgccactcaccacgaggctagtcagaactaccatacagctcatatgctaacacaagaacagaaagggaacaaaacaataagcaagagaagcacggacgggagcctactactactccagccgcagcatgcggcggaggtcgcgcgtcgcggcgtcatcgacggcggctgtgacggcggccttcctgaacgggaactgcggcagcggcacagagctcggctcgggggacacggagaacgccggcccggcgtacacctccaccgctacaggcctcgcggccgccttcctggcggcggaggagcccctgccctgacgtctccggcttcccgccgtcgtcggcttggtcctcgcatcgctctgatggttgttggccgtcctctggtgcgtggcggcggtggcacggatcctccgctgcgccggggaaggcaggagcacgttgtgcgggcgcagcacctcggtggccatatcaatggaggacgaggagaagaaagaagaagaggaggaaaaggttgggagtacagaacttggaagttgaaattggattggaggggtggaatggatgagaagaagaatgggtcttataggatggagaagaggattggagtggattcggtatttcggtggacgcgttgttgtggtggtgggctccgcctccgccggtgtggtggactttgacggtttcctcctcatttcgcctcagcagaaagctggtggagtggtgggttgtgggataacggcaggttcgcgtcggtttcgccggtcaaagctggaagccccgattgctctgcgtttcttggtgtacccgcccaatttgcacaccagattgttacattttctctttttgcgtttgtactccctccgtttcacaatgtaagactttctagcattgcccacatttatatagatgttaataaatctacacatatatagattcattaacatctatatgtatgtgggcaatggacaatgctagaaagtcttacattgtgaaacagaggaagtaggttagtcctagaccataagagcatgctataggttaactataatgacatatcgagaagataaaagaggagagaaaaatagcgagctacaaatttatagctagctataacacagactctaagacgcaatatgtatatgataggtagggtcaggtattaatagtgtacaatatatttatatgtaactagtgtatgaattagctacaacatcatccaaattaaaaaaataagtggcatgaataataattagctataacaacatgcttaccaacctcgaacatatctgttaaagtcattgttaaagtcatttttagtctgtagtgatgcacgaataataagtatcagtagaaaaatgactttaacagctgtgtttggggttggtaaacatgctgctggggaaatatgaaaaggctggtttttttagcttttcgattctaatttattttctgaattttgcagttattgattctcataatcatgtaagaacctatatattatttggggaagctggggattcttatagaaattatagctggaaaaaagtacaaataataccataaaggttgcacacatcgattgagctactaggttttaatgtgacttgcactttggaagctcgctccaatcgaaaaattttcgaaggaaacaatcgaaaatgatttatgagtgaagtttttatatggtattaataatttaaaagttaatgctagaaaatagatcatgataaaaaaaaccacccaaaaatcaaagaatttaaagggatcccactccttcggacattgatccctattaggacaatatttgcagttatgtgccattctgttacatatatgtcccttaagtactttactagcattatagttgacaaagacaataaaacacatgtaagaacaccatatataatatgttaaaactacgagtgaaatactgtattgtcgagtagtcaaccgtgcatgtctgctggtgtgtacgcattgcaaattgcagtgctagtgcaagcaaaagccccagccggcatgttgtaagctgtctgctggactgctgatgccgcggtccggcgcaagttgggtcaggtcggcttcggaataaacctcgtgcctcatcagcagctcagcgccgtgcatccctcccggtcaattcaggtcatcaccgcgttatagattggcatcacgcgtcaccaaccttatcgacgatggttcactgcttcactgctgccgtgcctatacttccatgcatgccactaactccgttaattactctcaatactgactctgattctggaggaaactttaactgcacaactaataattttcgtataataaatctatagatactttcctacatgtatattagatcggtcaaacttcaacaagttttaatctcgtaggatatcaagtagagaagaaatcagacgtgcataaatatatatcctaaaagaaatttgagaacaagtaacatcaacatggacgttttttcaagataatagaataacattcctgcctttactcaatgagttacaaccaattattacagcctaacactcaaatgaatgcacttcaaatataattataaaaataaaatggcaccaatcataaaaaagaaacaaaccaaatactaccaacccaagataaagagtacacaattattgaattatgtatatgaacctccatccgaaattgacaaacaaatgcataaccattgtctcaaagattagacatgcaacctttaaaagctcgccatcttcatcatacctttgtagttgtgtctaagatctgagccaatatgttgccttgaaaattacctgaatatataaaatagatggtgttttgttaaaaatcttatcattcctacttaatcatagagcctaacatattgcagatgccctaataagtataagttttctacttttcttgtccactccccgaagccaatcataaaaaatatgagatatgctattaagagggtatagaccaaaagaaaattgaactactttctaaataaattttgcataatgacattccaaaaacagatgttgaatggacccctttttcatacagaaacaacatatcaaacttccattccaatttctcaacatggatgtaactacacagttcttgctttcgtaatagtctaaacacgtgacacaattatttccataattagtatcatgttcaaccgagtacgctctccgaaagcagatgtgtctaattagtaatccatctctttttcacgtgggaatatgcaagcatgcaacaggaaaagatactactaatagctaagttttgaataaacttttctttcaaattaaatatccaatctacaattcaattataacattctattcgttttaattaaatctttatagaaagatcttacatgcttatatttcgatgaaaaaagatatatgttataaattagttttattatacgtaaattacttttaggttttcttagaaatttatgaaaggaaatttaataaagcctaaaagtaagtcacacaaatcatatataattacttctaaatttcattctttttttaaaatcatctagcaatatcagattgttacttttaatatatgaaaagttacttctatttctctacatagttacttccactactagtattttgttataatgtaattatttttctagagttattttacttctaatcatgaagggttacttctatttttgactttctatacgatgaaattactatttttttaaaaaataatatagtgattacttcaaaaataaagaaaataattttatttgctcgtgaatattctttgcattttacttcacatactttcttatttcaacctcgtccactatgtttactttcaatgcaacgaaaagttactttacttcttgggtttaagtaaattacttttgaatgcttatataaattcaatattagactcgttttgtgatatattttgagtgaagtgcgatggttagaacggatttaaaaaaaataatacatggtttaaaacatataagtgttcaaaggttttgtaccaaaatatgagctaatgcaaaggagggctagtggagttggtgttgcacaaattttgacaatttgaccctttgtaaaaactatttttacaaataaaccgctgccaaaacttatttcaaatctgacccttttgctcaacgccaaatcgtgtggcgctgaatttacacacctcaatgccaaatagtatagcgctgaatgtacgttggcatacggacttagtctcctatccgtcgtggtacggcattaagtgccagctgacgtggcgctaaggtgtctaagttctacgccacatgatttggcgttgagtaaaagggtcagactttaaataagttttggcagtggttcatttgtaaatatagtttttacaaagggtcaaattgtcaaaatttatgttggtgttgcccccaaaacatgaatagttgtcctttttcgcgctaaagcctctcggtaaagttgatcagatggccctgcacatatgcgtcacttgatcggatggctcacacatatgtcgctcgataggtccagatcaagagagcgcgcacgcaatagattttgcctatcaaacatgtcaggaggtgcattttattagagcctaccattattatttgtcagagcatgtatctctaacattattatttttgttaaaattttggaacatcatccgtgtttgattaggtttcgagtatctcctattttacttccatatgttttttgtccgacaatagcgctaggtcgcagcctcacgcgggatcggttccgtttccacgcgacgccccgcacaggaatacacaatcactccatcatcctggacaagattgtggtggtttcagcatgggaccaactgaaacagaacaaagtagtaaaagctaatccagttcgtttaagttctggccgagtcatcttcgagacaaatcatcactaattgacatatatatatatatatatatatatatatatatatatatatatatatatatatatatatatatatatatgcacgagcgaggagagcatatcgatcacaggccttcatatggctgctctttgattagctgaggaaattatccgaatagtatatattattcttagcgataaatatgtcggtgcagtgccttgcaaaagtgtacgtacaacatcttggatcttgaggatggtataactaattaaaattgatctctaaatctcactagtacagatccttctatctgtgacggtctctaacatacctgaaaatagcaggccgtcacaagaaagtcatctcaattgggccgaaaaagtacctgattgagatatggtcgcacatacatattagatgggcataaaacttaagcccgtcacggatgacacctatcagtgacgagccgtagtttagatccgattgagataacattccatatctcaaacgggtttgaagttggggcccgtcacaaatgaccatcatccatgatgggcaccaactttatgcccgattaagataacattccatatctcaaacgggacttaagttggggccgtcacagatgaccatcatccgtgacgtacaccaacttaaggcccgtcacagatgactcatcagtaacgggctacatactaattttcggttgacatgacttaatctctatcgggcattaattaaatcccgtcaccgatgagtatttttttcatttttcgtatgaaatgtttatatttgtaagttgaattatagcaaaataattaacttgcagtataataatttattttacgagtcaaaataattttacgggtagtaaataatatcaaatggaaaagtgatcaacaacaaagttgtataactcatcaagaactataacttttattttggtcatttttctatataacattttttgaacagcttgaattggaatttgaaaatatgacaacttcaaacaacattttcaaatactaaatgatttcaactgaaaaagttatcaataacaaaattgaataactcatcaagatctataacttttattttggtcatttttctatataacattttttgaaccgtttgaatttgaatttaaaaataagataatttcaaacaacatttttaaatactaaatgatttcaactaaagaagttatcaacaacaaagttgaataactcatcaagatctaaaacttttattttggtcatttcttcatctgataaaatgttagtaacattgttaacaaattttacatatatgcgtatattttataaattagataggagatatgtcaattttgtgaacaatattactatcactttatcagatgaataaatgaccaaaataaaagttataaatcttgatgagttattcaactttgttgttgataactttttcaattgaaatcatttagtgtttgaaaatgttgtttgaagttgtcgtattttctaattcaaattcaaacggttcaaaaaatgttatatagaaaaatgaccaaaataaaagttatagatcttgatgagttattcaacttggttgttgatgactttttgagttgaagtcgttcactaacaaaaaattctatttgaatttctcaaactttgaatttcaaatttcaaattttttaaatagagtcagatggagaaatgaccaaaataaaaattttgcacctcgatgagctctacaactaactttggtttcggtgacttttccatttgaaatcatttattaaccctaatttttcttcgaagttgtcaaattttgaaaattcaaaatttgaattgttcaaataaacttatttgtacaaaggaccgatagatctcgatgagttatacaattttgttgtttatgatttttgatggttgtgtatgtgaatgaatgtatatgaatgggggatgttggggtatgacatatcccggcctaggacttaataggattaatagaatactcataccaacaagttacaactactcttccggaagccgatctccaaagaactttgtagtgaacttcccgggtgcacacgagtaaggacaaaaaaaagattggcctgagaggggcgggacggcatggcaaggctagccaaaaataaaatatttttttttgggattatactcatctgtgacggacattaacttaggcccgattgagatgactcatctgtgacaggctatagttaatgcccatcacagataaggatcatctgtgacgggctatagtttaggcccgattgagataggtcattcgtgacgggctatagtttgacatgtcgtctgggtcaagactatcactccccgattgagataggttcatccatgacggccatttgcccgattgagataacttttcacatagtgacttctaacctgtgacggacgccgtgcccgattaagatgggggttgccgcccgattgagatgatggtatccgttctagtgtctatatctctatctattctattctctactatatctatatctatatctattctctatccgtgtatgagtcgatttttaagttcgttcgcttttgaaaatatatatccgtatttgagtcgatttttaaattcgttcgcttctagaaatactaaaaggaatcgtataagaaatctatttaaaaaaactcacatgctaactggagacgatcggactactaactacagctcatgattatatgtatatatcgaagcgaattcccatagtgaatttcaccttaactaaaccgtttaaaataataagattaaaatagccttcacccgttgcaacgcaccggcattttttctaataatatacatatatgttgatatattgtcacatattccaggaaaaaaatattgtcgcatgctaaagaaataatccctaaagcatttttcttaaagaaaggtattcctagactgccttccgtatttgcttgtaggcaaaatttgccataggacatccaaaatttgtgtaattggttggaggacaccgtaagccactgctgaggaacaccaccaaaggtctaattggctataggacgctggaagcattattttatgatatttgggaaaagcttatagagagaaatttaaaagggacaagtttgccctgcatgctctttctccacctggccacggcgcagcggcacgctgcacagggaggccggtgcaggtgcgagcacgcaccgagatggggaggcagtggcagcgagtagagataaggaggaaagggtgggcggctcgggatgggggcggagatggagcaaagctcaccaggcacaacggaggcgcggacgggatgcggacaggttcggcaaagtcagtggtggcttcgctggtactttgagaggtcctggctaacgcctagcgatggcggtcaggaggagaggggggtcccgagcgctgtttataagccatcgggggagaggagccgtggaggagctcggccggcaccatcaatggccccgatttgccggcggccaaatgacaaccaattaattcgcacaacgccgttcgtggggaaattatggggaaatagagaggacggaatgggagcaaaacccgccaatcctttcttttcttcctatataattggaaccctttaagtgcaatgattgctataaagaatatctctcagctagccacgtcatcagaatcatctcagccattaaatcaacgtgtctttgatgctaaaccattagatcaactaacctccgatgctaatagaaataaatcaggcctgatcaactcccctacacagaatgtgagacagtgcaagacacctgctgattgtcgcacctgaacccattctgcgtgacgtgatattgtctcaagactaaatcatggttctcgatgtttttagtcatcagaacatttcgcatacatcttcgcagccatccagtagtatctcagtacaataaaacgcaagtcagtttgggaatatacctgggttgctttgctcattgaatcgcatatgttcgatacacattgaaatgaaaaatggacgtttaggcacaattttatgtcagcatcatgaatctgccccctttttttcatgcaagtttgttcaccatcttatatcaacattatggatccattttatatatttttagaaaattttccactatgcccggcgcaaagcgcggggtatcaactagttaattcagtgaaacggccggcggcgcgagtgaatcagcacctcctcctccaccaaatccgccgtcagagtggcttcttcctctccctgaccctgacgaccccaaccagccggcgacgtgatcattagcctcgacccctaaagagtatgcaggggtacatttgtactttccacaatttttctctctccatttgcatcaaatataatataataatacctctggtgtccaacagccaattatactatttttgcggtgtccctcaacagtgacacgacattgctgtgtccttcggccaattaaaaagttaaaattttgaatgtcctatagcaaattttgcattgcccgtgaatgctcatctaatgcgtggaaattctgcaatatgtaagtttcacatgacactttctttcagtgggtcaagtcgttccttctgaaaaatgggtcactcaacaggctatctttttcaacaatattattatacccgccgaaataattaatttgattgcaaggcatgtctatatacataacacctggcaaaaaaacaaaatttatgcagggttattattggaacattgcaacagcggagactacctgatgcagagttttttatttgaactattattttgaaaataaaccgccaaaaattattttaataacacagaaaaggtcaatttattcttccggactatttcatcgggctcaaatttttattgcaaattatataccacctccgtctcaaattatacgggatgtaatgtatcctaactaccccattgtttcgcttattcgggggataaacaaaacggcatatttgcgaacgaaaaataatttgtgaataaaacttttatatacgtgtttttaacaatctaaaagcaaagactgaaaataaacttcaatgaaaaaacctcgaaatcaactctaaatttaaggttgaaaattccaattttggctgataggcataagtataagctaaaagatgaggctgtaatactatgaatctcaacaatttctatcacatgtcacatcccgtactagattaacttaatttgggaccaaagaagtacgagttatatagatagaatcaaatagaaaattagtgttaaggctgatctaaacatcaaattaaatttcaaagttgaaacaaacaatcatcaaaatatatggaaatatttttcaacttatgataatagtgccatctattgctaaaacaaaattaatcttaaaatataactagtataaatagtaaaaatgataaatattattaaggcagcggtgacgatagccgcctcgacggtggggccgccactggtggcgagttgtcggcggtggaaagaagataagaggagaggagagaataagaaggtgctcgtgctgctcgcggagaggcacagtgtttggctaggcgctgcctccccattcgcctctctctccgatgtcctcctcgccgcccgccccatcaggtggagagggattggggaagagagaagaagggaggatgcaggaagataatggaattgacacgtgggtctcgtatctagtggtatttttgtctatataatgacggaaatcgtggcgatgatggcatgcttccaatttgtgtgtatccggatggcatggatacaaatagaatacgaatgatagtagcatttatctaaaatgatacatttgtaaaagagataatccaagaaataccattgacaaacgtccaagtcccagaaattccatcgacaagtgtgagttccaagaaatgccattgtaaagtcgcagaaatgccatcgacaagtgtgagttccaagaaatgtcattgtacaaacgattttgtcccaaaaatgccatcgccgttagggttccgaccattttgtgccgttaaaacactgttcatcctatagaacataacggcgcggaattgacggaaccctaacggcgcggaatggacggaaccctaacggcgatggtatttttaggacaaagtcatttgtatgatggcattttttagaactcacacttgtcgatggtatttctgggatttggacgcttgtcaatggtatttcttggattatctgtttctaaaagcatggatcaaatttacctaaaaaatttaggcgatggcaggtcttttgctgtcaacataaaccacatgtcaccaaagtaaaccatattctgttccctaaaaaaaaagtaaaccatattctctatcttctaccgcggcgacaggtcttctttatggtcaccatattctttggctggatttgcataaaccaatgacgggtgatggttggagtgatttgcggaaaccataatgacacaatgatgttaaaatgacatcgatgcccttctttcgagtttatgcgcattgcattaagccttgatacggtgggagggggtacaacctcgcaggcgtcggatgtgaacacgtggcaacatctgcacttgaccacatctaggaatgaacaaaattggaaacatggttatataagagtgaaaaaatggaaatgatagtaagataagactatttttctgagttaatggttaaagtctttgttctaagagaccatacttgtctctatcgttgaacaagcccttagttgcccttaatttgtttgacagaattgacgtttaccaaaacatattatgatgtgatatacttacacattacagtttataacatctgaggcctagtttggaacataagaatttcatacaaaatatttaatacggttagtacaaaaatagttcagttccactaaataaaatatatcgaccacatagtacatcaaccataggtataaatttgttacatcaaaaataaatatgataattcatccttacattattccaaatagagctactgctggcagcgcaaaatgtgaataatttctttttttaagataatggaaataaacccggcgtttgctcaaaaaaaaggtacaaccacttattagttattacacaaaatcgctgaactatattcacacaccatagagttcataggagacaatcagaatttaacaaaactccaacacaaactaatagacaccaaaacaagataaagaaatcacaattattggctcctatttgtgaatatccacccgaagttggtgaaaatatgcatgaccgatgactcaagtttgcgacatgcattctttattagcgtgatgtcgtcatcgtacctttgtagttgagcccaataccagagccaatatgtttccctaaaaagtacatgcatataatattttaatgctgatttgtcaaaatccatatcattactagtaatccatagcctaacatatagcaaatgctcctacaagcatcaatttctttgtttttgaatcaatccccacaagccatctcctaaaaatgtgacatatattatgtggtggaaataacccaaaagaaatatgtattactctctagagagatatagcaaaacggcaatccaagaaaaggtgatatattgtatcattttttatacaaaagcaacacctcatgctaccattccaattcctcctagccaaattatgtatttttaccaccgccccttcaagcagataccacataaaaatgttgatattaagaagtgcctttaagctcccaaataaacttattcctctcaatatacccattattaattaaggctaaatacatagatctaaccgagaattgaccattttattgaaaattccatttaaaaatgccattgttatttgataaatgaatatgcacaattgaagcacacaaattgtgctaattggccaagtcctgatctactaatgctctcataaaagaaatattgagtggaacagagctcgtaacatttacaacctaacaatttcttctacgaactatagggtacaaagatgggtatctttccttaaaggaagtattatctatccgcttatccttccaaattctgacttgttaaccgctatttattatctaggaactcatatttgagaaaaatacttttaactttcaggagacctgaccataaatgggaatcccttgtttcctctcaacttgagttattgattggttattaaggtattttattttcaataagtcttgtcaaactccttgctcatttattaacttaaacaactatttgctcaataaacactagttttaaatttcaaaattatgtcccatctcgtcagtctatatttttttgtgtgatcatcatcttgccaaaaaaagtgatatataataatcaattttcaaagaacccctctgagaatcttaaaaaaaaatattataaacgtagctagacttaagagcacataattaatcaaaaccaaccttcctcctgcaggtgtatgtttacctttccaacaactaagtttttttttaattctttgtttaatctttttccaatctttattacttagctttttaaaatacatagaaataccaagatattttaaaggaaagtctcccggtatacaaccagaaatgtttgaatattgttcataacattttgtgtctgaccaaagcaaaataattcactcttgtgaaatttatctttaggcagaaagcatttcaaaagttgataataacaactatgggtgtgttcgtgcccctttttccaacccctctctctcgctttccacacgcacgtttttcaaactgctaaacggtgtgttttttgcaaaaagtttttatacgaaagttgcttaaaaaatcaaattaatccattttttaaaaaatattttactaatacttaattaatcacatgctaatggattgctctgtttttcgtgcgggagggattagttcccatcccctaaaaccgaacacagcatatatatttttcgctttctctaaatcattgtcaagaaaaatgagagtatcatctgcatattataaaatgaaaaaccatcatcgactagatgaggaatgaccccactaatttaaccatcttcctttgtcctcttaaataatatagatagcatattaacaaatatattaaaaagtatgagggataaagcctctccttgcctaagaaccttatatatttgaaaattagatgccacttggttatttacttttataccaatatatccatcttggataaaagaaactatccaatcacactattttttgaaaaaccttttatctttaatgtttattgaacaaactattacttaactttatcatacgctttctacaaatcaatcttaaaaatctgtgaaatggtcgaaaatgctcgcgtttagcacgtcgctctcctaacgtgaacaaaactttccacggttacgtcatttgcatcatgcacgtgtcctcgtcggtcctgatcagttcgtacgtgcaactaaatgccacccctttactatgcatcttttgcccttgcaaacgcagcatatctcaggtttgatttggtcggcaaccaccattaattatgaagatgacttatgcctgataaacactaattgcataacatccgtcacatcgcatctccaagcaaacattatccggcatgctgttacccggttgatgatggaagatgacctgaacacacagtaattggacggcagtaggcacgggatggtgattcaagtcgttgctctagtaatttactaaactccaaatgctgatgcagaacaggccgaaattgtgacaatttgaacttttacaaaaacttattaccagaatagaccatgccaaaaacatcaacaaaaatacgttggaaccgaaaatctgatttggaagtggctcaacgccaagtatttgttgaatttataagcacataataatttaatgtatttcataaataaatcatgacgttacagatgtaaactagcgtaaaaccattataagatttaaacatataaactaggtagtaaagcatgaataaatcgaatatgcgcaacatgctgaacacgaactaagggtaccggaagaccagttgctcaacaggaagtactcgcggttgcgggcgttgatgacggcgctatagatggccaaaaggcccgatggcccggcccacggcacggcgttttggcccagcccaagcacggcacggcccgtcaagggtcgggcccgtgccggcccggcccgaccaccggcccgtgactgggcctctccgccggcacgttgggccggcacggcacgatgggccgcatgccaggcccgacacataaacaatagggaggaagaatagacatattatatgccacggtcgaaagaataggaacgtaaaatagacttattttaactatatatatgtcagcccaaagaggagggacgaacaatagacttattttcactatatatatgtcacaccccaaagtggagggacggaaatagacttattttcgctatattatgtcacatcccaaaaaggagggatgaaaaccagacttatttaaaaaattgcacgatgggccacccgcgccttcaggccggcccggcacggcccgacggctggtgggccgtgcctgggcgggaggcgcagcccatgggtaggcacggcccggcacgaagtgtcgatcgggccgtgtcggcccgatggctggtgggccgggccgtgccgggcgggccttttggccatctatagacagcgcgcagcacgcacgcgaaaaggaagacgacccgttgtggtcgaacagggagcagtcgcgcgaagcgcttcccaaaaaccttattgctgtcttctcccggtgcaggacgtcgaaggcgaaggttctagagacggcgtagtaaagaggaggaggcaaaccctattgatttcgcgtgtgttgcgtggaggcggtggctcaacttatataaagatatcaggacgcttgatcaggacgtctgcacgatctccgctccgcgtaaccgaaccggataagtcatgtgtaacttatcccgactctacggcgtttcacgcactagattattcagagtgtttccagtaaagaggaggaggcaaaccctattgatttcgcgtgtgttacgtggaggtggtggctcaacttatatagagatatcaggacgtctgcacgatctttgctccgtgtaaccgaaccggataagttgcgcgtaacttatccggactccacggcgtttcacgcaccggattattcaccatcatgccaggcgaggcgagcgagcacgtgtattccccctcttctctccacttcacatgcttcaagtggttatgagagcatcctccgttataagaaggtctccctctcctagagtaggcaaagtagtactaaactccccatccatgccgtcacatgaggtgggcttttgtgatttttcgaagaattaatcttcgtatgggctaagacccatcaattaattccaacagtactgtggtgctgaactcggacacgcattaaaacgagtatgatctgtgaactggtctggtggtagttgctttcacggtatagcttgaggagttgaggccttgggttgatcctgcgcatagccaaataattttttggagttttttttaacagaaaataacgctggccccactagcaaggtgcggaaaaaaagtaagtgaagatatttttttcgaagtatttgtttggaacaaataggagtttttttaacagaaaataacgttggccccactagcaaggtgcggaaaaaaagtaagtgaagatatttttttcaaagtattttttggaacagataataacgctggctggaaaaaagaaaaagaaatacagcgcttcaaggattcaagcttgggtctgcagattgagagagaggtgcaccaaccactgtatcactgtagacctttttgctaaataggaacaacaatatacttcacaaaaattcagcgccaggcagtgtggcgatttctggtattgacgtggcaaaatctccatgccaaagggtatgtcactgatacgtttggacctcagtgccatcgatggcgctggcgctaaggtcgaggtttgttttttttttaagtttttgacacggtctattattataataagattttataaaaagtcaaattgtgaaaatttgggcagaacagaccccttctcaaacggttaaacccactcaatatcaccatccacgagattttgaaccatttgccatcttctttaatggcgcactctcaaatgccattttcttttcttgaataatgttgattatttgccatccgactctttatattctttctattttaccattctttcctaccaactcagcaaacttgtgtgacaaatgacattaatatccctcatctcctttcccatctgcagttcacggactgtgccatcaccggcctcgtcaagtgaagaagctattgctttcctagtttgcttggtcgattggtaatttggtatatatgcaagtaattaatttggagggctgaatgagtgccactgttgattgctttacttaatgcagcgctcaatcgaaagcttggtcttttttttctgtagtgtgttttcttctttttatcttcgatgcttcatgttggctctacgcgaagatgcaggacgaaagcgctttctgccatcatgggaactttgtcgctacgctagcttgacagttcgatttacctcataactgatgagaattgctcgtccgagcggttgcccacgaagcggataaaagccgaggtagcggtcactggtcaagggcggtacgcccttccttataggcagtcgccaactcgccatcgccgtcggatcaagaagtggcgaggtcggcttgaagacggcaccgttgcacgttgcaggaacaatgcagaggaagaaccgaagagacgggggtagtgaagttatttgtcacacaggtttactgagttggcaagcaagagtggctaaataggaacaatatagtgggtcagatggcaaatagttaaagtcatttgagaagatggcatttgagaatacaccattcaagagaatggcaaatagtccaaaatcccgtgggaggttgtgcgcctagagcgcgtgcgttacaatggaaaacaaataaagtttgtaacttattaaatcaattaataatcacttgtttagtctaactaatactatatttttttattgaacaagtaggtgatattgaaatttagagaaccaatagagaaataggaaagaccttggtaaaagttggtgtaataatatagattgtagggcccaaatttagtgataggggtggtgtgggaccaccaccaccaccaccactattattattattattattattattgactttgtattttacatttcaattttatgcttcccaactcccatgcttgtaaactgtccatatcctaaaagaaattctctaaaatttaatcttagaacacatttcgaaggaaactttttaacttcgtcgcagaagttaattcattcatttataccctgaaatagctgtcacaaaattacataatctatcaatttgttggcaccagtacccgtagtggcatccacagacgtgccaccaaaggggatagatgttgtcaaacgatcacctgggagggacctcatcacagtgaacatgcacaggtttgtcctaggctcgataagccagttaggacgccatcaaaagtcgcagatacgagagacaatgagtaatctggaaattggtgggtgaatatatgtaaattggtgggtgaatatatgtaagatacaggacgcaataaggaagggcaggtgattggttgatttttcaatcgacattggccactatatttaagaggggtggtcttacgtctataggatcttctccacggttctattagtcttagagaaagaaccctcgtaccaagcatggaaacacgagaaataccaaaattgatcagactcgcggttgcatgacggtcttaggtatactaagactgagttcgtttgtagagcttctaacttttctctctcgttttccgcacgcacacttttcaaactgctaaaaggtatgtttttcgaaaaaaaatttataggaaagttattttaaaaaattatattaatcaatttttcaagttaattttagctaataattaattaatcatgtgctaatgtgcctcttagttcttcgtgctggaagggaaggttcccaaccaccacaaactaacacagcctaaggtcagttcatattaagctgctagacagtccggcattataacaccggtttatccagttgtagtcatctccaaaggattttgcaaccctttgtctcttactcttacgagtatctacaatgttttcctgctcaggatttccctcaggcgtttgatcattgtgttctatcggtgcaaagtgctcatagggtatgacagtttcttgactagaagtgctatgtgtatttttcatgtgaaattcattctcaaagaatgtagcatctctggactcaataattgtaccaacatgcatgtcgggtactccagagtttactattaagaatctataacccacgctgtgaatagcacaaccaaggaacactcaatcaacagtattcggtccaagtttacgctttttggctatagatacatttaccttggccaaacagccccatgttcgtaggtatgagagatttaatttcttcctttcccattcctcgaatggggttacttccttatgcttcattggaattttattcaggacatgacacgcaatcaaaactgcctcaccccaccattccttggaaagtcccgcagtgtctaacatggcattcaccatctcagttagagtacggttctttctttcggctaacccatttgattggggtgaatagggaggcgtcctctcatgaataattccaaactcttcgcaaaaagatgtaaactcattggaaaaatactccccacctctatcagacctcaaccgtttgatttgcctttcaatttggttttctacctcaactttataggtcttaaagtaatgcaatgcttcatcctttgttttcaatagatacacataacaaaatctagtgcaatcatctatcagtgtcatgaaatat

SEQ ID NO: 27516 - DNA, 15531 bp, Oryza sativa
tattattataacacatgtcagccaaaggaaagcggaacaagcctctgctgtcataaccttttccaataaaagttgcaaatttagataggacatattaattggattcaaacacaagtctaaaaccttctctacatagtagagacgctaactagattcttctttattaaagggacatgttgcacgttcttcagctgcacggtctttcccgaagtaaacttcagatcgaccgtaccaacaccatgaacagccgcaagtgacccgtttaccatcaacaaggaggaacttctcccgacctgataagaagaaaatagggaaatatcagcacatacatgaatattagcaccagtatcaacccaccaatcaggtgaatgaaaaacagagagaactgtaggtaataatttaccgtaccccgatgttcctccgccctcgctaatgactgtcagggctatggataccacatacctaatagtagttgactaaatctcagcaggacccaccacataccatgtcctatacggaaacaacctgcagatataggaggagttccggataaggaaagacaaccagagttctacatgggaacgacaaggactactcggattgtatccatattggtttccctagttctacttggacaaggggacacccatgggtataaatacaaggccccctaggaggagagaggacacgatcacaatcaacacccaccacaatcaacatacacggaacaatagatcaagacacaagatccacatacaagccaacatacgcctaaacaagacgccggatatcgacttcagagatagacacggctagtcccctacggtttctccggatactgataagagagacattgcgctgtctctgatctcactgggcacgaactcgaggagaaggactaccctgttgtcgactacgagtcagtccttcagaccgccatggcgacaacagttagataggttaccccaaatattgtactggtgtgattatggtgaataagagcaataccagcttcggccaacaggatgtagggttattacctgacaattcaggggcccaaacctgtataaaaatcctcgtctccatctcttttacctcagtctcgtctcgtgtataccctggtaccaacgatccccatactatgcaaataccagaatcgcgacatcaaacgtcgacaatgaccatgttggcagacttcctgtctttgcgctcaggacagtccttggcccaatgtccagacttgccacacacaaagcagtctccctttgcctttcccttgcctttcttcttaaaattggttgtagccttgggtttgacatcaggcttgactttcttgttgttgtgaaatgcatgagggttcttcttctataccatattggcactagaacctccctcaaccattttgccccggttgtcctttgccctcgccttctcttcaacacccaaagagccaatgagatcagaaacactgaactcttttctcttgtgctttagagaagtagcaaagttcgaccaagaaggtggccatttggcaataatgctaccctccacaaacttgtccggcaactcacagttgttgttctcaagttctttagccagcatctaaatctcatgagcttgttctactacagaacggtcatcgaccatcttgtagtcatagaactgctccataacatacagctcactgccggcgtcgcaaactccgaacttggcctcaagtacatcccacatgtccttccctgaaggcatgtgcatatacacgtccactatattgtcagcgagtacactaatcaatgctccacagaacaggcaatccgaagcctcgaacttaacctcttcctcaggagagagaggtggttcacttcatttgccccatgaaacatagaaacattgcatcgctgtcaaccacagaggtgcatgtgctttccacctcttataattagaaccatcaaaagcatgtggtttcgtacagtagtaaagccaactaacgaaaatgacccatcaggtttttggattgttggaaatatagtcatatatcagcatattttaatccaaaatattaagacaataatcatggcatgaacaatgtgaggtgatctagtgataaaatcaaacataaccagaagcatgcttaggatataataagcatcatcatcatacatcgaacgcaatagaattgcgactaataaagatatcaaaaaccgaaataacagtaagggtagaaggttataccctgtgaatgtccctccgctggattgtgaggcagaaatgcctccattggtgttgtcgttcgcagcgccagatccagctcccggcgcgccatctctaggttcggcagcggcggcagacatggtacggacgtacggtcgaagacgaggagcagtcgtgcggaagcactccccaaaaacctgatgacccgcctacccggtgcaaatctcaggcgaaggtgtggttccggaggccctgctcgctccgatctctcgtgcgcgcaagcaatcagaagcggggaagcagaacagtagcgtgcaaagtaaccgagcagatctgatcgggttgcctctttccttatagcgcaggagagatatccgcccgttgccgtagtaacgacgcgagatcaatgggtattgaatcgcctgcccgttacggaggcaatctcggggttggtccgttgcaaaaggatacagagaggcgcaacgcaatgcaatgcacgcacgcccgcctcgcccacgcccccggcccggcgcgcgcgcgcgtgtggctttccaatccccacctcaaccggtcaacagggagcctccaataactccctatttaagttgagatactcctcatttaattcccagggtggtattattatccttaacatttattatgggctgcccatttattctaacaagagagagcaagccaagggcacaaatgattgcaaatggaaccagcagccctcacaagtgaggggaggtgggtatttatacccacatcacaaatctgcccgttggtgtgcaataaaagtgatttttggaactttcgacaaacatttttggaacttccaaaaattccagatcttagaaataatcgaagtcaacgcattttcagagcttccgaaaatttccagaacgccaaaaattgttctgtgtattttcggaacttccgaaaattatttttggaacatccaaaaatttacagaacactccaataagagaaatgcttccaagaaaattagattttgagcacccgcatcactccttatatgtctatgcatcattccccttaatagtacagctttccaacgacacaatgcaaggtacaagatacaatataccatttgatcattgccgtattacatcgtgatgtcgcattcacggggtatgcatcacattacaacatgttgaggacataacaaccttcacatttgcttgaataaaaatgttagtcctctctaatcgcattgtaatcaatcatcaaaatcaataggagcctagatacactttcactcactatatgggatgggataaattatcccgacatgttggagtttcacgacatccctcgtggaattatttagtcctcgttgcagctctcaagagggcgcacaagaaggatctagaagaatacgatgagtacagagcattgtactaatccgcttatggtcttgaagtgagtagcttagaacatagcgatgcttttctaacacggctgtgagcttggaggtcttgtcatcggaaagcttgtcgcttatgataacgggcgattccgtaccatcgtgcaagtaggcatagagaaggcttaaagggctcaaccaaaggttgtgaaggcagatcggttttgggtaactcgatcacctctctaggatcgtcctcctccttgacgaatgcactggcatcatcttttaggagggattcggggaactcaaatgaagagatagccaacacttcctcaattggcttggaatcgggaatgagttctgccaaagaattttttgatcgaaagatcaggacagaaaatgccattttcccaagtttgatgttgaggactccggtatgcggagcatcaaggagaagtttctctatgggatgacctatgagaagtggaagtcagggacttcaaaaacatggaagtctagaatagcctcgacatcattgtgtcagatcagcaccctgcgcagaatctcataaccttcgataataggaccaaatgggctccgggaagttctgtctcttggagccaacagttcgtctcctaagcaatttaatgcaaaggttgcaaacataatatttgcatgaatagtgggattataaagattttgcaccatggcctctctcatgagacatggaatatttaaggacgaggagctaatctgagttacttcagaagaaagctccacctaccttaatcactcatcactcatgatggtagttaattcctgcaccatctctttgaagagattctcctcgagtagtgcaggataagtacgtgggactggtggtctcttttggcaggaattgtttgaggtgtgtccataatcttcaaaaagatcaccctcaaataagaacagggattccaaaggctgaattttttctaccttcggttcctgaggttccggtaaggattcaacgatcgaaacatgggatgtggaggttgtattctctgattcggccatcgatggttcctcatgtgtatcctcgatttccaggatggtttcgcaatgaacgaaggaagtgttctctatgatatgatccaagaggtccctaccttctgacattgtaccatcctgaagttttaattaatcaacttaagtggaaatcggggtatgtccttagtaaaagttggaagttttaaagctatttgggttcaaaacctcatgcggttaatttgtgtataaaaaacatgggtagaaattgaaaccattttcccaaactgttggtttgagttattaagaaactttagtgatcattataggtagactaatgaccctacaaccttttgctagataaacaaaaactttttttaatgactcatccatcgttcagagagtgttttggtgctaataaaatctaccaacagtttcgaggagtagctagactaatttttgttttcccttccacaaggggaacaatgtttctagagaccaaactgactgaatactagataatccatgaagctctagtgtttggtctggtgtttggtgtcttcttttagcttctaagctttgtccaagcctctatgtatataaccaaattaaatggtcaagcggtagttaagaaacgttgtagtatagttgttaatctttcgctctttggataatctacctgaccatgcttcgcaattggctagtagaattagtaacaagtgattgtgtgcttgtgtacttgtttgtaatgatttttatgtcgttcataattggttgatacatgttaaataaacatagagactttatataacaaatctaagcaacataaaatccatgaagatcctcatgtcacttagacaacctaagatgaccactatgaaggtttcataattttatcattctttttactacctcaaatatatcagtcaaatatagtcacacttagttaatagaaacctaattggcaaaatgaagcaacttctaaatgtgcctaaagttgaactgaaggatataggttttataatttattcaaatactagattatttattatgagttaatataatttttctagaatttttacactcagttttgacctcattaaaattcaatttagttctcagcataccccatttcacctttttgccagaattaaaatatttcaaatttttgagtgaaactttgaaaaatggaaactacgtaactcaatctatctccatgccagaacacacatttttgactctcttttagctaggacaaactagttacccaagaaggagagaaggaaaattcttgaaaactcactattttcaatgtgtatgtaaggttctaaccttcctttatctgtcccatgacccagctcaacttggccccacctttcactgacctaggctctccaccaagccccatcccacctccaggtcgtccacccacctcaggtccataagactagcaagaaaccctttcatcttcttccttttttctttctcccttgcttgttcttttctttcttgcaagctgagctcccagttcacttctttccatcaaatctcctccaaacacttgagatccatccctgcatgtcacaccacagcaatctcaagtatccaagcctcccatccatccaaatatcttgcacatgcatgggttcgtgagggagatcgggaagaaaataggtggagcttgctgctggttgcagcaacaaaacaacaaccatgtttttcctccacttggtgagtttccttcccatccattgtgtccctcttgtgagtgccattgtgttgagcctccctacctctctccacaggtcattgatgcaagattttagagcatagaacagttgcaactcgtttctctccactccgaccattacaacccccatccccctcagtttactcaggttgctatcaccattttttttcttcttcatcgatttgttcttgtgctatggctgtttgtgctccaaccttcgcaaccacagtacctgaccacctgcattttaaagtatatgcatgcatggagtgtaacagcaacctttggacctttatgagttgccattggaagcaagttgctacctttcagcatcataagttcttaggccagctagaaacttcatgttacgacttaatccctcatagactaaccagcaccttgtaaaaattgtatttacaaaaccaatagctgagctaaatcatgccttcttcattttcctcaatcactgagcatttgtaaagtaaactttcgaatcaaatcttgggcacaagggctgcaggcagcagttttctttttctcactctctaggtttcatatatacctactatcttgttcaaactccaaattaaataatcgaatactattcctatcaccagtaaattatactcttttgtatggagcaagtttcacccatgaaaatttgctagaatatgtggggatcaccaaatgacccatagtttatattcagttttggcataggaccattttcagcatttgtggctcgtcacttttatatctccagaatcatggcagcaaatagggtcattcttttcacccatgttcttcttgaaaatgtgacatgtccactgtgtttaccccgtgttctgtagagcatgttgcatatgcatgtttattcgaatcttatttgcatatttgcctcttatcgatagattcggagaattcggagtatgtggagcaagactctgaggttgagtgtgtttccacgcagcagcaaggcaagcacctaagcatatagaacctatgctttctctaaaaatgatttggttgcaatctatatgtatatatatatatatatatatatatatatatatatatatgcatgtattgcctagatattaatattgtcggtttatggtgtatgggtagaacctattaatgcatttagttcttgtgatatcgttgtcttataccctattaccactggttgggattacttgggatgtcttattcattaatgcttagccatgcttagtgctaatagaactatagggatagacagtgcttaatagtggtatatagacaacttgcattattgggcataaaacttgagcacttacactaaataatggttgatgaaatatgttggacttggacgggtgatagggcgatgatgggaggttggtttcccctgatgcaagtagccccatctaggtcgttaaggaccgaacattttgacatctaatcaagcaccctatgtacttaccacatgccttatttgggaccggcttgttcttactagttctactgtgatcatttatactacgttggagagtcgtgaggcaggtagcctttggaggttctcgggtgcctaggtttggccgggggtgcctcccgcgtggcgcgcccgccttggtcacatcatgcacgcacgtgactgagtcgtcgggaaccccagcgtagtataggtggttggggtggggctaagaaagggcatgtaatgagcttgaatcacttatgtaccgcactcgacggggtgtgtagcatttgatatttgttcatttcgtgtgggtccagttgtacacctttgatcagagtataatctattcgaatagccgcgtcctcggttatgaacaatgcttgatgtgttagtcacttatgttagaatcaaatgtggattattatggatgggattatgtttgatggtggtgttggcatgttgtgccatgttggtatggactttggtagtccatggttgatgatgagagcgccgtttgggctcatttgcttatatatttcagaattatatacttgctgtccataaattaaaatgatgctagagttacttgtccttacttattttactcattaatttctcaataaaattagctttatgcaaacgttgaacctagagacccactataggctagaaagcttgcatacttctctctcccttatgtatatataattttgggtaagacttgcgagtacaatcttgtacttaacccggtgtctgcaatttcaggagaggattccggttatgagttatgcttcttgtgtggtcattgctctgctgagggtggcgagggcaatgagtgatctcttgcagcttggctcttgcccggttggtttgccctagtggggttgtggcaccaccgattttatcttttgcctatgaactctaattgagacttctgctgctatatttatgtgttgtatgttgggatcttggaccctattatgtgtcatgtacctgctgcactttaaccctattatggtacttgctatgtttattaattgcttgcgatgaaagtgtgaggctagtcgcattcctacggactagctaagcatgagtaacgggttttgatcgcttgagataatcggggatagtgccttggatcgagtcactggggtatgcttttggtcgccaccttcgagtggttgacggacatatgacggagtagactggcaagctatcttatgattatctcttgtgttcactacttggcattccagttattataacagaaggttgtcaaccgcgatcatggacacattgaggatgagtggctatttatgcgtgtatggatcccacttctccaatagtatgtggtgttcgcgttggacactggatggtataatactcggggtgtccacagacatcgttttgtgtgcgcacgaacctacagcagaagtatcgagatacatggcagacatcttgtctaaacccgagtggaagtgttgtaacaacacatgatcggtaaagaaaagtctgtgtcgtcttgagttaacaaggagaaacgagcataggctgcaccaatggattctttcgcgtgaacctccacgtagagagactacacgggttaacaggaagaaagcaaggcataatatgctttttaatttgtcccatcaatatgcagttttctcatggtatgagtataccattgcttcgccccctctgtaagagagaagtgaaacaatttccactttaaggtttcttatgtcatgtccgttattgtcaggcataagcacaattgctcaaactcacgcaaatgatggtagggattttcgctttcacatcctgagaaggattattcccgaaccatggctcttaagctaggacggagttcataccagatgaacagatatgtttgaagaaaaaggtggctcacagaactcggtccttggagcataaaggttttgaatagaaaggtgctccgtgctaggtaagaagagaaaggaaggacaacaaagaaaagatatgaggatgaatcaggtttgaagatgatatagcaaccgttccatggcaacagcgtcagaaatgcttgttagtatttgatatagtaaaataaaaatcggaagcgcacagataccgctgtagcacttcaacttagagtattccaaaggtatcaaatcatagggattgtgtgcatatctaataataggattctatccaaggacagcacctaatggtaggctaaggctaaagaagattcttacgggttaatgtactatacttgagttaaaggtaaaactctatcaattgctttgagcactagcactctcctggtttgacaaactgagtcaatgtacgtaaacatggagggatataaaagatggacaaggttgtcaccacctgccgcatacctcactttgcatggagcacacaacaaataaaggaaaccactaacctagacaccgcgcctaagttattgataattactctagcctcgcgcagaaacttcattctttactcagagtcctaatactagagcacataataattgaactaagcgacgaacccgtaacgatgtaactatatctcactcaagcaaataattaaatactatatggagatctcaaatacttactttattaaaacaagcattcgctgaggtcaagcaacagaagaaggctgacaactccaatgcttctccggaactcgagtggaagaatgtcaacaaacctgacactccttctgaacttcccaaagagaactccgatatttgggggcatttcttccagagcttcccatcactttctacctaattccacatactaaggtgatgccttaaaatatggatgtgagttatactccacttaagtcttgtattggaaatgagagtttcttgtccttttatagtgtgctatgaaggttaccaacataaccaccactaggagtgcatctggagcctacataaggaaggtcaggatgggaggtggcagtgaagattcggctgagcccctagtttggccaaactgtgggccccacttccgagctgcttcttcggctaggaggccgactggcgggtccctatattagtgcatcgtggataagcccattttatatcggttttgactgtcatgtggaccctccaatcctagcgctcgtgtacgattggtcggagatgcatttcgtcgcaagacgggtgtgttttcatttagaaatcacctgcatactcatatttaccaatacgagtgataatggttagtagtaaacccctacaagtaagtttgatgatatattttatattcttttatatagcagttgatggttaaagtttacacttaacgaccgtcaaccgttagcaccgtaagaattaggagcgtcgctatcgctaactcttcttttcttctgaaaatgaagatgaagatgaagattaagttttttacacaaaacgaggtggtattaacgtatgattgattgagttttaattattacaaacttgaaaaatagattaatatgatattttagagcaacttttatatagaaagttttcgcacgaaacgcaccgtttagcagtttgaaacgcgtaccacgaaaatcttaattttcatccaactcttgttggagaaaagaacaggacctaatgtgtgtctatatatgtatgtctggaataccatggtccttgttcatccgtgcaacagcttgaaaagttaaattttcctgacttttaattatttttcaaaaatactaaattaaggcgcatggtgttacaagtactatgcatcagttatctcataatagaattccaccacatgtccctttcttgcttatagttaagcacctaattaaactcttgtttgtgtgttctatattaatactccatagatgtctatggtattcccttcccaattcaattcttttagtttgtgttgctatctgtaagtttttgtttaactatgtgcttggatactgaaagattgtagtagtcccttgctagttgctagatatcactactatgtttaagacacagcaaaataaaccaccgtttgcatagtgtttagctccgccatgtaccctacaaaaaaaaggagaaaagtgagagatcaattcatcttaaggatttaaatggtagataaattctatcagcaagtcaacacagagtactcaatctctttatgcaacagcaaccttaaaattcttttagtgatataaagatgtactttttgcaatagttcacaacacaagtacacaatgcaaagattatcatgagcatattctttacatactttagaaaccaatgttcattgcaccatcataatttgcctcattgaatatttgagacaacagtttgcaaaaacttgaaagaaccaattgatagtctcaattgtttcaggcgtgttaatcatggttagtacaggaaaatgagaggactgaatataagagtaaaaattggtagacagaaacagtttcttctttgtgaacttcaatttatcagcaaagatttaaacaattgcgactccacctaattcttgaaatccttatgttaatggacttgcagccaaatcatactttcgattttccttttattcctgatgtgatcctctatatcttttgatagtacaaatgagacgcaaaaacatttttccagtcagccaaagcccaaatgttagcaatgcgaggttaaagattggtgctgattctggttaggagatatactataccagtaccaaataagaaacacttaatcaccacaactcttttttatgtacaatagaaaaggtattcaaaagttgagtaaatttcacttcgggccaccttttgttacctatgtttcactttggaccaccatttaagcaatatttttactttggactgggtaaacttacatttgtttcactttggaccacccaactctcttctcaagcatatgaacgatctcgattacgccgtctcctactcgtcaatgaactgccacagctatatgtaagactatttcttcgacatattacaagttggatgtagatggataaaagagtgagggtggtccaatgtgaaacaaaggtaaaaatatccggtccaaagtgaaaacattggtcctaaggtggtccaaagcgaaacatcggtaataaaaagtggcccaaagtaaaacgagaatcctaacgagcgatcaagcgctccgggcgatcaatcccccctccctccactttccttttttgacaccgcattactttcatattttagaaaatttatgcaccaaaagtttacacacctaaagtttacacatctaaagtttatacacttaaatattacagatccaaagtttataagtcaaaagtttatatatccgattcaaatttaaatttgaattcaaatattttttctatatagtatttttatacatctaaagtttatacacctaaagtttatagacccaaagtttataagtcaaaagtttatatacccgattcaaatttgaatttaaattcaaatattaatttgaatttgaattcaatttttttatatatagtatttgtatacacctaaagtttatagtcccaaagtttataagtcaaaagtttatatacccgattcaaatttgaatttaaatttaaatttaaatttttttatatatagtatttctatatacctaaagttactttagacccaaagtttataagtaaaaagtttatatatccaatttaaatttaaatttgaattcaaatattttttatatatagtatttttatacataaaattttctaactttgttttttttattattttaaaatttatggtgtagtaggaagaaaagaaggggagaaggaagggggagaggacgtatagggggatggggggtgatcgctggccgcccattagcgtcgcccaaagtaaaattaactctcaaaagtttaaagctggtttgtgatagatgctcgatttgtccgtgatttgtccatgattagtggcagaatctcaccacacccgccgggttttcgagcgtctcttgttacctctgcaacatcgtctctcttttcgtagcatccgtcagatgcattttgctggcaggcggacggatccgcttggctacaggcctgcagccaccacaagacatgggattcgacctcctctgttatacccttggtgcatatgatcgatgtttcttcgtgggggccttttgcttcaacaacagacagaatgtaacaagtgcttgattcgttcaagctgatccaacttggtctacagcctgatgtgaactgttccaacacaacaaaggatattgggaatgccaacttcaaaagcaacagcaatttagattcttatgatttgttgtatgcaggaccaatatatattactgaaagcattacagagacagagcgaacaagtaactttggttttagcaatggaatttgtgggattctctcctatcactagattatgctccttttgaagttttgaaactaaaccaagtgttgaacagagagaacagaatgaagtctctgaaatttacataattcgtacctggagttggcatatgccagcacggaattgtagagcatacaaagattgccaaattggcgattagaccgagcctggaatctgcaagactaagaacagagaaaaatcctgaaagcaaacaagtatataggtgaaacaaggaaacctcggtttagactttagagtgacttgagtgtgcaacgaaatcatccctagcttcctcagatataaatggtgactaaagggacaagttgttcacaattcgtggtatctaatctaagttagtgatcccagaaagctttactaatcctttaaaaaaaactaagctttactaaccctttctccaaaaaagagagagagagagagagagagaaaagctaaactatttttttatgataccatcaagtaatgaagtggctattttttcttatctatcaaaccctttttgaggccactagaccaacgcccaatagcaaaagaaattaatattttcatttcttacttaagataaagtcactgtattttatttaatgaatccgaaccactaagaaacaagataaaaatcaaaactagagaggcaaacaaagtaaactttaatttgaagtaaattatactaaagttgtggttttatatattctgcaagttaagattatgcaatgtgcaagcttaggtgttaacaatcaagaaattttcaggtgacatgacaaatagcaaaagtgattcttagtacaaatcaaactagtttttccaaggccacaaattacaaatttaacattaataagtatatccaaaccccaaattgtcaaagaatcttcagtaaattccacgaaaagtataataatgtcattaaattccatgaaacagttaatcgtacttggactatggaagtattgaagtgatattaaattgtgaaattgttcacaataatatcacttcaatagttttgatcctcctccaatactacctggtgttcagtctagtataacttgccattgattattccaaataaattcagattactgcattagcacatatatagcagcaaatgttcaatttgtcaagcaggtgctcaaattgattaataacctccaaggtgacgttgtagcttctgattggtgctacagataataataaccaagtattcaagagcaatctttttaaaaaaaatttaccaacaatatcatgaattaccttgaaaacagataatcagtggtaactggcaagtaattt

SEQ ID NO: 27517 - DNA, 1060 bp, Oryza sativa
taaatgcttgcctttccaactactaagctttttctcaattctctcttcaatacgtttccaatctttattagaaagcttcctaaaatgcatcggaattccaaggtatttaaaaggaaaggtacctaactaacaaccaaaaatattagaatagtgttcataacattcctttgcctgaccaacgcaaaataattcactcttgtgaaaatttatttttaggccagataacttttcaaataccgataaaatcagtttcaaattctttgcctgttgcaagtcatgctccaaaaagataatagtatcatctgcgtattgcaagatagacacaccatcatcaacaagatgaggaataaccccattcaagagtcccgcctctttagccctcttaatcaatagagtaagcatgtcagctactatattaaaaagaataggggataaaggatccccttgcctaagttggtagcctgtactaccctctcagcctgtttcaccttgtgcaatttttttttaacgactcacacgagacgatgcgaagttttattgatagagaagggaaaaattataagattacaaccctgaagggtcgtaaccaggaaaaagaaaaaaaatataccaccacccacacaccgacatctccaacacacaagcccaggagaaggctagcaccggaccggccgtcactaagcgtgaccaatcgccactagaccaacaaagggacacatacgagatttaggagatgccaaaacgacgtcttcaagaagagaagcgacggaaatccgccgctgccgtccgttgggactcaaaggagacaagaccgggctttcgcccggtaatcacccttgaggggtgagacagcacgacaacgccctcaggagggggaacatcgttgtcggtccggccaaggccggactgggttttcacccgctgctcaccacctgcgaatccacggctgacgcaccgagggggcaccaccacacaagctttgccgacatgtgggacccctgcaccagaattccccggcggtcagtcttcgtgcgccgaaaaccgtgccacaaccaccggc

SEQ ID NO: 27518 - DNA, 1002 bp, Oryza sativa
  unsure (1)..(1002): unsure at all n locations
nnnnnnnnnnnnnnnnnnnnnnnnnnnnnnnnnnnnnnnnnnnnnaagaagaatctagttagcgtctctactatgtagagaaggttttagacttgtgtttgaatccaattaatatgtcctatctaaatttggaacttttattggaaaaggttatgacagcagaggcttgttccgcttttctttggatgacatgtgtaataataataatgttgtgaaccatattagcgagaatgatgagtccaatgtgtggcattcgcgactctgtcatgtgaatttcggttgtgtgacgcgcttggctaatatgagtttaattccaaaattcactttggtcaaaggttccaagtgctatgcttgtgttcaattgaaacaacctcgcaagcctctcaaggcatctgaggcgagagatttggcacctctagaacttgttcattccgatttgtgcgaaatgaatggcgttttgactaaagggggaaagaaatatttcatgacactgatagatgattgcactagattttgttatgtgtatctattgaaaacaaaggatgaagcattgcattactttaagacctataaagttgaggtagaaaaccaaattgaaaggcaaatcaaacggttgaggtctgatagaggtggggagtatttttccaatgagtttacatctttttgcgaagagtttggaattattcatgagaggacgcctccctattcaccccaatcaaatgggttagccgaaagaaagaaccgtactctaactgagatggtgaatgccatgttagacactgcgggactttccaaggaatggtggggtgaggcagttttgattgcgtgtcatgtcctgaataaaattccaatgaagcataaggaagtaaccccattcgaggaatgggaaaggaagaaattaaatctctcatacctacgaacatggggctgtttggccaaggtaaatgtatctatnnnnnnnnnnnnnnnnnnnnnnnnnnnnnnnnnnnnnnnnnnnnnnnn

SEQ ID NO: 27519 - DNA, 590 bp, Oryza sativa
  unsure (1)..(590): unsure at all n locations
ggcgaattcgagctcggtacccgaagtggtctttagtcccggtttacaacccctcctttagtcccgggttacaaaccgggacgcccaatccggaactaaagatggcagcaccacgtgttttgcgctaccatctttagtcccagttggtgttatcaaccgagactaaaggtttttttttcttttttttcattggtttttactgcttgcatattgatttcctcaaattgagttgctccctacatccccaagtcacatataacaccacatatcacagataacatcacaaattcacagatttacataataacatatcaaatacataaaaaaattcacagattcacatcatagatcaaatatgacagggttatggataccacatacctaatagtagttgactaaatctcggtaggatccaccacataccatgtcctatacggaaacaacctgtggatataggaggagttccggataaggaaagacaaccagagttctacatggaaacgacaaggactactcggattgtatccatattggtttnnnnnnnnnnnnnnnnnnnnnnnnnnnnnnnnnnnnnnnnnnnnnnnnnnnnn

SEQ ID NO: 27520 - DNA, 698 bp, Oryza sativa
cgagctcggtacccgattacaactaaatctgttcaaataggaactgaaaggaggagggaaaaaaacaaatataaatttcgcattcacctcgaaaagaacaagactttaacgtggacacaagcttgcaatccagctatccaggcaactccaagcagggcagtaaagctgatagccggaggcttggactcttctacagccagtcattccctacacgatttaaaaaataatttaataacctgaagggaaggaaacggacaaatatgcgtgtgcagcgtatccctatcgcctttatgatctctaccatggcgttagattcttaagcggacgattggtccatagcaaagttggtagtaactgcaaacgaagtaccgacgattccagcataaaatcctaagacgtactactaaggaactccgaactcgctataatctgtgccggctcatgaagcgacccggatgaggagggagggaaaggagaggctaacctgtaccttcaattcgactcaacccgagacggaggacgaccgccgcgcccctcaaaacctgctcgccggcggcgcgagcgaggatgccgaaaaggggggagaaggctagggcaagaggccgtacacgccgtgcctacggggcccgggaattaggggcagagggcgccgaggtctccccgcacgcgcggggcggtggaattggggaggaggcgaa

SEQ ID NO: 27521 - DNA, 613 bp, Oryza sativa
cccgtttttttgacaaattggtccttataaaaaactgttttcgaaactagtccataccaaaaactatatctagaaatatgccgttgggtcagcgccaacctttttagcgctgaggctggtcatattagcgccaatgggactggcgctgacatcgcgccagcataaacggcgagacacaacgtggcagggcctcagcgccaatgtatttggcgctgaccccttgtacaggctaattaaaaggatgcgcgcccattaataagcaatgcactcgtggtgcaatggtatgaccatttgcttgtgtaccctagcaccatggttcgactacctatcacggcaaccttgataaatctttttttttcttcaaattctccatacacttgggtacattaggacatataaatgattaatgatgctgtctgatttttaaaatatatatatataaatataaataatagaatatatgttctacagcggcgctggcctttataccggctaaataaaagcaaaagcaaaacaacagttaggtttggcttagctcagtggtaggtatttgaaaggtggcgttacagtgaccagggttcgaaccctctcctttatgtttttactaaacttg

SEQ ID NO: 27522 - DNA, 644 bp, Oryza sativa
  unsure (1)..(644): unsure at all n locations
agaactaagtaaaaaacaggtttagtaaaaccataaagaagagggttcgaaccttggtcactgtaacgccacctttcaaatacctaccactgagctaagccaaacctaattgttgcttttgcttttgcttttatttagccagtataaaggccagcgccgctgtagaacatatattctgatatttatatttatatatatatatttaaaaaacagagagcatcattaatcatttatatgtactaatgtacgcacgtagattgaagatttgaagaaaaaaaaagaacgaacaaggctgccgtgatagggagtcgaaccatggtgctagggtacacaagcaaatggtcataccattgcaccacaagtgcattgcttattaatggccgcgcatccttttaattagcctgtacaaggggtcagcgccaaatacattggcgctgaggccctgccacgtcgcgtctcgcccgccacgctggcgcgatgtcagcgccagtcccattggcgctgatatgaacaacctcagcgctaaagaggttggcgctgagccgacggcctatttctagatatagtttttggtggannnnnnnnnnnnnnnnnnnnnnnnnnnnnnnnnnnnnnnnnnnnnnnnnnnnnnnnnnnnnnnnnnn

SEQ ID NO: 27523 - DNA, 512 bp, Oryza sativa
  unsure (1)..(512): unsure at all n locations
nnnnnnnnnnnnnnnnnnnnnnnnnnnnnnnnnnnaccgagtcgaccaagatcggatgacttggattgatctggaaagcgagcctcacgacatacaaactcaacgagtcaattttacgtgacacaggatcacccaaatgatcaaccgaaaccggcaaacagaaccggcggctctgaactaaaggaccactcaacacggatgaacgaacgaacatggggaacaccttgttcgaacgaacgaacgaacgactcaacaacggctgcgacaaaaccggtgggctagacacgattcacggtaaagccccgatacggcaaatgataggccggttgaaacctagggttgcacctacggctagacaactcgactaccgagcaacgggctaaagcggtagctaggttaaagcggcacacagctgcgacacagcgacagtaaagcgactttgctcatctaggcggcggcggctcggcggaggcacgcggnnnnnnnnnnnnnnnnnnnnnnnnnnnnnnnnn

SEQ ID NO: 27524 - DNA, 266 bp, Oryza sativa
tcctccagtatccagtactcccacggaacaaaatgggtaatggagaaaaaataagtgcatatgcctatgtgtggtacatgtacaagctgttattagctgcacaaactatgaagttttccatcgggtgccaagctaaatgtgtcacctttgatgtcatgttacatttagtgtcctcccggccgtcagatcttggtccatcttgacctgcaggggaagagaatttgcagagcacacgctaaaagcttcagttctaaagtagaggcgtc

SEQ ID NO: 27525 - DNA, 807 bp, Oryza sativa
  unsure (1)..(807): unsure at all n locations
acaacgactgcattttcgacaggttcagctgctgctccagcaagggcggggactacttcgccactggatcttacaggtttctactgctgcaacacatcaacctcatatctggagtataaggctatactgtaagtgcccatccttatccatctcgtggttctttgtgttcagcaatacattcaaaattttctctcgtgctgctgcaaatcccaacggaactacgttggaagctagcacgaacccttacaggtacttagctttgttcttttactgtcgctttgacgctgccaaatgacttaaatttagcaaggctgatctaatacggtgaagaattcaggatacaatcattcccctctgcaaagagtcaagggttgctcagcaattttgctcgcggaatccagagaaaaggttcgaataattcatcaagttattcttttaatgtgtctttgtgcattctttcagtgacgcctctactttagaactgaagcttttagcgtgtgctctgcaaattctcttcccctgcaggtcaagatggaccaagatctgacggccgggaggacactaaatgtaacatgacatcaaaggtgacacatttagcttggcacccgatggaaaacttcatagtttgtgcagctaataacagcttgtacatgtaccacacataggcatatgcacttattttttctccattacccattttgttccgtgggagtactggatactggaggaaaatatagaggnnnnnnnnnnnnnnnnnnnnnnnnnnnnnnnnnnnnnnnnnnnnnnnnnnnnnnnnnnnnnnnnnnn

SEQ ID NO: 27526 - DNA, 233 bp, Oryza sativa
  unsure (1)..(233): unsure at all n locations
cctaaaatggagctcgcatgcatatttggcggccgtttgaagtcgacactgtagcaggtgaccgaactggattgcagaacttggacagcttgatcttgatgtgaacgacggttgtatctatagtagtcatggtcacatcattgtcctttgtgaccccccatgtactacctatgaagaatgttctgcgcaantcttgtggtcgatagtatttgctccgaaattaactattcctt

SEQ ID NO: 27527 - DNA, 595 bp, Oryza sativa
tttataattttacagggatgttttaggtctcactgttgactgtacaaacatactgttacataattatgtattattccctttcttgttaacattgttttgcatgtttttgtttgaaataaactcttccttttatcaggtgcaattgattatccatcatttcttacgctcctgaagcagctagttcctcccttatctgctcagctgtctgaccgacggtctagcatagtaaaacaggtatttgatttaacaccaattcttgaggggctgtcaaattagttcatccaaaaatatttcattttagaagtacatgtgtgttatggaattctgttagaaaaaaaagaattcttattgaatttgcaatgactgaacaaaccttggtgagaaaaaattgctgaccaagtttttttccaggcatgccatctacttaatatgctatcaaaagaactccttggtgattttgaagcatgtgctgaaatatttattaccgtcaccataaaagcaggttcaatgttttgcaacagtaagtcagtacttttatactttctcagtagggctaacatactgatcaaattatcaggtacttttcaagcttgtt

SEQ ID NO: 27528 - DNA, 1324 bp, Oryza sativa
agtatgtcctcacaaatggtggatttttcataccatccaaatcatggttggcatcttgttgactatcaccgccacagtctccagtattcctgaaagacaaatcagatgtatgattggcagatatctgccttgttgttcttttacttcttggaaagaagaaatctgaaactctacccctgaaaaatgatttttctttatttgatgcgacaatatgttttgttctttcatggccctgatgatttgaagttttcacatttgccaccatgttattaagcgtggatggaatcagaggaacagatgttgatcttggcaaccccataggtctctcaccatttttttcatctttcctacaagcagttgcatatttagcttgagtaggtagttcattttctctgtcataacagcgactggtagaaacagaaggtaactcattgatgaaattatcattcttcacatcctgaagggagagcatctctcctaaggtgcatgtgctccttggcaattctacttgctcttgactgatctcatcacaagttacagttgcccatcgctctgaaagccgttgcttggcttccttagtaactgatgactcagcaaagtgggagatcttgctaaaagacgatcccagatagggatttccatgttttttggtataatgccatgttcgctttgacacaggactacatccccctgagtcactgaagctgtcaccttcatcttcaatatagtcaatatcagaatcactgttctgatcaatttctgaatcacctaatgaactttcatctcctccatatccatttgagtatgaggaagataaaaaagattcatctccttgatgacagccatcttgctggttatgaatgataccaggctctacttttgtagatcgtagggttgccccattgccatccaatgctaccctgaaatcactggggttaattgatagaaatggagttgtcctgggggttagctttgcatttgttaaactcggcttccctggagtaggcctcaggagtactattctacttggcaaggagggattttcttccttaaaattagaactctgatggaactctctcattgctgctccattttgctcttgaatttgctcagttccagtttgtcttgtgccatcactctcaaaagaaccaagtggctttagtaccgtaatccgttttttctgagggggtgctagattggtgtgagaccctaccaactgtcttgagaaaattgagttaggttcttcaagaaatttcagaaacaaatctttgtttgaacctaccaccctaagagctttttgtaagttcctttgaatgaagcggct

SEQ ID NO: 27529 - DNA, 460 bp, Oryza sativa
  unsure (1)..(460): unsure at all n locations
nnnnnnnnnnnnnnnnnnnnnnnnnnnnnnnnnnnnnnnnnnnnnnnnnnnnnnnnnnnnnntgacataaacagtgtacaaaaaaaggggagaaattcatcagttgtaacttgcaaagacatatcatcgttgacaggcaggaacaaaatccagcacagcttctcccacgagctcctcccagactccaccctcaatttgctcggtaatgtcaaccaactgcgtcctcatcgttttcacccagcctgttccttcaacctcctgcttcacaactctctctatcatgatcccagcattatctctcctgctcaccacgaacatccgtgccccgtaaatccaatctttcaggatgctccagacttctatccccaatgcaggagaggaggcgtccatccatgttcttgagtgtgctttgctccatgggaatgtactnnnnnnnnnnnnnnnnnnnnnnnnnnnnnnn

SEQ ID NO: 27530 - DNA, 810 bp, Oryza sativa
  unsure (1)..(810): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtataaaaggaggaccttgcccatagagaaggggttgattctggccagatttagagcttagagcgggggagaagtgggctcacactttgtagctcattcatacacaaatccacaaaaacacaggagtagggtattacgcttcgcagcggcccgaacctgtatacatcgccgtgtctcgtgtgtcttgccggggagtaatctttccacatacagttaaatttttgagagagagcttgagattgcaccctaagcccccggccgaaccggcaaaggggggcctgcgcggtctcccggtgaggagcctcgagctccgtcagcttgtttcttcgatttgcttgcaggaataaggttgatttgcaccggcaagatcaacaacccacggagaggtgtatcgatcgctaaggcgcaacacaacgtctcgtacggttgtagtcggatcgttaacgtttctcccaaatcgtagttatcacaactctcatcatgatagaccccccagcagccttgagtgttgaaaagtactcagggttcatccagtggtatcacatcttgcgctgttcggtgagtttttatcatcctatacctagacaatagccatccaannnnnnnnnnnnnnnnnnnnnnnnnnnnnnnnnnnnnnnnnnnnnnnnnnnnnnn

SEQ ID NO: 27531 - DNA, 747 bp, Oryza sativa
  unsure (1)..(747): unsure at all n locations
nnnnnnnnnnnnnnnnnnnnnnnnnnnnnnnnnnnnnnnnnnnnnnnnnnnnnnnnnnnnnnnnnntaacttagaccaaatttatagaaaaatgcacccacatctataatatcaaaatagttgaattaaattcaccataaattatgtcttgataatgtatttatttggtattgtagatgttaaatatttttctataaacttggttaagtttatcggaaccaacatatacgctgtaaagtgcatgagaacataatctatcatgacctttcactctatacttatacaataactttttgcttgggcgggtgttatgttaagttggttatgacatacttattgccaaaagtttattattggaatagttatttatgaaaaaagaggtatatcagatgttctaaatttcatgctgcatataagttcaattgtttatcataaagcaaagttgattctgacatacttattgccacaacatcatatcgtttgatccttttctttgacgaaaacacatcatttgatcttatatctgcaaaacacttgaaattggacgtgcaaatttcatgccacatactagttcaattatttatagtgtaatgtgtaagatcatatttttttaattaaaactaacatgcatttaaagcattgtagttcagagcattttgtgattcaattataaaattatactatatgggttcctcttgcttctaacaatgcccctccccttatttgggtgatctacagatgtgtgga

SEQ ID NO: 27532 - DNA, 733 bp, Oryza sativa
  unsure (1)..(733): unsure at all n locations
nnnnnnnnnnnnnnnnnnnnnnnnnnnnnnnnnnnnnnnnnnnnnnnnnnnnnnnatttcaattgccttattcaaaattttccacttatcgggaacacctttgcatattttctacttactccattattaaatcgctgtaacatatgcattattccccaccatccataggcacatcgtcgtttttaaacttctctgtacccatgacggggcatacgatctgtctgctttacgattctagcttctctttaagctaaattactttatatttacaactttcttttagagaatttttctatttactttcatgttccctagctggaatcctattttgtgctgatttccactgcattccgtcctactatatgtaaagcggaatatgtctgtctagagctctagggttcttttttatgtcttgggccaccaatgaattgattacgcatatatgtatgtgtagattcttgagtacatccagaagagtgtagagatgctcacaaatgtaatggattccttttggctttggctctaagattgtagtaaaagagaatccattatattacatgcgggatagagataaattaactcgatcatcaacataggataaagaggcgcaaatataccgttttatattaaagccaaaacataacctaccaaaattttggtgacttaagtggtaaaataaaggaaaaactaaggagttatttagtatggaaatcctacagcgaaaaaaaaacta

SEQ ID NO: 27533 - DNA, 432 bp, Oryza sativa
  unsure (1)..(432): unsure at all n locations
nnnnnnnnnnnnnnnnnnnnnnnnnnnnnnnnnnnnnnnnnnnnnnnnnnnnnnnnnnnnnnnnnnntgccaagctaaatgtgtcacctttgatgtcatgttacatttagtgtcctcccggccgtcagatcttggtccatcttgacctgcaggggaagagaatttgcagagcacacgctaaaagcttcagttctaaagtagaggcgtcactgaaagaatgcacaaagacacattaaaagaataacttgatgaattattcgaaccttttctctggattccgcgagcaaaattgctgagcaacccttgactctttgcagaggggaatgattgtatcctgaattcttcaccgtattagatcagccttgctaaatttaagtcatttggcagcgtcaaagcgacagtaaaagaacaaagctaagtacctgtaagggt

SEQ ID NO: 27534 - DNA, 586 bp, Oryza sativa
  unsure (1)..(586): unsure at all n locations
ttgtttagcacttttaaacttagcatgccggttttgcattgagacaagcaaacttctagtcntgatgcatccttttgagccttcgtttgcttcatatgcctagatttacacaacctacataatttattggtgttgtagatcccagatgtactagctatccttgacaaaaatctgatattactttattcagtgttatgttcttatgtagagtcacttctgttatttcagttgacatggatttgtgcccatcttttgtgcaggttatacgcaaaagaataatcgagaaaggacttagagttgatggcaggcaacttgatgaagttaggccactctactgtgaatccagcacatatccaatattgcatggatctgccctgttttcacgtggggatacacaggttctctcgcacacactttaaattgaaggaacattgcaacatttgttttccagtaaagtgaccacccacatggactactttatttgtaggttttatgtacagttacccttggtgctcctggtgatgctcagcgattggattcaattgttggtcctccaacaaagcgtttcatgcttcactacagcttt

SEQ ID NO: 27535 - DNA, 672 bp, Oryza sativa
  unsure (1)..(672): unsure at all n locations
nnnnnnnnnnnnnnnnnnnnnnnnnnnnnnnnnnnnnnnnnnnnnnnnnnnnnnnnnnnnnnnnttcctcaaggcacagactaccaaacatgttcactcttggttgtgtgaagtttgatcaactgcaggcatttatacagactaccatagaaagtcataggtatgtctggcaaacttgcccaaaatcatgctagctccaaaactttggcacctatttgtaaggttgccaaaattttgcaagcacatgtttgttcgttcattgtgcatttttcttgcaaatcgtaggcgaaatatagttagacacaactacaaaattatccaacacaggctattaacatcgaatttccagcccatgaactcactcccaggtccactactctctccggcccattagggtttgctccgcgagcatctgacaacgcccgagcctataaaatgcgtccacccccctccaccgaaggataccatcgccgccgcagaagccttcagtgttcgatccttcgtttctcttttcgtttttgctcgtctcgtctgtgttcgattcgtttgtttttggatttgtggtgaatctggtgattgtgttcgtgcttcgtcatctggtcattgggaggattagtctctaatcggttcccaatcgactcgttcccttgaagcaaaatcggcctgttgtat

SEQ ID NO: 27536 - DNA, 1494 bp, Oryza sativa
cgactccctcgtcgacaacggcaacaacaactacctgatcaccacggcgcgcgccgacgcgccgccgtacggcatcgactacccgacgcaccaggccacgggccggttctccaacgggctcaacatccccgacattatcagtgcgtagtactttaactcctgcatatttcagaaacagtgtgtcgacacgttttgccgaagagctgacgaccatgggcgttttcttcaggcgagcatcttggggccgagcctgcattgccgtacctgagccctgagctccgaggggacaagctgctcgtcggcgcgaacttcgcgtcggccggcgtcgggatcctgaatgacaccggggtgcaattcgtacgataaaaaatgctcaattcatttcacttcaattcacggccgtcattgtgtttccgtgtttcttctcaagattttcatgtgcaaccatgtgggtgtttgtgcgtgaacacaggtgaacataatcaggatcggcgatcagctgcagtacttccgggagtaccagcgcaagctaagggctctggtcggcgaggagcaggcgaagcggatcgtgaatggtgctctggtgctcatcacgctgggaggcaacgacttcgtgaacaactactacctcgtgcccatgtccgtgcggtcgcgccagtacgccatccaggactacgtcccgttcatcatctccgagtacaggaaaatcctctcggtaattaaagtgcacgagatcgccttgtggcagtagcagtagtagagtagtgtactagttcacgacctaccaccgcgcaactgtcaactcaattggtggttgtcacgctcacgcacgcgctgacacaccggctgcttgcgcgtgtgcgtgcagaggctgtacgagctgggggcgcggcgcgtgatcgtgacggggacggggccgctggggtgcgtgccggcggagctggcgctgcacagccgccgcggcgagtgcgcggcggagctgacgcgcgccgtggacctgtacaacccgcagctggtgaacatggtgcgcggcctcaaccgcgccatcggcgccgaagtcttcgtcaccgccaacaccaaccgcatgaacttcgactacatctccaacccccagaactacggtatatacgtgctcccgcgacggcggcgaccgtttgatcgatcgaagccgaacgccgaacttgactgatctgaacccgttgattgctttggcaggttttacgaacgtgcaggtggcgtgctgcgggcaggggccgtacaacgggatcggactgtgcacggcggcgtcgaacgtgtgcgacgacagggaggcgttcgcgttctgggacgcgttcacccaacggagaaagccaaccgcatcgtcgtcggccagttcatgcaccggttcaccgaatacatgcaccccatgaaccttagcaccattctcggcgtcgacgacgaggaaccgcgcctctagtataatagatagatatgtgcaccgatcatcgatcgatc

SEQ ID NO: 27537 - DNA, 732 bp, Oryza sativa
gtacccctggttagatttataccaggcttcatcctaaccattacaggcaaggtgttacacgaaaaagggcaaacgtgcacgttgttaaactgacgcgtggtggacaagaatgaccggtctgacactggtcgcatcagcaacgggcagccacgatctcacgttgcgcccgtctccgccgggagtggaggtaggtgtgagttgtcccatcgaagtgtcatttggacgacaaccataccaatctccgcccattaaagaaaaaaagaacagtccagtttggaaagggaagggtgcatgtggtatccccttgaagtataaaaggaggaccttgcccatagagaaggggttgattctggccagatttagagcttagagcgggggagaagtgggctcacactttgtagctcattcatacacaaatccacaaaaacacaggagtagggtattacgcttcgcagcggcccgaacctgtatacatcgccgtgtctcgtgtgtcttgccggggagtaatctttccacatacagttaaatttttgagagagagcttgagattgcaccctaagcccccggccgaaccggcaaaggggggcctgcgcggtctcccggtgaggagcctcgagctccgtcatctggcgcgccaggtagggggctcagcgtgtgttttctgagctctcatactcttccgtgtgcgccaagtttcccttgttcagcccaatggccgagcaagcaaaggcg

SEQ ID NO: 27538 - DNA, 865 bp, Oryza sativa
  unsure (1)..(865): unsure at all n locations
ttgtcacaagttgatttacttgctgttccttgtgataaagaagagttgtgcgataatgcttcacttatatccatgccacaactagtgaatggacatgctattcctgttgttaatactaactgcgctgattttaagcatgttgttcacattgctaatagagtagaggaacgttaattgacatcttctttaaatactttgggctatgttcagtttgctgattttcatgagctcgataatttgaaggagaaattatttgctaagtttgattttccatgtccaagtaacgctatttttcatctctttggtgaatataatgatagaggaatatatttggtgcatagagtttacatctgttcagatttagaacctcctgtacatgtggataaaacatgcaatctagagagaaatgttattgctaacaaaattatctcgagtttgtcttgttgtgattggaagaaacaggtagttttaaatggactacacgaagagcaccatatggaaaaaccgaggacggttttccgtgaagaaggggaggatgatgtgaccatggctactatagatacaaccgtcgttcacatcaagatcaagctgtccaagttctgcaatccagttcggccacctgctacagtgtcgacttcaaacggccgccaaatatgcatgcgagctccattttgggtccatgagtacttgatggaaagctctcggagtcatctttccaatggatccagcttcatcgccaaattccatcccagtcgggcgaaatcaaaaaagaaggtgctgcgtcacctataatgggcctatgggnnnnnnnnnnnnnnnnnnnnnnnnnnnnnnnnnnnnnnnnnnnnnnnnnnnnnnnnnnnnn

SEQ ID NO: 27539 - DNA, 679 bp, Oryza sativa
  unsure (1)..(679): unsure at all n locations
nnnnnnnnnnnnnnnnnnnnnnnnnnnnnnnnnnnnnnnnnnnnnnnnnnnnnnnnnnnnnnnaccttgtataacagctggcattccattttatttatggtgcattttcttgactgacacaagttatccccaaatcgtatgtcggacacccctagaaaaattgcatttgccacttcccagatgacaatcaaatcaaatgtagcacacattgagtttccagtattgatatcacaaaccgaatacgggagaaaaaaaaaatgcacagcccaaacaatgcctaatcctgcataccaaagctccaccaaatgaaacagaatgctggcattttccatccagcacaacccaaatccaaccaggcacatcacatcacatcccatcccatgggaatcccggcacaagaaaggcccgaagttaagtgagcctgtgatccagagagagagagagaatcgctagtatgcacacctggggtgatgcggcagcggagcattcttggccgccgccggcggccggggaggggagggagcagcttggcttgcgcggcggaggcggcggcggcggtgggttttgggagggggtaagcaacggagcggaggagacagtgaagcagagtggagtagagtggagagtgtgggactagtgggatatgcggaaaaagcctttgcgagccgtttgtttgccg

SEQ ID NO: 27540 - DNA, 576 bp, Oryza sativa
  unsure (1)..(576): unsure at all n locations
nnnnnnnnnnnnnnnnnnnnnnnnnnnnnnnnnnnnnnnnnnnnnnnnnnnnnnnnnnnnnnnnnnnnnntactagagaaattacccctgtgatccgaagagtctaaccgatttccacctttttgtagttcgctgtcaaatgagctggtagttggggtgcttgacttaacataagctagaaaagcagaagactcagcaaccctcaagttagtctttattggacgtgaaaacattactccgggagatgctggcataaaagcaaaggcataaaccttagaaactattcttcaattgggggatctgctaaatcagctaaaggaaatggtttaaggctcaagatacttacaagcttggtcgccgccttcagtagagactagtaaaccctctggtgtgcctttttgtttaggctcagcatcagaaggattagactgcaaacatatcaagaaatgcaagggcatttaacaagtagactgatgcaaaaaattcagcatcttatcatcatcaattgaacatatgaggcaaaaaggcatgctctagcatctaaacagaacacaaaggtagaaagatactaaatag

SEQ ID NO: 27541 - DNA, 768 bp, Oryza sativa
  unsure (1)..(768): unsure at all n locations
nnnnnnnnnnnnnnnnnnnnnnnnnnnnnnnnnnnnnnnnnnnnnnnnnnnnnnnnnnnnnnnnntttgtgttgtactcatatttcaaattttatagaacagaagatcatgaataaagtgcaagcaaagatcacagaccctttcataagcacaatgaataaatagcatattgttgtattgttgatacataccttctcgatagccttatccataattggttgggtttttgctacaatagtgactgtaccatcactaacagatacccgtgcaccttgagaatatggaagataagagttaaaactcagctgattgagaaaaatgtgaataaaacagagtgcattgtatgttcatgcattcaaatatgcaggttatcaaatacaaattagtgatgaaacatcatttttaacctcaagagaaactccattctcacacagactgtaaatttagaacctacataagcgaggtcaagaatagagaaataaaatatgaatgcttggtagcaaaatgaaactctaccaatattttatattcatattgtcgtgcaaaaaaaacaaactcctgaagttttgaaagatacaaacttgcaaccattcgatactaaattaagtgacattttgacccttacatatgtccatgggctattctttatgaagttctgatccttaaatatatccatatgatattctttcatcaaatcaatgtttttttttctaaaaaaaaaggtgccgttaagctcttgcaaacacttttttcaaacactgaaacacc

SEQ ID NO: 27542 - DNA, 711 bp, Oryza sativa
tatggaagaatccattgagattgtccttgaaaagctcctacatgtgaccaaggatgtcgtggcgaaggtaaactttcctcatttaggaagccctcttgcttctgggctaatccctttttaatgccggtgcaggtttcaaatgaagcaaaccagtgcttaaatgtcgtgttggcaaaatatgatccttttagatgccttgctgtatgtacagagctcccttttttgtataaaagagtatatattaatgcaacactacttgtttacacttcttgttactagcagcttatacttttctttatctttgtgcttgcactgcaggttattgtacctttgttggttagtgatgatgaaaagatgcttgtcgtgtgtaccaactgtttgacaaaggtatcttagttacacgctttaattatcattgatgcaacaccaactccaaagataattgaataaaaacatcagacaatgaggagaagtaattgacctacatttaatttgtaataactttatatgtctatattcgtaaattcaaattcaaaataatctcaaaattctagattcctgaagtgttactagtacaatgaggcagtcattaatggtatttttatctctaattaggcctgtcacaacttgaaatatctgggcactaccaactaccgagttgttactggtgtaccttatacaactatttcattgaagcttcgttgctggttt

SEQ ID NO: 27543 - DNA, 1001 bp, Oryza sativa
aattcctcttgcgagtgcacccaatcattgccatcatgcacactaccctcactccttaatgagaagcactacgtcttaacagggtcctttcgaccttacgcgtcatccatgagaccatgaccaccagagaaagcatcaatatgtgcacgcatcactagtctttggactgatagtctccacctctagctgtgtgtccgtgtgtactgaatgattttttgtttgtacaaaccaaaacatgttgctatgaaaaaaattaaatcctgtccagccttgacctatggatgaactataaccttcagaaacgatggcctgaaaaggaggtaaagtagtactaaaacatcatgcttctaaagaataagtgcaaagttcatggcaaaggattctaggggtgtgtttgaggagaaggggattgagtagattgggaagatacgcaaaacgaggtgagctattagctcatgattaattgagtatcaactattttaaatttcaaaaatggattaatatgattttttaaagcaactttcctatataaattttttacaaaaaacacaccgtttagtagtttgagaaacgtgcgcgcggaaaacgaaacaaacaaactcactctcccaccctctggaacgctgcctaggtctacccatcagggagtaacaaaaagtagagatgctttactcaacaaaagaagaaacgaagaagaaaagacatatattaaattatatatttttactaagagagtccaattcattacatattctgttgtcaatcagcgctgcgaatatgtgatccatgttcagtttacccaagactcctctagggttgatatcagaaagcattgctgttataccccactactccactaaatccactcaatgaagaacaaatgtctcactctcaataatctacaaagcaattgccaacttccattcgctttcaacaatttatattgctgtcaatctgtagagtgaagactagtctaaagctaacatcactgaagggacatg

SEQ ID NO: 27544 - DNA, 234 bp, Oryza sativa
  unsure (1)..(234): unsure at all n locations
aaactnnnnnnnnnnnnnnnnnnnnnnnnnnnnnnnnnnnnnntttgttctggagccgcatttacacgcttttttttttatgtagctaggccggattgccgcctgggatagtattcatgcacgcgcctgcacgaagagtgtgaccacaggagcggttttggtgagtgtctcgtggattgcacattcggccagtgtcctcaacggcttacaaaattcacatgcctattagagctg

SEQ ID NO: 27545 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnntttaattcactgcaacattagatttatttatagtgaaccattataaatacactaggtgaaacatctattgtggaaaaaggaaggaagaagtgtgtgggacaacaggtagcacgtgggggagaggcgcgcgtggggggagtgcttgatccggctccccccgcgccggtcgcccggcgacaagcattatcgttattacccaggtgttttaaccgaatgggtcgtgatgggctagatcgttacaggcccaagttggctgagaattaaaatcattcggcccgtcctcttttcttttttttttttgtctcgtgggccaaccggccgtcagaactcagaactgtgcgttccgtgaagaaattagacggggaaacagtaaaaagaagtagccattgattatttcatcgatctagatcttgccaatgttcatatcgatctcgatccgaagaagaacggcattgattggtgtgtcctgcatcgcctttttctttttctttctttctgaaaactctgcatcagacatcaattctgtggaggtgaaaacagccaagaagaggcgagcatttggcttgttgtactgtaccaatgtacccgttcatgtgctcttcgctggcgctgggatgaaccaattgatgatcagcttctaccgctttaaagtacatggagtttggtagtatacggtggtattcca

SEQ ID NO: 27546 - DNA, 622 bp, Oryza sativa
  unsure (1)..(622): unsure at all n locations
nnnnnnnnnnnnnnnnnnnnnnnnnnnnnnnnnnnnnnnnttgcaaatttgctgtgatataaaagtgagatttgatcatttgatcctgatcacgcacgacctatccactcgcaaaccactgaaaacaaagttgattatcttgtgctgtccagttaaactggaactgaatttctttcctcaaggcacagactaccaaacatgttcactcttggttgtgtgaagtttgatcaactgcaggcatttatacagactaccatagaaagtcataggtatgtctggcaaacttgcccaaaatcatgctagctccaaaactttggcacctatttgtaaggttgccaaaattttgcaagcacatgtttgttcgttcattgtgcatttttcttgcaaatcgtaggcgaaatatagttagacacaactacaaaattatccaacacaggctattaacatcgaatttccagcccatgaactcacttccaggtccactactctcttcggcccattagggtttgctcgcgagcatctgacaacgcccgagcctataaaatgcgtccacccccctccaccgaaggataccatcgccggcgcagaagccttcagtgttcgatccttcggttctcttttc

SEQ ID NO: 27547 - DNA, 680 bp, Oryza sativa
  unsure (1)..(680): unsure at all n locations
nnnnnnnnnnnnnnnnnnnnnnnnnnnnnnnnnnnnnnnttttgtggtatcgtttgtgtctaggctcgcgtctctagtacgttctagcctaggaccagcacggtacttgactttgaaccattattcaactttgcattctctcatttgagcatttgcattctctcatttgagcatttgctatccctttgctacatatttaagcctacccagagctccacagatctgattgcagccgtacagcaagtgtttgccaaggcatcgatacatccaacctccattggggtgcttggttaagtcggtgtacatcaccattccgcttgctttagtaagaacttgtaagagcttggttaaaagcttgagtgtgtgtgatatttgagctgccactacctagtagttgataggagcgtgcatatttttgtgtgtttcttggttgctactaaccatggtaggattgtgtaagggaatacgagaacatcgacttctacaccttcgacgagatatgacgacttctccatgtgatgcatatgaggtacatgactattattttgaacaagtgcatctaagttaccattctatgatgggaagtatgattcttgtgcatacattggattgggagctagtagtagacaatgaaattgatatatatgaattttctgaagctcaaatgaataaagctgcta

SEQ ID NO: 27548 - DNA, 553 bp, Oryza sativa
  unsure (1)..(553): unsure at all n locations
nnnnnnnnnnnnnnnnnnnnnnnnnnnnnnnnnnnnnnnnnnnnnnnnnnnnnnnnnnnnnnnncagttgctgaacacgacggcgtactggtctgggtcgtcgatgctcacggtggtggtgacgccgccgggcgggacgtcgccgagccggagcaccgggagggcgtactcgctcgtcagcacgcagtaactgcccccgccgtcgtcgccgttgtcccccgggtcggcggccgcgtacgcggacgcgttgttgatcttcgggaactgggttccggagatgaggacgaaccccatgaggctggggtcaaccgcggtgcgccgtgacccccgccggagattccaaaacgagcggcgtatggagatggtcgccttcccgccacgctcgaagccaaactgctcgaacagaatgagaggccgagcgtccgacacgatgagcgtcgtcctgatctcgggatcggcgccccgcacgaggagcagcagcacgacggcggctgctgcgacggcgatggaaaaggaggtgtccatggaccttgccggcgatcgtacgtgcatg

SEQ ID NO: 27549 - DNA, 19915 bp, Oryza sativa
  unsure (1)..(19915): unsure at all n locations
cgagctcggtacccnnnnnnnnnnnnnnnnnnnnnnnnnnnnnnnnnnnnnnnnnnnnnnnnnnnnnnnnnnnnnnnnnnnnnnnnnnnnnnnncaaggaaaggctgttgtttttgcaattgattttatttgatctcttttctgaaaacaactaagtgagtgcttctcaaacgacacggatgagacagtgcgtctcgtccggtcggagtatgtgcaatgtatcagtcttttgaattgatcaagattggcacccggccaacaattttcaaacggccacccgggccaacaactttcaaacggcctcccgggcctagctgatcccatcagctgcagattttccaaacatcgatcccctttccacaacagcaatttcacaagcagtagtcaaacaaaactatgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccataccatactgtgccaggaagcccaggggtcctccccgacactaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaaattcatttagttcgcaagcaccgacccaggtgtcgggttttccaagtcttttgtaaaacccaagttttacccaagatgtttatcatattttaagtttgaaggcgaccgtcgatactcgtgcagagtgcacgatttccgaggcgcaactgggtggttacaagggaacatggtataacaattaacgaaggaaggatcaaatgcaacaaattaggtaggctgccattctgccttgcagacgggacaaacagattaagtgcgatcctattaatgcataatatttttcaagcaacataattaagttcaaatataggctcaagatgttcaaaggtggcttgccttgctcgagatcttgagcttgatcctcgaaatccttggactgcgggtcttcgggtgtataggaatcaggagatcaggaattctggaccgtatagaaatcgtacgacgtcgcccgttcccgagtgatcaaacgttcacgaaactccgcataaaactgaccaagtcgtatcgatcttccagggcgcgcggaaaacgaattaagcatgccagctgcgacgacgattcagatggaagcgtcgccggcagaccattggtctccccgtcatcgccggcggtgcggttgccatggtgtaaactggtgccgtgtcgtgagcactgccatcgtactcctgttcgttggcctcgctgtcggcgggttgttttacctcatagctgtgtccaccagggatctggtttactccgcctcgatcgacgccgtctccggcctcgatctcgaccacccgacgctggacccggtgttcaacctcacagtccgcctctcctcgcagaaccaggtgaccaactacccaaactgcatctggcctggtacaaccgtggaggtcacctaccgcggcgtccagctcgccatcgggtccgtggagcagctctgcgtcggggcgcgggagacgaaggagcagcacgtcgtcgcgtggggcgccggcgtgcgcttgccgggctccgcgctggacgcgctcgcggcggacgcgcggcgcggggcggaggcgttcgacgtcgcggtgaagatcccgaccgtcatccacagtggctaccacagctacgacccccgccacgtccacctggggacgcttgtgtcgtgcatgtcgaggcgggtcggggacgaccccgtcgccgcgctgaggactccgtgccatgcgtccagtacggacatcgctgcgtcatacccaaacaaggggaggacgcagcctgggggtgccagttaacgtgcgtgaatatgcaatccgcccgtcatgtggtagtgagcgagaccagtttctacgttactagaatataatagagttcagtttttttttgggtcaatatatattttgtggtgcatgaattatacatatatagccgaggaatcaataatagatcatgatataaaacaacagtccataatgtccattgctgtacactctattatgcaattttgttgctaatttcccgatccgttgagcatgccttcttgtacaaaagggagagacacaccagtcgtcacatcatcaccgtttcaggcacacgccaatccgcgagcctgacgctccgatcgagcacgaaacatatagtcgtacacaattaacgcagctagccaactaatgaaacgcataaaacttggggggaaaaatcatatggacgatccacgagggcgctcaaaatcgaccttcgtcgtccatctcacgctcgaccgccgcgtcctccaccgtgtcgccaatgtacaagtacgggttcttcgccaccggctggaagttgtagaaaacgaacaggtagaaggcgaggctggcggcctcgatggccacgttgacgccccactggtacttgtagctgagcaaggcgaggaacgccgacgcgatgatccgggtgaagtagaggtagccgacgacgacgaggtagaagcgcttgaacagcgtgagcttctggaggttgagcgccgccttgccatcggtcttggatgcctcgcgcatgctgcggatcgaccagatgatcgggaagaacacggcgcagcagcagatgacgtccaccagcaggaacacctggttccacacgacccagtcctgccccgtcggccccgtctccccgatcaccaccagcaacaggttctcgaccacttgcagcgggatcacgatcataagcatgttcttctccctctcctggaacgagtaattcgcaataattctgtaaaaatggaaaattctatagcctggaattctaggttcgttaatggcgagagagagtaattaagatcaatggtgatcacctggaggtagggcttgaggatggaccagccggtgccgatgaggatgatgacggtgaagagcaggacgcccttgaagaagccgaagacgtagaacgccacgtcccagccgtgcggcgtgccggtgcgctccacgtaccacgagtccttcgccgcgcacgccatcttgagcgccttgaacagcagcagcgcgcccatgacggcgtggatccgctccaccgtcgcgcggtgccgcacgcacacgcacgcccacagcgccaggaacgcgaagtacaccttcgacacgaccgtgtagatggtcggcagcggccgcaggcccacgggtaggtagtccctgggcccgtcggagatgccgtcccgcacgttgtacatctcggtgtacacgtcgacggtgacctccacgccgtcctggcagttgctgaacacgacggcgtactggtctgggtcgtcgatgctcacggtggtggtgacgccgccgggcgggacgtcgccgagccgaagcacgggaagggcgtactcgctcgtcagcacgcagtaactgcccccgccgtcgtcgccgttgtcccccgggtcggcggccgcgtacgcggacgcgttgttgatcttcgggaactgggttccggagatgaggacgaaccccatgaggctggggtcaaccgcggtgcgccgtgacccccgccggagattccaaaacgagcggcgtatggagatggtcgccttcccgccacgctcgaagccaaactgctcgaacagaatgagaggccgagcgtccgacacgatgagcgtcgtcctgatctcggcatcggcgccccgcacgaggagcagcagcacgacggcggcggctgcgacggcgatggagagggaggtgtccatggaccttgccggcgatcgtacgtgcatgtcgtccaacgctgcggattagccgttctgcttgttgcatcgatcttaatctgcccttcccgatgcagaaatcgcaccatgcatcgatcttaatctaccgtgcaggaggaggaggaggaggaggaggggcggcaatggaaatggacaggcggttcgtcgatgaccatggcgtgttttagggatggccatgagaggagagcgaacggagaagggcgacgtgttgtttctctcccgtttttgcaatgccacggcggccatggtgggcacatttggtacggtgctcccgcgtgcatggtaaatgggcctcatgtgatttgggctgggcgcctgggcagtatatgggcttgatgggctgggtgtaatatttcttcagcgcacaccttctaatttcaattgccttattcaaaattttccacttatcgggaacacctttgcatattttctacttactccattattaaatcgctgtaacatatgcattattccccaccatccataggcacatcgtcgtttttaaacttctctgtacccatgacggggcatacgatctgtctgctttacgattctagcttctctttaagctaaattactttatatttacaactttcttttagagaatttttctatttactttcatgttccctagctggaatcctattttgtgctgttttccactgcattccgtcctactatatgtaaagcggaatatgtctgtctagagctctagggttcttttttatgtcttgggccaccaatgaattgtttacgcatatatgtatgtgtagattcttgagtacatccagaagagtgtagagatgctcagaaatgtaatggattccttttggctttggctctaagattgtagtaaaagagaatccattatattacatgcgggatagagattaattaactcgatcatcaacataggataaagaggcgcaaatataccgttttatattaaagccaaaacataacctaccaaaattttggtgacttaagtagtaaaataaaggaaaaactaaggagttatttagtatggaaatcctacaaggaaaaaaaaactagaaattgctactccctccgtactaaaatataagtgtttttggatggatgagatacatcatagtactacgaatctagatagtctcttgtccaaattcgtagtaatatgatgtgtcacatctactcaaaagccctttgtgtctcgaaattcctatgtttttcatatagtgctatcaaaaaacattttcacaatcttgtggatttactttctatagtatttaatgaggtgtggcatcctattttacaaatttgtgtatttactttccatattattcactgaggtgtggcatcatgttcttgtattttctaaatcctgattttcaaatacctgaatgtatactcttggagcttaatttgctctaaggcccccgcgtcgcctcccgctcgggcgactcgggcggcgacccaagccaccgccgccgccgttcttcccccctcccctctgcctcgccgccgcctgagcaaacggccggcaaagccatcagcttgctaggatggtggcggcggggctcgtggcggcggccaccctagatccggcgcgggcgaatctgagggtggaggccggccggagcggcgctgtcgtcgaggccggaggcgtgcagggcgcgcgggcgacggcggcaggtggtcgtggtggcgacaggcggcgcaagggcgcggggttggcggcggtaggtggaggcagagactggcggtgggatgtgggccacggtggtgaaggcggcggcaggcggaggcggcggggtgtgggccgcggtggtgaaagcagcggtggcggagtctacgacctcgggcatcacgggatccgcgtcgaccattgccggatctggagctaggtgcgggaggggaggcgggtggcaacggggatgcggtggcagcggggatgcaggcggcagcgggagcataagaggcgtggctctggtggtggtggcgcgtggaggagcgtgaaggcgaggccggtggtgtgaaggccggcgcggcccgtgaagatgcggccggcggcgtggcgtggaggccggctcggcagcgtggagtcgggtgcgtcacgtggagtgtggaggccggctcggcagcgtggagacgcgactggcagcgggaggccggtgcggcatgtaaaggcgcggccggcggcgtgaaggctggcgacggcgcgtggttgtgcggccggcgatggcagaggccggtgcagcacgtggaagcgcggccggcggcatggatggctagccgagcttcgacgaccggtcccttggccgccttggctggttctagtcggtgcagcaggggaatgtgggcgacgataggttgagtcgagggttgaatgcttgtgagacgtcgtggactatcgtgtggccgtcgatgtggggggcttgtgtgggtaatgtgtagacgccggtgaaagccttgccgtgcctttggccggttcgatgacgacgacgccgttggcgccgtttcccttcttgaaggcgttgtcatggcgctctgccatttgccccacaaatctccaggtgaaaaccttgctccggcctcggacgagcggtgacgacgttacgcgtcgtgtccttcttgggggcatcgcttcgggaaagttccttacatcgatgactattgatggtcccttcggctcaaaagctttctttccttggcattcggcgaggcctaagcctcttgggtctgcttcgttctatgatggacgacacactcttcggttgcttctgcggatgaagttggagctgctcgctgttggggtgcggcgacgcttggcaacgatgacgtgttgtagtctcttccaaagagttggtgctggccatgtggaggaagtggctctttggtggcttggctgatgtccattgtggatgtcggagctgctttcgctttggcgacttttgtggcttcagtgtcgctgcagtggtgaagtcggcgctgctgggtcgcttgggcggctagctcggcaacgataatacctcttctgtgatgtcggagctgttgtgccgcttttgtgtttagcttggcaacgatgtcctgtatttgggctccgctgttgttgttagttgtgtgttaggtcccatgctttcttctgtccgttgggttttagccggttccccataattaaccgtgcagctgtatggttttcgggcctgatttcccttataaattgggtcgttgtctcttgtctgtacagtttctccctctcttaatataaaaccagcaatgctggcttaggtttcaaaaaaaaaaattgctctataagtaagaccggttcggaaaagctggttgttgcaacgctgctgagcagtatctacagtgctacagcagccagccaacagcggtcgtaggagcttttcagccagtacaaaacaactagctgcattcaaaatagtccagaccgctgcagccgaacggttaggatgtgcatcacagctgagattgacgtggaaacaggatactaaacatgccttaattcgaagttgttccatgttctaccaaacaaaatgtcttatcatccatcacattcatatatatgagcaaagttcttgatcatgtcctttgggacgaacagaaaagattttgcctacaactcaaggtcgtaggcaaagaactgtttctcatgcatcgtgacgcaagcatattagcactgtcttttcgctgggccggcttggagccctgcatgatgcatcaatatttttcttcctctgaaccagcagcagctcgcttgcagcacgggcaaatcatacgtacagatcacgttcagttcgccgaataataaccaaaactagaatactaatgagatcgacccttctagtagtagaaatgcaaagtgcaaaagcgccagggagaataccatccgaccagaaagacgcttgagaatcgacgtgccatcgcaagaaaacaaaagcagagaacatatataaaccgggcgatctcgatctcgatcatctgcaaatgcttaacaaataataacagtagtagcaatccaaagccaacgccctgcaattatatgtgcgcatatgtggatcgcccttccctttccggtcgctgggctttatccgccctcgcccatttaacaatccggcgcgcgggacacctgtcgccggctcgccgcgcgactagcgcgccgtggccgcgggcgacagcgacgccgcgcgtaaactaatcggccgcgggagcttgcccgaaatggcagccattgaacgccggaatagtttagtctccccgcgagcgcgcctcgccagaaagcaacgagccgtacgtcgacgtagcagcggacagcgcgcgcggatggtgggtgtgggtgtgggtcgtggcgtggtgtgcgacggcgaacgtcctggcagggccgtgtggcgtgtggcgagagagagggaccgaatgcgtgagccaggtgggcgcgcgggctggagcagcgcgtcgcatcgatcccactcgccgtgacagctacgccggagataaaataaaccggctgaatcgatcgcccggccgtggctaagctagccgtgtaggaccaagctacttacgggctaggctacagggctctacgtggaggcgagggggctctccggtcttgccggccagccggccaggacggcatcgtgaggctgtgacaaagatgccctttgctcggtccccggttaatttagtgaggtctaaagagaagagtaaaagaacatcccattgcaacattctggtgcctcgactgctctcccgccctgatgtgatttattgattaattatacggagtagtaagagtgctgagtctttttaatcagtgcaggaattaaattctactgcaaggttatatgcaacgtgttcccctgttgctcgtaaaagagatacgaccgacagggagaatgactgaatatgcaggaagtagagtgaaattggttctgcttgcctaccttgggctaactactcgtagtcgtagcaaaacgaacaccattacaccaatattcatgcaaaagttttcaaatcaacgcctatttgcagagatcaacacacgtgttaattaattcgttggtcttccactgcaaatctgcaagtcgacggctgtggtctctcctatgtcctatctaggctagttagctttcacgggtttccacaaaagcaatgtgtagccaagcgagttggcagttaacgaaacatctacttcgatctgatccctagtttaacaaactgttcaaacttcaaagcgtgtaaaaggattagatttgacaaaggtgcattaaccagtgatcagtataccattgtacatgctgcggcggcgccgtgcgtgatcacgctccgagatagcgttactggtttggcggcctgcaacgacgacacgtcaatatataccagtaaccgcgtttccccgcctgacaaaacggagttttatacaattctagtgcactaatcaaaggttagcgtgttcaagtgcaagatgttagcacgtaactatatagttttctatggcaggagagctttgctctggtccttctaaagtccagctaaagtgcccgtctttttatctcagctttttttcccatcttacaagctgatgagactaggggtctttctctgatctgccgagagattaggaagttccggtcggttctgagatgtcaactggtggattggcctttctttgctctgccccatcacgcatgctctttatcttcagatcaacagggtaaatgatgagtgctgaactgctgactgggaggatcgactgtgtatggctccgtagtataccatgaattaattcttttgttattttgaacgaaccgcaactgattgtgcaattcttttgttatgaattaattatgaatatactccctccattatatatttataagccgttacaaattatttttattaaatattatgtaaatatattttgataatatgtttgttttatgttaaaatatggctatattttttgaaaaaacttggttaaacttaaacgtgtttgactagataaatattaaaactacttataatataaaacggagtgagtagatattaggatgtgtgacacagcacaaacacgaatggaagtggttttcattttttactccaaatctttgtgtcatgataaagtgaacgcacgtcactactaagcgattagtttttgttctcttgaactagcgcaacttcattgttatatatccacttgcttctttatatattacattttccttggcaagaagtattgctaagttccggatgcaattatgcagaaaacgacttatcgccttaagttcacaactaaaacatggagcatatggccaacttaaatttcatgcacgaataatatagaataaatagcatgatattcttctacatgtgtggttactattacaacatatgtccacacatgttctcattcaggtaataataacctaacttaaaaggctgtaaaagttatactgttggacaaagcctgacaaccattcaaatgaaaaataacttaaaagaccactaatctacacgataagaatatattggtatacgcttgattgctagtagtgcttacctaagtggtgtgtttatttaagagtttgaacaattgaacagaaaacaagtatatgcagcatgtttttattgaaaattgcctgattttgcaccaaaaaaaaggcatagcctaacggcaaatctttaaggtcattaaatttctaactaaaacaaacccacatgcgtttactattagcgtgcaccaagatttaatctcaggtgagtgtagtcatacacttcaccatttccacataattcacattataaattagaaaaggacattactttattctttcgacgccacaaattactgtagctacggtgtaaagaaccatacagtttccatgctatactcccgtcaaagctagaaatactgttttaaacattgacaagttcttcaaaatacatttctgttgtaaaacattttaaaaacctaatgatattataatttcataaaatatttttaaaagcaaatgttctacacacatgatttttatacacccatctagtagtaattaaatattgggaaaattgcaaaaccaccccaaatatcactctaagtttgagataccctccctgtaagaaaatttgttgcaaattcccaccttctaatttaccttggttttgatttaggcaccttggtttggaatatatagtgagtttaccatgaaaaacacaatgaaatgaccatgataacacaacgaaatgatcgtcttatacagaacaaacaacataatctcttgctcccgccgagtgggactcggctgattttgccacaagattcttcatgaatcacgtacgtgtggagagaatgtgtctaaatcaaaccaaggtgaattaggaggtggggatttgcaacaaattttcttatggggaggcatctcaaactcagagtgacatttggggtggtttttgtaattttcccttaaatatttaaaaggatgcatgctaattaattagttttgtatagtttgacttaaacaaatttgaaatgatatgatatgtcgtatgtaaaaaagaaaatgatatgaaggaaacgctagtggttttgtgtggatacatgacttaatccactaccactagagtataaaattcttatacccataaaatattcgcatacgcacttgcgctatcaattcagtgatattagtgattttctgctagcctttatctgtttagcactttctccgttttataatgtaagattttttaacattgtctgtatgaatatagatattaatgaatctagacatataaacggaggaagtatgtattagagtacatatattttttatcggaaactagagtacatgcatcagcgtgtacgtgtgtgatggtggtgtacgtgcgcgcatctatctcccgtgtaatctaaaaacacaacacctgcatatgtcatatctgctacctacttttctcgcgaacgaaatcggacggcacgcactgtacgcaccacgtgcaacacgtaccaagtaccatgttctcaacctaataaaaatcagctaattacctgtgatgatcggtctttccacgcgataataccattgtcacgaacccatcatgcgcaactaacgaaccccgcgccgcgcgaggatgacggatcgctctcatgaaccctacctatccatgaatccatccatccatccagcgaaattcgcttccggcatcatgccatccacgatcccagcggcacaacgcgccacacaccacgggccgctcgtacaagtccgttgtgctgcgtgcagagtgcagcgtgctcctcgacaaggaatctctatctctctcgtcaattctcctctgctctcttttttttgttttttttgtcccatgttaatccctactagtactaagctaaagcgcgctctgatgggggtgatattatcacatcccgatcccgcgatatcatcagcgcccactcactcacgccgcgcacagccgcgcgcactcgcgagcacgcgcgctttacgctttttcttacggcctaaaccgtgtgagcgagcgcgcgggggtgagcgagcggtggattccacagtgtcgcgcgcgcttgaccccgagtcagcgtgcggtcccgactccgactccgcgggcgcggttgcgcgctgttggttggagtacgccgcggcgaacgacggggagagtggtggactggactggtagcgtgacggtggtggggttaggccccggggctcccgtgttgacgacgcggcgacccggccgaccgtataaagggagacgtactccctccgtactcgtaaagaaaatcatttagaacaatatttaagttaaatcttagaaatataaatcatgaataatcacaagttgttgagtttaaaaatacaaaaattatataaatagatttatcttaaaattaatttcataaaagtataaatatattatttttcaataaatatttttataaaaataagaagttaaaattgtgttttggagatcgtgccgtttaaaaaacgatatcctttacgagtacggagagagtataacacgagtacacgaggcgcggcgcgcgggcgcggagcggcaccggaggtgaattcgccaaaacgtggtgtggtcaaagagaccgccccggccttttggcggacggcgacgggtagctatattaatcgatcggatcaaggcgctgctacgctttttacgctgctaagcgcgtcgcggctggcgaagccttgaagcgaccgtgatgccccccgcgacggccaggtgtttaacgagttaggctagcgttgcgcgcggtcgccgtcaggttgtgcttgactgtccggtgaataccatggagaggtagccaaagggaaattaccagcaaggacccctgatcgttgccagtggtcggcctcacacacgtgccaatcgagaagagatgttgtgaccaagttgaagcctgtgctgctgtgcccaagtagcctgtccgtccatgtgttattgtgttgtactactaccatggtgtgtactgctactagttgggcacagtcagatacatcggaccaggagattcggagatcgcttcgagctggatggactgctagcatggtgtacaggaaaagcgacgtgaaggagcatgtccgtttgacttgagcagcagaaactatatatatatatgcgattcggcgaaggcctacaggctacaacttgacggaggcctacaggctacaacttgaccgacttgaatgcatggtaggccatgcgcacgtttcggcgcaagtcaactgcacatatggcaacgcacgagtacgacactcttaagacaggtcaactgtcctaggccagggcttgtcccaatgggcacctgagctggggccatatgtgtatcttgtatctcatcctaaaattttaagccatgtgacatcgaatgtttaaacacctgcataaaatattaaatatagtctaaaaaaataactaattgtacagattgcgactactttgcgagacgaatattttaagcctaaatgctccaatgtggtgctacggtaaacatgtgctaatgacaaattaattaggcttaataaattcgtcttgtggtttgctcatagatactttaattagttttttattagtgcccgaacactaggggtgggcattcggtctgactgaaaatttcggtctcggtcttcggtctttgaaaagtgaagaccgaatttcaacgcaaaaatgtcaggaccgaaaaattcggtctcggtctcggtctcggtcctgaccgaaattcaacaatattttcatacatgcaaagaaataatgaaaatttttaacacaaaaatcacaaaaaaaaattataagcacttatgagttaagactgttattaggttgcatgcctagaagaagtagggatgtaaaaattatagtttaatcctatttaatatagtggattgtaagttgcatttacacttttttgataaatcgatcttttcgatctattcggttaaccgaggagactaactaaattcaccgaacaaaattcggtctttcactgcctaggatcgacttgatgaccgaatttctcggtctcggtcttttcggttcggtccttttctgcccacccttaccaaacaccctatataatacccaatgtgacatgccaaaactttacacccctaaatctaaacaccacctatatagcagtattgtgtagtatcctactgtagtatggatccatatccttttccattactgcacagtgcatagcagtaacaagctaacagcagctggcatgtgggtttatgatgtgtgaggtctacctgtcagctgtaactgttgtatagcaataaatgcgtacaattcatgtcatgctagtatactactctgttaaaaaaaacacattcatcccaacatgtttgtccagattaggattggtttttttttatggaggggtatgtgttttgcatggatgtaaatgcactgtattgttctaaaatctaaaatcttaagtgtacaaaaatattgcatacattcttagatagatagaaatattgcataccacttacatctcttgaaaggaagatatatattggttcaacctaaaaggccacgcatagatcgaacaatcatcacaacatagctatatttttaggaaattttattttgtgaaagttagaaataagtcataatcaacctgggactcaatccaccaattcttgtatgtggctcatattaatcacatactcaagcaagtatattcatgctaaagtttccacatattcacacttcatgttttagggaaaaaaataatcacctttcttttactaaaaaaaaatcacccataacctttgtcaagtcgatgtactagcacgtctacatatgccatattgtacttctcttccaacacatggacactcagctcaacaataggatttaacaagcatgttctcattttaattttgtttggtaaatcggccaagttaaaaaaaagggtaagttgaagtacctattggacctactgttgcagttaggggtgataatgggcctaatattattttctacgaaatttgagggttagatttgaagtggagtggactgaatttctatatattttctttactcaaaaatatattgagattgagttcttttcttctctttttcaactcacctctctcgttttccacgtgcacacttttcaaactactaaacggtgtattttttaaaaaaaaatatacgaaagttattttaaaaaattatattaattcattttcaagttattcttatctaatacttaattaatgatacattaataaaccaccacgtttttcatgcagggaggtccacctcacgaacacagcctgagtaggattgtgaaaggacccattacaaccctgtagtacatgccacaccgtttgacacctatttaccggaaacaacacatttgtagtgatatggatctaattaaccttaccatatttagtttcaaagtgcaaaccttaaaaattagagttatttaagtttcaaaattcatacccttaaataaaagtgattttaaggccttaaggaggaggcacctcatcttaattgtattatttatttattttgtaggagcactgctacacgtactaaatttcttactaaatttgtgtagtatatatttatacatcaacactagattagagaaataccgagagatgcaatactctgttcgtactaaaaagtgtggtaccccggtccatcctaccgtaagaaaaatttgtaactactatcacatatatacttggttgattgagtttttgagtgtgattaaaaggaatcattttgcaaattgtagcgatctggccctccaggagaaatagctgcctagctacaaagtaggaaacatggttggttttgtccttgtcgtggctactccaagcaacaccaaaaaaaacgcatgcagctaagctaggcagaggcagcgctttcggcaggaaatcctacggtaagtcggtaatccatcatcatatcagcggagacaaagtgcggaaaaaaggtttatcaaaattacccgcgacaccgatcgaatcaccgcgggggcatttccggcaaccccgtgctcctccgaaagcagtagtggcagtgggatgcccctgacagcgacatggcctgggccgtggtgatgagtgatgacccggagaatgagagaggcgactgtgcggatatatatgcagcgatagctcactcggttgttgcatcgatcgcttcatcactcgctagctcatcactgcgagcggagacagctcaggagggaggaagcaaaagaagagagagagagatcaagagatagacgaagagatttgtctgtgtaaatcaatggaagggcagcagttcgcttggggaagggaggagggagggtggaggaaagggccatggacagcgcaggaagacaagctgctggttgagtacgtgaggcagcacggcgaagggaggtggaattctgtcgccaagatcacaggtaggtgctatagctactgattgagtggtgttcttgcatgttcgtgaccatttcgatgttctctcgcacgttgtcccaaatcaagaagctcgatatatatagccttttaggaagaaattatagctagtagcatcagtttgcatttggtttgttaaattgcacgttggggcagtcaaacatgcaattagtacatgtttaaggttgcatatgtcgcccatgattgtcaagttgcatgatttgattccaattgcggcatttggtacgatcgtgttttcggagaataggcatttggtgcttgctctagcacatgcattaattaattaaaccgcgtatgaactgcatgcacgcgcgtgtaaattcgtcagaaccttttcctagctgtaaccgtggaaatccttttcctagctgagagttagcttcagatgattagcattaaccaagctttactttcttagttaagtacaaatgggagtggtaggtgtgtcatgtacatgttactttttctgcatatgtacgtcagctaattctgtctgatgctatgtatcttacagtactgagcctgtgtatgtcgtgctttgcaggtctgaagagaagtggcaagagctgcaggcttcgttgggtgaactacctgagacctgacctcaagcgaggcaagatcacgccacaggaggagagcgtcatactcgagcttcatgccttgtggggaaacaggtaacaacccatttgcaaatcctttcgtgatcgagctcgatcgcgtttaattttgccatgaatgtgtaactgattcgatcgatcgcattattctctgtggcggtgtaggtggtcgacgatcgcgcgtagcctgcctggcaggacggacaacgagatcaagaactactggaggacgcacttcaagaagggcaagccgtccaagaacatcgagcgcgcgagggctcggttcctgaagcagcgccgcgagatgcagcagcagagccagctgatgcaaaccggccagcagcagcagctcggccaagacgacgacgccaccagcgcggtggtggacgacaaccttgcggaggtcgcgccaccagccgccacctcgctgacccacgacggcgagctccagataatgcaggagatggcgccggacatggacgacctgctgtactaccacccgggagacatgtcgccctattcctacgacgacctcctcggcagcggcggcggcgagtgcggcgccgtggcggccagcgctggcgctgccgcctcgacgagcgagggctcaagcgaggagctcgacggcggcgccgccacgtggggcagcctgtggaacctcgacgacgtggtgcacgacatgatgatcgactgcgccgccggcgccggctgctgctggggtagcttccctccgctacaggataaaggcctcgctttctactagctatagcttaacgattactaaattgctagctagctatagctacaagcctacacactctacaagtagatgttccttttggtcttgtgcatcgatccaaactgatagcacacagcagcctgtgcgtgtggaggaggtcacacgtagtgactatgcaggtgagagcgagaggccattttgtgtacacgaagtgttggtggataaggatgcaacaccaactatactccactttgagtagctagctcgcctcgatggcatgtttggctcatttgagagcgctttttctaggagaaaaaggaagggaagagtttttttctttgttttgcttttggagaaagaatataggaggactgcaggggggaaaatcaggtgttaaaagtgcatctgagctcttgaaatttgacagttgtccattcgaggccatgtacttccaggcaaattattctatacatcatggtgagaattcattcatagagacgctagtaaggaccttcttatagtacttgtggtaataggatattactcttagggtttgctaaggggcgagcactcgttggcagcgaatgtattccaacaaactccacgtttgtcggggtgttcacgagagccacagacacggactctactacccaaaccccatcggatcagagtttcagggtgaggaacggggggagggggttcggaagtggatgatggctgacactggtgggatgggaaaggatggtggggaagatgggtgccaaccagttaagttgcacggagttgtggattgcggcaggaaagggcatggtgcgagggtttggtagtggtgttgtcgactaaaggaggtggtgaaggggtagaggttggcgcaaagaattgacatggtaaataggacaagctcaatagagggaaacctatcgtggggctcgttggcgtcgagtttcccggtgttaattttgctaagaagaggaaaaatggggcgggtgctagagggtgagggaggaaggtcgccttagtctcttgtgattggaggaggtcgtctcaaggaagaggataaggcgggggaggtttggggtaatcattgattctaagacaaaattaaaatatatttttatatttgtgaatgtacctttgatgttgtctagagggagtgaatagacacacttcctaaaattcactttgcaacaatcagtataggccgaaacttccagtgcgcgcatgaggacctacaaaacaagccaagcaaccttaccttaaaactttcggtttctataatagaacttatagtcaactagtccttggcaacaaagagcactcaatcgaaacttctagtctatatatgtactagaactttcgggaccaacaaaaagctagaacccagtgctcatgttgcgtaagatgactctcatctgtagatcaagcgatcgatttgannnnnnnnnnnnnnnnnnnnnnnnnnnnnnnnnnnnnnnnnnnnnnnnnnnnnnn

SEQ ID NO: 27550 - DNA, 5205 bp, Oryza sativa
  unsure (1)..(5205): unsure at all n locations
ctagaactttcgggaccaacaaaaagctagaacccagtgctcatgttgcgtaagatgactctcatctgtagatcaagcgatcgatttgagcacttgagtgacaattaaaccattctcgtgcatcctcttcatgtacagcatacctggaccctaattcaaaatcaaaattaaagttaacttaaatcgctttgacacatttacaaattctttctcttgtttttaagggtcaccattcgtcaatgaatttcttgaataaaactaatgtctacttatttgttaaatacaccaatccattaatcatttttgacatcaattagtcaaaatcctcttagaggacctagatgcacttcaaatttaaaccaacgtaatttccactattaattcatctatctatcatagcggcctccatcagtaccctcctaaccaccggtccatccccttgattttgcctaagtaagtgggataagtacttttattttttttctttatttaagaggacatccctcatatcttttcatgccatttaaatagttatatttcttaaaaaaaatgagagcatagataaatatgtgatatgattctataaacatacaagtttaaataaaaggaacaaattaaactctgcgtgtactattcacaatcacatttttttaacttgtatatgttgaatttaaacttgtatatgagtaaagtaatatatcacatattgatatatgatattaaaattattactattttgcatggttgacatgtacaacaacaaacgggaggcgacctcctcgagggaaataaaggttatctcctaactcgcgtacatttccatttttttagaaatcacctatgtacgaggagaagtgaaggaaaagcactaaagcagcatggtgttccaatgagtggtccttaaattaaaatcttcttttttaaaacgggcaaaagacttacacaccaatatattagtggaaaagagagagatttgacgactatgatctaccgacaggggcgggcccaaggggtagtccaggtaggcccaagactatcctaaaatttggtccagagacccctaggtattcatttttttggcccatgaaaaaagcttggcccatcaaacaaagaaaaccctaactcctcttcaggatggccgtctcccccgtgcgcggcgtgcgctctctcccctcccactcgacggcgtcacggcgacagcgctcccgcgacgcgagccggcaggccggccgccggcgcgactccggcgctcctgcccccgccactcctcccggctggccggctcctgcggtcccgccaggtgcacgcgcccagccgtggcggcggcgccgcgccggcgcccgcacggacacgtcctctctccgtcccgccgcgccttccggccatcggctggtggcctcccgcaggccacagtcctgctcccgtcgtcccggcgtcccgctcccggctcccgccccgcccgagcccgacggttgacgctgccagcggctagcacagcagcgcccagtcggcagccgcccaggccggccggcggccggcgccactccatctccggctcttcgcctctccggactccggtgagcaattccacagtccctctcccccttctagaatctagagactagagttctagtagtaaaccaacaggcagcactagtgtactacccctttatataacaattttgcattttttgatggttcatggttgttaggagtccaggagattgaggcatggagaagtcaagcattgcgttgctttttcaaaagcatgaagcaaaaaaaatgcttgtgaacttcttgcaaaaaaaaatttacattttgatttaggtaatatttaaacttatttgttattttctacttgtattgaaccatttagagttatatactgtatcgtttaccacattatatatcgaatcatattgtattgcattcgaattttttttggctaggcctaccctgggttcaaatcctgggtccgccactgtctactaacacatatcatggaggttacatgggagagggagggcacactaaattaactagggaaaaataatcgaactcctgagaacaacgaggaaaggagaaaaaggagaaagagtaagttactaagtgccaagaagatctcctagggattgggcaacaccgcaacccaaagcttctcttattgcacgatgcgatcaaccaccatctccgtcgtggaaataatcccctctaagacatgagcattttttctagccacaggtgccaaggaggacgagggagttgaacccctttcttgtgtgatcctacagttgctggcaagaagactcccaccaaactggaagcagagcctgttgacagggtgatagcctcttgacagggtgatagggaggctaacctggcccggttgaacagcaacttgtgctaaacttgtggtgcgaagacacactgcaccaagatatggtcacctagatatctattgattatctctatacaaacaaatcattagtgtttattattccgatgatcagacgggctagaacaatcagcaaaagataggatatgtgcattcttctggtgcatatatatgctttcgggcctgtaagatcactagcactctatataccatgtgcatttaaacttatatactctgcggcaaaattaattatactactctactttaggggtgtttgccttatcaatatatattaaagcagaaaagtagtgagaatatagggagatgagcttctttttcatatggacaaactgaatggaagaactttcttttcctagagacaactgaatagaagaaacttcaagtgcaccgtttgcactctccactaataagaatctaatcattaaaaaagaacaaaaacgacaatatgcacttggtagtgctgttttttttatcgcacatcagtttgcatgttaatttcgtgaccatatttttacttcctccgttctcaaataaaagacgtttcaaaatgcatacattcgaatcttgaatcttaaatcactactatatatgtacaagcgctaagatttaatgtcgtaaaaatgacattaatagatttgtcataaataatatttttacggagtctttttttttgtttttttataagcttgtgattagaaaaatagttatcagacatgtgctggagaatgtgctgaggtagttcttgatatgttcccattgctttgttatgtagttgggtaattttactatccttaataaggtatgaggtaccatattttttagtgtgaaacttgatatctccatatactagacatcttgatatatcaaatttttagtgtaaaatattggtattacatgtactttcttaactattataaaatttctctatatagttatgtgctatgagcatatgatatacattgtcaaatgcatatatagcacacaagtgacaaatatgtttatagtgatacatacactctccatctcataaaaaaacaaatctaatactggatacagattcataataacatgatgtatcacatattcacattttgtactaggcttgttggtttgttttttaaatagagggagtaagtagagtgagctatatgatcatttagttggtcgtacatacatactgcattatatttcattaacgtgatgcgggctacgattatcatgtatgaatgtcaaaactccattatatttctacgattgtttgtcccttttttatttagatgctttaataatcgtctgtacataggatagcttataagttatttctaagatctcgtttagcatcgtttatattttgttacatatatttttcttgctttacttaaacggtatgaaccaaacctgcactatttggtgtataactacgagtgtcgggatcagctatatgttaagttaatatcaaattatgattgttcaattgaaaaacaaaaacatattcgatttatgtagtcgtacatttaaatcacaaaagaatgatatactaaattatgaaatatataaaatatttacaaacattaaattttcgtgtagttccgattaatcgctgaacctccttccaataaccatatttcgggccaagcccatgtgtgagcaggccgaacactggtttcaagcccatcaacaccgcctccacgccgacgcccgcaaccagcccaacccagccaaaccgccaacttagaaaaacggagcaaagccggctaacttacctcttctttagggtttgtgccttccccccaatccctcacaacgcagccgccacaaaacccttctccccgcgcgcgcgccctccgctccttcctccgcccagctgcccgccgctcgttcgccaccgccaccgccgccgccgccggttggtcccatacttctcttcttctgatctttccggcatagtcgtagccgcgtggtggtctcagaagtaaatctcacccctgtttcgacgaatttctcacggttttgtcctgcagctgcgtcgatcgaagatgtatctccagtactacatcaacgagaagggggacaaggtgtacaccaccaaggttcgtataggctttccccttgcgcttacttgtttgattagtgattattactgtatggtttgcgatgttagtccatgcctgagaggtgtgtctcctcgttgcgttgcagaaggaatctcctctcggtgttcccacgcagtctgctcacccaggtacggtcacttcctctgatttctttatctgctcttgggtcataaaccaatctatgtgctgtttgttttagtgtaaataagaacttaacattcggtttgtatgtcaatctcattgttggcctaactataaacccgcaaacagtttgaagcatgaaaggtggtatactttttgttgagattttatagtctcgttttgtcatgcataccttgagctatcaaagggtgcttagaataggactggctaattagtgctggtctgctgggaattttgctgagcacgaaggcattgcctaaccagagttttgaatctgctggtgtgccttatactagtattttgggtttttggaactgattctcagatgatgtacggacattttttactaagtagaacagtttttttattgttcttgacttaggctgtgtttagttccacaccaaaattggaagtttgaagaaattggaacaatgtgatggaaaagttggaagtttgtgnnnnnnnnnnnnnnnnnnnnnnnnnnnnnnnnnnnnnnnnnnnnnnnnnnnnnnn

SEQ ID NO: 27551 - DNA, 16289 bp, Oryza sativa
cttttccctcatatcaaatgtctagacacatgtatggagcatcaaatgtggacaaaaagaaaaactaattgcacactccaactgtaaattgcgagacaaatcttttgagcctaattacgtcatgattagccataagtgctacgataacccacatgtgctaatgatggattaattaggctcaaaagatttgtctcgcaatttacaggcggaatctgtaatttgttttgttattagtctacgtttaatacttcaaatgtgtgtctgtatacgtcaaaaaaaaaactggcgatgaactaaacacggccttagaagattgagcttaaagaggtcatagctctttgttcacataagccaatctagtgattgcgttccttgtttagtttcatcaagtgttctacatgtatttttgagggaaaaaagatctctgaggttgtgcttgtgttgcagctcgcttctctccagatgacaagtactcacgccagagatacctgttgaagaagagattcgggttgctgccaacccaaaagccagcaccaaagtactgaaggagaaacctcggaccaccatgttccatggatccctcgaagcgaatcagtcttgcctacctcgctatttacctgtatcactcaaatgatctgatgtatcgcgatgctatctacgaatcgtacttcctctcgaccatattagtatgatcatgaaagtcattcaggtgtcttcgcatgttctgaactgttggcatgattataatctaaaaagtatgaatctagactgttactagtatattgtcacctttgtgctattaggaaatcatatggtggttagctgataaagcaaggaagcaataactgccattttattcaactgagcaataactgaacactcgtgagttgctactttgctttcatgtatagtactggtcataattttaaatgatggctatatgtcggataaggcattctgatagctcgcatggcttacgcggccattgtgtccaacggctaatcagtgatgccggtggtggcggcgtcgctcttggcttcggtaatgattgtagcagatgctatcgccggtgagggatcgagctggcggagcaatggactgttgataccagagctggagcacacggtgacggactgtcgtgccagcacaaatccgcataaccacagaacgtttcactgacactgaggaactctccctgctgatggacctttcctttctcatccatgatccatcaactatcccattttatgaaatgacctcgtctgattccttttcaatgagcatttattcattaccgtgcttgaacccacattactttgcaattcatggaactggaactgagatttcgcaaattgcattcatggatgtgcgaatggaactgaagtttgcattcatcatgaaaattatgatgatgatcagtctgcttcctagatcagaaactgtggtattatctgtgtgtgtgcagacaatttagaagagaagaccgcagagatacaatagatgaacatgacaaagtacagctacaaaatatatagtcgacatttgtcacgaatatacatggattagcagtaaagtttttgataggggcaaaatcaatattgaagatgaaagtggggggaaaaacgaaattgtccttagaaagggacaatttcctagaaatattggcactactcagaacagtacggtaggtcaggtcgctagtgtccttgttttcaatggtgctcgcaaacttctgtgatagaacacaaagttcaaacatgtacaacctccaaaatcgacttctgtggtagaacacgatgttcaaacatggacagcctccaacatcgagaaaatggaagtaaaaacgtgtctaagaaggagcactgagtaaagtcctataagattctgaaacaagatggttacgatctagactggcctatgcatcactaactagcataattacatctcaccttcaaagatgattttctccaaaacgtccatagtaacagtgatggatatgccacaagttccttgggggacaaaaaggatgtattgtgtgtgagcgagtggatgtattgcctagttaaaagcagaagaaatgtattgcctacatctaatgagttgcaaagtgagcagtaatcatctgcactctattttacatataggaaaacctttcaaactactctggagaagaaaccatctctacctccctggaggatggatcatcatcttcatcttctgagatatcatctccagtgctggttatatctgtatagtttgcctgtctaacaaattgccctcgcaccctcggccttgtttcagcaagtttcttcctattcacgtacctcaccttcttgtcaaaacaacgttccttccttttcagcctgaatttggcaagtgctgcagctctccgttcagaccgactacatgtttcctcgggcattggtgtgcttgatgcctgtggccacatattttgtgttggcagttgatttgattgaatgctcataccagcaggattatactgaaatggtggcatcatagatacaccatgacattggggataaacattatactgagggagcaacgtttgtggtgtatgcacttgagcgttgtttatgttcccttggaaattttgcaccggaggatgtgtcataccgtggtccatcatccctgggtaataaaagggaaaatgatatacaggaggagttcctgaagcatcattttggccttcattgcttcgctccagatgcaagttagaggaagaaaagcataccacagggtattgcactggcatctcaaaggcttctttatcccgaatatttacatcagtgccagtgtcacttctgtcagttgtactagagaaattacccctgtgatccgaagagtctaaccgatttccacctttttgtagttcgctgtcaaatgagctggtagttggggtgcttgacttaacataagctagaaaagcagaagactcagcaaccctcaagttagtctttattggacgtgaaaacattactccgggagatgctggcataaaagcaaaggcataaaccttagaaactattcttcaattgggggatctgctaaatcagctaaaggaaatggtttaaggctcaagatacttacaagcttggtcgccgccttcagtagagactagtaaaccctctggtgtgcctttttgtttaggctcagcatcagaaggattagactgcaaacatatcaagaaatgcaagggcatttaacaagtagactgatgcaaaaaattcagcatcttatcatcatcaattgaacatatgaggcaaaaaggcatgctctagcatctaaacagaacacaaaggtagaaagatactaaatagagaagtagtatgttggacagcaaaatataaaaggataactagtacttgattggttacctcatattcatgttgattcgaggtgcttgtttcttgattaatgttttcttttggcttatcatctgtgtcatccgagagaagagtggtgctgttggtattggcgtcactaggttccgataacgccaactcgaaattgtcattgaagaagtttttctccgacaaaccaagctgccaacaccaacattcaacttaagatcaactcatacacgctacagcaacgccacagccatctcagcttagagcatgcttttcaacacagaatttgaagatgaatcaacatagtcccctttaccatccgccttcgccgccacacatgggtccagaggttcagcagctcgttcatgcgcagtggcttgaccaggtactcggctgccccgagacgcaagcacttgacaacaacagagacctcgtctctgttggacatcactgcataattcgcatcaaagatgaggatggtcactacaacaaccctacgagcatgggcatcagaggaataggaggacagcttacttatgatggggatgtggcgcaattccttgttcctggcgatgtatttgagcatcttgaagcacttggagacgggcagatcgacctcggccaagatgatgtcgatctcccccgcctcgcagttgagtacgttgatcacctgcctcggagacttggcgcaagtcactgaaacaaaaacaaagacgtatcattccatgcgagaaggtgtgatagaactgctaattcatctactaaagcaatcttaatccttaattataagagcaaaccaaatactaagcagacaaagctgaactgaccttggtatgagcagttgcagaggaggcggagcacctcccgtgagctacttgggtcgctgtcgcagagcagaatcctcaccttgctccggtccacgaactgctgccctccccctaccgccggcccgccgccaacgcgatccccctcgccggcgcccaccataccccgacccgcacggattccccccctagccacttgtcaccagctgccgacgcgtccgaatcagcacgaacagcacagcagccagcagcagctgccggcgcctagactagacgacgcaggaggacgaagcggttgttggatctgcgggcggcgcctcctcctccatatcccgtgccgtcgccagtagtatcgcccccagaggctaagcagtgtgctaccgccgccacccgccgccgacgccggcggcgtcctcctccgccgcgcgttgcggtccggcccgcaccattatccgcgcctaatctattcaggaggcggcggcggtggtggtggcggcgttggtgtccgctctactggcacaggatattttcctccccctaccttttgctttcctctctcggtggggcacgcggctcggctcggctcggctcggcgagagatgaaagaaagaagaaaaggcctcgtcacgccgcgccggggcggtgtaaaaataaacgaaacggctcgtcgcgagcggtttgtgtcgcgtactcgcgtcgcgcggtgcgggtgtgcgtgtgcgtgtgccggtgtcaatggattcgtcacgggacgggacgggacgagccgcgagccgcggccccgtgggtgggagggccaggttggatggaggggaagagccgggcgtggttaagccagatgggcccggcctggcggcgtgtgatttcggtgagaaaatatctacgcctacctggcacggaaatatcttaatcgcggatgcgattaggggcggcgggcgtggtggggccgtggccgtgcgatacgggagccgccacgcgcgcgagctgggggccagcgaacgaacgccagggagacgcgctactgtagtagtactgtggaaacgacgacgcgagaggcggagggaggtggtgccgtggtggtgccgtgggagtgggagcgccacgcccacgtacgtgcggcggcgtccacggtggccgcgtccccgccctccgttgcggatcacgacgaaagccgcgccagcccaccgcggacgtgccaaggcggagaaaaatccagagggaaacgcggctctcacgttttcacgtagtacagaccttgatgggcagcatggcgatacggtggtggctgggctgatgagtaaaagattttgagctaccggacgagacgagtggccggtagagagcagcagctggatggggggtgttttttttttccccgtgttggcaacttgggatgcccattgccactacgccgatccggagagcgactggtcgtggacttgtggtggcggctcgtggcgccggcctagcgctttttctgtagctttgcttttcttgtttgccactggcgatgtacgtggtggcctccgggctccggcagcaaatcagcgatgctgcaaaatgggtttagcgttaacagcgctgtcgtttgtttactgatctgttaccagcgctgtaattcagtaattcagcagaatggtaaacacaaccaagatttttgattgcagctctgaactatggccaggcaaaacaatcattttgacgaagggtgtttcctccagttcactggctgtatttcttccaccgagaggagtggatggttggtatcagtgacgacacaacaacatctcgatctcaaaaatctggaggcaggctggcagccagtagcaggagcttggagtgccgatgtcatcagtctcattcacaggacgcactaatcatatttattgctaccaatgaaatcatacaaaatgagttattagctagagtagtgctgcatacaggcttgaaagtcacccaaagctactactatcagcaataagttgttctgacagtggaagtccccatatatattcgcctttattctatgacattgacacaccacaaacacgttttggcaaaggtatttatctacagggaaggagtggcgattgctcctgcctccgtcagcagagggaccaagttccctcctttgtgcatcgccatggtatctgtttgaaagacatcaatgaagatcgacgttaaaatagtgtagaaaaactctggcctaagtgacccttgttctagcgattttcttgttcagaaaaaagttaaacagcgataaaaatgcatgaaaatgttgttggtccgatgacattagtatcacaagttcacgacaaattaagaacaaggaactcaccgtcacagccaccaatatgtttccctttaatgaagacacaaggaacagttctctgtccagtccaatcggcaagagctgactgcagctcagacccatcaccttcgtattatgaggatgaattagttcaatgataaattacaatgtatgaactaaagaatagccaggacattctaaaattgactcatgtaataatatatgatcttttttctacactgttttaacgtcgatctagtcctccctactgagtgttgatgtatcagagctataagtgggtccctgtagtttcttctctgttcggttgtttagttctcttttatgcactatttgtcagaattttgcaaatgcatttctctttttttttcttctctttaaataaccggccggtttctttcaaaagagtgaagtttacagccattttcagcatttcaatttgattaaactcattattgcaaccagttttgctctaaactcaactacaataaatccaatgatatctaaaatagatgcagcacggcggagtaatatgttgtatatagattggagagcaaagaagacgaaatttagcatatgttagtatgtacaataaaaatacccagaagaaagaaaataacagaaaaaaaaataatccactcactttccacatccaattcaacagccttgtaacttgctgccagctctgccagcaatcgcttcactcgggcgcagaaagggcaataagtcttgctatggccagtccaggaagaggaatgacacgaagaaagatcaaaattggagtttaggacagcataggtcacaattttgcagaagtagggagataatcatgttaaactctgttttatatgattgcttgattggttttaatttgcatgatgtaatatggttgtatacagacaaaaggtaacaattatttctcatttctttcagaagctacttaaaagttgagcgcatatcaaatcaactcgttccacattatacctgtgcattccttacaaacaaaatatttcgattccatcatcagcagacaacgacgtgatacattggtaacattgctacaccaactaattggtatgcattggctggtaacttgcatgaatatggtcactatttagctccagaaagttcagcaaaataaatttatagcaaaaggaacatctttggtattgacctttttcatgtgctatcagcttagtgattatcacgaaatttaagcacaaattcagcagaggtttatcatccttgctgctacatcatacacgcgagtgaataaaaaaaggaaaaggtgtgagagagacctgaagacgacgacgggggaggaggcgacgatctccttggccttgtcgagcgccatgaccggcttgctgggctcctctagctgctcggagtcggaggggcgcgaggaagacgaagacgactgtgccatccccatgatgcccgacctccgttttatggccgggcagaaggaggctgggtgatttatttacttatttttatctgcgtttccgcggcagagtcgaacgcaagcacgtcaagctagccacgatttcgaacgcaagggggatcttttatggccagtaccgtgtttgcctatttgggttctttcaaaaaagaccaactttgaattggatatttggaagaatcgttgctttgttgaaggggcttgccttgaggaatggcaggcgccagcactgacgcagctacgaaaccaggatgccaaaactggtttttagtcgttcaaatgtgaggcgaaatatacggcgaaaggcgatactagtattttagtttttcgattatacggcgaagaaaggtgagtactacgtagtacttcttccatcccataataaaagagattttaagtttttatttgtattgtttaaccactcgtcttattcaaaaaaatttaaaattattatttattttttttgacttactttattatccaaagtacttcaagcataattttttatttttatatttacaaaaaaatttttgaataaaacgagtggtcaaatagtacaaacaaaaacttaaaatcctttatattaggacggagggagtagtagtttattagctgttcaaacttcaaacaaacggcaaaacagatagtcgccgtgcctggtttttcttttctttaggcacagcatttgactttacagagaaccggcgagatcagatgagcgaacgtgcctacggagtacctattaggcccatattcagaggcgaggggccgcgacgaatgagatgagcgaacgtgtctacctgttaggcccatatacagaggcgaggggtcgcgacgaatgagatgagcaaacatgtctacctgttaggcccatatagaggccgaggcccggtaaagagagccaggcatgaggcccacagcggcccagacaattttagtacttttcctaccgactgacgaatcccttcttccaaaagcttaaacctcgtgcttttcagaggttagatggaatgtaggattgagcccaaccaggtgagtctcttcgtcttctcagtgccaaatatagcctatatgaacgtctcctcaatgccaaatatagcccacatgaacacatttgcccatctccacacacatcacacatttattcagcccatcaatctatataaaaatagtatgctacctaaattatctccaaattctagatagggctgttaaaaaaaatttctccaaaaaagctaattgttatttatttcttctatttcttcttaagattgtcttctatttctctatttcttcttgagattgtacctcctgtcatgttaatcaatttgttaatcccgcagcatcgcggggcattctctagtagaattaatgatttacatttttttttttgaaaaacgagaagattttttcggaggccatctccaattctccattccaggaacgtgcagtttccgcggttcattcgttaagatcaatattttctgtacgcatgtttttgttccaagacaattttagaagaatacttcaaatagtagtactaaaaaagcgagtgtagatgtagttcctcgacgtccaatcgcatcaacaaattccgcgccggatagcgagaggaacacattgcttttgcttcacatctcaccattgcccacgaaccaaaaattcatccgaaggcacgattagatctgagagaagccgagacacaaactggcaaaaatcgacgacgcaaaagtaaatcgaaccgaagctaaaaatcctattggttgatcatgagcgacaactcagtcccttagatgttctttgaccatgcgatcatctccgcaggagtcattacaggtctgtaggactcatcaccgttgctagcgaccaacagatcgaatcaaattgtaacgaagatctacataaagaacaacaacaaaaaattgattttatggcgactattgtttcgaggggtgttcggatgtatgtaacagccgccgagtgccctgcggcgagacgcatccgagggcacgattggaaggcgagctcaggatacaacagggcgattttgcttcaagggaacgagtcgattgggaaccgattagagactaatcctcccaatgaccagatgacgaagcacgaacacaatcaccagattcaccacaaatccaaaaacaaacgaatcgaacacagacgagacgagcaaaaacgaaaagagaaacgaaggatcgaacactgaaggcttctgcggcggcgatggtatccttcggtggaggggggtggacgcattttataggctcgggcgttgtcagatgctcgcggagcaaaccctaatgggccggagagagtagtggacctgggagtgagttcatgggctggaaattcgatgttaatagcctgtgttggataattttgtagttgtgtctaactatatttcgcctacgatttgcaagaaaaatgcacaatgaacgaacaaacatgtgcttgcaaaattttggcaaccttacaaataggtgccaaagttttggagctagcatgattttgggcaagtttgccagacatacctatgactttctatggtagtctgtataaatgcctgcagttgatcaaacttcacacaaccaagagtgaacatgtttggtagtctgtgccttgaggaaagaaattcagttccagtttaactggacagcacaagataatcaactttgttttcagtggtttgcgagtggataggtcgtgcgtgatcaggatcaaatgatcaaatctcacttttatatcacagcaaatttgcaaccagtggcatcacctcatgcatatgcctccagacatggacgtttattagagccagagaaacagctaacatgtaacagacaattcagataatatatgctgcctatcaagttctcttacaaaaaagatgtagctaaataatagtcaacatgcagcagacgatgaagctacatgcactaagatcagttcttgttttcaccataagaaaagcataactgcaaagatgctctgcgttcttgcaaaacacaaacaatgcctagagcatccataagatcacttcttgttttcactagtctctgctgaagtggaggatgccgatgacgctgtgatgtccctggcacattgtgacacgtacggcttcaactgcagtcatttatacaggaaatttattactatacacacaaccataattgaaaagggaaaaaaaacaggaacaagatgattccttggtcactcataccacataaagaagaattccatgttataccattcatgatcaatttatctgtcttgcctgagttaaacgtttcaacagtaatggattatggagcattcaactcattgcccaaggaatgaagtcatcatcttttcagataaaatttggacatggcaagttatttccatcatatttcttaagaaggacctcaaacagaactgagagctttgattatgttatattagctattttctgtttgttaggtgccattaagttacttttaaaagtttgcccagcaagttcagactggaattaaccagagaagcagtggacactaaaccgtggcagtatgctaattaccttgaaatcagtcaagtcagggaccacaaatcttggcaacttctcatccaccataacatatccacctgcagaattaatcaatatttcgaaaattagactaagcaagtaggttgctttactcatgaaagaaaagggatggacatagataacgacaatcagttgaatgatcatataatagttagtacaaatgtcatttgaatcaagtatcaagtaaatcaggaatacaatggagaagtatccgtcccttgcacaaaacaatcaaactaatcaatgataactaaaatttaaacatgtccgtgctccaaacaagaattgcatagaaaggtcaaggctaagttatagctaagagcaaatatccactgatggataagtctttgcgttatcctgtaatttgttacccataatcatctagcactggtaaaactgtacttgcatacagatatgtttgggcttctttgttgaatactgcctacatattttcaaggtgaactgaataccaccagactctgctcttcaatattttatgtttgggcctctttgttgaatactgcctacatattttcaaggtgaactgaataccaccagactctgctcttcaatatttttctttctggcagactaacaaacaggctgttcggatctctttgctgcggttgtgtgggctgcggctgcaagccaatgcaatagtgctttgcaccttgccatggctgcagcgtagccacagtacagctgcagccatgatagcaccaagatttactatgttctgtaggatgattatataccatacaaattaaaataccattatgtaactatgatagatagagcatttttcaatgtgtccatgagaaatttctgcttggctgaaccaccagttgaaatggacctgttgaattgaaatgttatttgctactcactagatctttaatgccttattaaactttggttactcacaccttttattgaagcgatatttgacattattgaaagcacctcccaaattacagtaagcagacaattacttgcacggttgactcagataaatcctggaacaaaacgattcacataaagaacatcccttcctaggttcttccagatttccggttgggcaaatagtgtggtgactagcaactgtcaccatttcattctccatcaacgttcggtttaattaaactatccggttcgaaatcacaaaatttctcagctaagcaaaacctggtcgcaatcttatatgcgattatacacaaagagagcatgcttgagcaatacagacgactagaatcagatcacagagcgtcccgcaaggcattacctttgcgggtgtggaacccggtgggcttgcagttcttccccttgtagtaatcccgaggcgccctcttggaggagaggatgccgagcgaggacagccgcttacgccgcatcgaccttccgagcgagctcagtatcagtcccagcggcatatcctcctcctcctttctgatgattcctgcacacccacagaagggaaaatcagcacgatgaggtggagatagcgcctcgccggcgtacagggcaacgcgaggggcacacccgagcagcgaggggtggaccggatgcggagacgagggaggtccggtggtttgcttgagaagggaggagcggaggaggaatacggcggcggcggcggcggtgggggggcgtttcgcgtatgcgtacgagggggagaaggctcgtagcggtggacggccaggatgagtacatcggagaatggacggtcgatataactttgatgatcaaggacaattaaacgtctgaacttcatagaattttcgtgtggacaaaaaaaaaaggatctgtccataatgaccactgcttaacagaaattttgtaggatttttgtacgaatgaatcgttaatattcgaggttcacaggcactatggtattgatgtgaggcttagattaagtgtagccgtagtaacatttataagtaaaaaaagaagttctcattctgttgtacgtatagtatttcttaataagccaaaacaatttattaataaataataattaatttataggtaaggtttttatatatatgtttgtgacttaaaaaccaatactgaaaaataaactacgttgaaaatatcttacaatcaacttcaaaatcaagtttgacaaaaataaatttcagcttttgctttggtttgttagggtaaccaatgggactcatagtgtttttttcctttttgaagtttgtagcttctcccgaaaagactacgcgtcaggctcgggagccctttgtctctccccaccccatctattaagggcattcacagtgcactgaggtggcattctgccccaaccatccacgtcagatattccttcccatatatgtgcgtggcgttcccaaccgaagtccgcggagccaaactaagttacccgttcttcgtcataacttgcagcgagggtggagcggcgcgttgggagaggccgtagccccatgcgatgcccccacatcccgtgcgaagtggcgacggtcgccggcgaggccgccgccccgaccagctgcgtcatcccctaagcggtgcagcttgctagatccggcgaacccgaggctggatctggtgagctcgacggggtggcggtggcggctaagcgaggagaaggaagatggcggcggcgacagccaagcgaggagaagaaagatggtggtggcagcggcctagggaggaaagggatatggtggtggcggcggcaacttaacctcgctgttgtcgccattccgcgccaccaaggaccacagcagcggcagctcgacggagagggccacaccgccagatccactccaccaagctcccgccgtgcccccgtcagcgccgtctcccgctcgcgcccgccgatgggaggagagacgtagccctgccgtccacctatttgatggtattttggctattatatgtgtacacaagacttactcatgatggacaaagcaaacaagcagtttgtaagttggctagcttatcatttctacgcaatgctcggccatgtatatacacgcaaatacatgcatgcacaggcagctgggaatatatatacttggattagtatatgtgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcataggctcggcccatggccgaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaattagatatttgacgccaggagaagctaagagataaaatcaaagaaggatatgaacaaataacaaactgatcgatcaagccttatctgcaacgaacttgacgcggaggaaacggcgcgcggacgcggcgagcaccgacctcagacccctatataaggcgtcgacccctcggtagccaggggcattcacgaactcatccacacattcattcaccaacgcatctagcatccacaagccacccatcatcaacgcatctacccatccagcatcaacacatccatccatcaactctcatcggcgatccatccatcgacgacacgcaccggcggcggcgagcgacttcggccggagtcccggcgtccggcaggagagggcgcgcgcggtgatccgatcattagcaagcgcaggagaggagcttgatggctagtccaggtaaaagctagcaagattgtttcgttttctttcatctacagcacgcacacatccatgcatagggatccatctacacgtatcgtcgtcgccggggaagtcgcggtggccgattcatctacgcgtcacagaagcctcatcgatgccggtgtctgttcaagccgacgcagtgctacttgtccctggactcgacgctgctaattcaagccgctggtgatgcatctacccgaagctgcgacctcgccgagataccagacatccttgatttgcaagcttcaccgcactggagcgggctaaccatggaggaggtcgtcgggaagccgccctgccggagcgcgccgaggatcggcggagctgccgccgactgccaagacttctatcagttctcatgccggaggtcaagcatcatgcatggcgtcgaaaccagcggatgacgatggaggcaagtatggctgcagtacagaggaaggacgacgggaggacggcgagccagtgctgttggatggcaacaagctagctaatgcatgttgattaagttaattattgtggcaacgtggccaaccaatcggaggacgacatgtcatcgctgctacagtgccatgcacaaaccaatgcgtgggctgaagaagtcctgttggtttttcttatttgtcccaaatgagatgccgagctttgattaaatccggccaccgtctacatcaaccatcttcaataattcctccctgattcttctctaatctaatctcgacgcaactgctgtgacgtcaagtcgttcaagctacgcaactccatgcatgtcttcaccaacaatctacatcgacacgttgttcaagaccgacaaggctagacgacgg

SEQ ID NO: 27552 - DNA, 5961 bp, Oryza sativa
  unsure (1)..(5961): unsure at all n locations
nnnnnnnnnnnnnnnnnnnnnnnnnnnnnnnnnnnnnnnnnnnnnnnnnnnnnnnnnnnnnnnnnnnnnnnnnnntcatcgctgctacagtgccatgcacaaaccaatgcgtgggctgaagaagtcctgttggtttttcttatttgtcccaaatgagatgccgagctttgattaaatccggccaccgtctacatcaaccatcttcaataattcctccctgattcttctctaatctaatctcgacgcaactgctgtgacgtcaagtcgttcaagctacgcaactccatgcatgtcttcaccaacaatctacatcgacacgttgttcaagaccgacaaggctagacgacggagggtgggcgaccaacactggcgcacggaccgacgaggccatggatcgctgccggcgctcacacacacacacacacatctacatcatcatcacaaccatgcatggagaatgcgaagtgaagacgacgagacgaccacaagcagcttaatcggaggttctcttgcaggcctagacctgcggaggtaattaactgggagcttctcgaggccccaggaaccaggagaccacatcgcacaagtcagatctgtccaatgacagattatggagcgcgcatacatatatattacattgggaatttgtatttatgatcttttaagattaataaagagcatgtttcctatgttttgtttacattgtgtattcaggtacactggcacgcccacacatatatgtatctctaaacaaacgagatctcagatgttattttccaccctaaacaccaccgtagctccgcttggatccgagtccatcgccgggaacgctccgtgccgacgcctcatttcctacgcgatagaaaaggcgatgtgatgaaaagcagagtgaaaagtaaagggggatagagagagaaatagagagagtggggggacccaccatgagtgacctccactgtagagcatgtagctaataccgttcctggccttggtggcaagcgaggttcggcgaaaatgtgtggcacactgttactgccctaaatgcagtagactagtactactactcgatacaaaaagtatgcatctttcctgtctacgtgtctatctctttgtttctcttatgaataaatggtctactccatgcatgcaagaaggaggacatgcaacataaataaattttaaattgatttttctactaaactatttattatatatactatctaattactcctacattgttatactccttacaagtaaattttcaaaacaaaatctcaaatgattatttttatcaaatatatgattatattcctaattgaaacatttttataccatacaagaaaaatagttgtaactactaacatcgtaagatactgagtgaaacacaccaagaacaccacgtgcaacatttacacattaactagtggaacattagaacatatttattgaaacatcctaataatacatcgtgcaacgaattaaaaaatacatactgaaaaaaaagttgaatgtgcaacatagtcaaatacaaattgaaacatttgtttctcacgcatgaaacatctatttttaatggtgtgaaacatgtatattgtttttatcggaatgcaaccatacgaaatattgttatcaaaatttaattgcaacgaataaatggtgcaattaaatcgtagatttgataaatatattagtaaaaaatattgttttacaacttaatagatactactagtcgattttgtgcattcatgtgtagagggtgtatatagagagaggggcacatggggagagagggagggacgcacggtgagagtgagaggctaagagcgcagtccttgcatgcaatggcgttgcgtccgatacttccatgcgtgtgtcgggcacccgatgctaagcattgttcaacttcccaattatatattctatattcgagtgtaacatttgccatttgatctatatctaacaggattactataacccaatgcaacattaaggcaaaagctttgtcttgttgagaacacatacaactctgacgttgtggcaggttcctgagcaaggttacaacaacatggacctagcctatagctaaggcttggggcgacctgtggtgctctaacagtaagataacctatatacgatgaaaatttgttgtggcccatgggcttttgacaccagccccaggccatgacctagggtgttaggggcctgggtccgcctctagtggcagttttgcttcgttccaaatgttttcttcatttgaagctgtatgaatgtgttgttcacttgttcagcttccctcatgtaagtatgcaactgcacattctttgagagaattcagaatagtgtatcatggaacaaacaattgtattccaaacatttctcaacacttaaagatccgagtaaaaagtttggagtaggttgcccctaacatcataagccctttttgggctgaatattgatgcattaggacactttttctagacatacgttgcaaatttgtactctggtagcactatgatactacatccgtttctttaatatatgacactattagttttttatcaaatattgtaccatttgtcttattcaattttttcacacaaatatatatatatatatatatatatatatatatatatatatatatatatatatatatatatatatatatatatatatatatataaataaatcatgcttaaagaacatttaaagataaatcaagtcataataaaataaataataattactatattttttaataagacgaatgatcaaatgtattttaaaaagtcaacgatgatatatattaaaaaaacgaaggagtactatctctagcagtatacagtaagtactttggcagtttcagcttgcaagaatgactaggacgtatgatggatcaaggtaccacctgcagtgcttcggtattcagagacagcgattttcaatacatatatgcttagatgtttgtagattaattacatgtgttctattattattttcatcagaaaaacaacacatatttgtgaccgagctattgataaacagaatggcacgtattcttactttgcaatacccacccacacaatcctgcctcttcattgcaaatcgaacaacaagaaagatggcagcgttgatatgtgaaagatggcagcgttgatatgtcgaacaagatcaatcaaggatgctatctttcctggacacttaaaagctcccaagaaaagtactgagtaaagcatctgtctccagcattacaagcacttcttttggctgtatgttcatgtccaaggaagcttttctggacatctgccggaaatctgtgctctagtactagcctgcagtatgcgggaagcactttggcagcatcagcttgcaagaataaccaagatgcaattacagtgcttcagtctcagtacatgcttagacgttcgtagattcaagtattcaacacatacatgctcttcccattctttctatcagaagcaaaaaaatttatgactgaagctacagagccttaagtacttccaacaccgacctcacataatcctgtctcttcgtgcaaataactttatgcatttttttttcgaacgaaaggaaataacttgatgtaaaagaagatataacaataatgctatctttcaaggtaaatatgagcatctcggataaaatattcccaagcaacacacaagcaaacatttgactccacaaaacaagattacaccgagacaacttcttatctgcttccacaagatacaattgcaatgacctttgtaagggggaacaatagaaagttgaaacaactggaataaggttacaagggaatgaaactaaatttgataaactgaggagtaagatccagtcggagctcactattgccgatttatgacttgccggtttgttcatacctccctaagccacccagagattctggaatccagggaattatgccatgaaaggcatggacaaactgaagagttcttgagaaggaggaggagaaggaacagcacagccattcttctccatcctcatactgcttatgctgctcccgatctcaagaaccatgaagatgctcctgccatgcacccaccatgatctgtggaggcagagaattcaagagtcttcatgagaaaaaaaaaagacaggccaagaagccatgaggtgtctttccgtacctgattgaagttgcaaatgctcagctgttgatgaggcaaaagctaggggactagtgagagagccaagaacttgcacggtggcattttaaagaggctagtgtggtgcgctttatgggaaagaatgacaatgaaaggtagaaaacaaagtttactgtgttcagtacgtttattttactgaacatgcctcaaacatcaatctactaaacttaaatctgttgacaattctactacacttcatctgttgacgattcttcgttcctatcctacttctggggctcccaaacaaacttactaaatgtaggtataattgtagagctgtcactcctacctatttaagtgggacattcgaacaccttctgtcctccaattagagtaccaaaggcatcgatgttagtaaaagtttagacaacctctatacctcaattgatctgtcaatttttaccattttggtagcagctgctgaccaacagtcatgcttgccggcaaaagttcagaagcaaacattcatgtaggcatgtagctaaccaattacttagaagttaagcatctcacgactaacctgggacaataaacccaaccagatgtttaccaacaaacagagtctaatcagctttcactgagcaaccaaatccacagatccgcgataaaaagagaagagggcatcctttatataaagctaaagaagcaatcttccttttcgagatgcgcatttttcataatatatggagtttggagcaatgcagcctgcctgttcagccactaactcatgctgacaaagttttgcagcacttcatctgactcatgacgatgtaattctatgagggcaacaaggttgtaaattgacttagtaatccagatttggtacaaacaaactaagcttaagggcaggggaatatactatctatgcagcatgcgttactgctcccaccacaaaagagaggaaatcagcaccaccaattgtgggcaccaggtccagcactccagctacattagagctgtgtttagttcacgtcaaaattgaaagtttgtttgaaattggaatgatgtgacggaaaagttgaaagtttgtgtataggaaagttttgatgtaatagaaaagttgaaagtttgaagaaaaactttgaaactaatcacggcctagaccctcccaaacaatctcccttttcctctctttttttgtacaggtgggtgagcaagaggggaagtgaaaattcctcttgcgagtgcacccaatcattgccatcatgcacactaccctcactccctgatgagaagcactaacgtcttacagggtcctttcgaccttacgcgtcatccatgagaccatgaccaacagagaaagcatcaatatgtgcacgcatcactagtctttggactgatagtctccacctctagctgtgtgtccgtgtgtactgaatgattttttgtttgtacaaaccaaaacatgttgctatgaaaaaaattaaatcctgtccagccttgacctatggatgaactataaccttcagaaacgatggcctgaaaaggaggtaaagtagtactaaaacatcatgcttctaaagaataagtgcaaagttcatggcaaaggattctaggggtgtgtttgaggagaaggggattgagtagattgggaagatacgcaaaacgaggtgagctattagctcatgattaattgagtatcaactattttaaatttcaaaaatggattaatatgattttttaaagcaactttcctatataaattttttacaaannnnnnnnnnnnnnnnnnnnnnnnnnnnnnnnnnnnnnn

SEQ ID NO: 27553 - DNA, 1202 bp, Oryza sativa
  unsure (1)..(1202): unsure at all n locations
nnnnnnnnnnnnnnnnnnnnnnnnnnnnnnnnnnnnnnnnnnnnnnnnnnnnnnnnnaagatacgcaaaacgaggtgagctattagctcatgattaattgagtatcaactattttaaatttcaaaaatggattaatatgattttttaaagcaactttcctatataaattttttacaaaaaacacaccgtttagtagtttgagaaacgtgcgcgcggaaaacgaaacaaacaaactcactctcccaccctctggaacgctgcctaggtctacccatcagggagtaacaaaaagtagagatgctttactcaacaaaagaagaaacgaagaagaaaagacatatattaaattatatatttttactaagagagtccaattcattacatattctgttgtcaatcagcgctgcgaatatgtgatccatgttcagtttacccaagactcctctagggttgatatcagaaagcattgctgttataccccactactccactaaatccactcaatgaagaacaaatgtctcactctcaataatctacaaagcaattgccaacttccattcgctttcaacaatttatattgctgtcaatctgtagagtgaagactagtctaaagctaacatcactgaagggacatgattaccccacaagaaataaatgatttgttttcttcctagcatgctcagggtgagtaatgagtagtactaatagcctaaacttaaaatttatccctttttgagaggcttgatcccagcaaaaacaaatgaccaaattcaaactgcaggggacacaattcaaagagaacacaataaacccatgagctaaatatgacaaaaaaaatcaagaatgacaaaataaatggtaggatgactcttttacaggactggacaaatttatccaacatgacaaacccattgatctcctgaattaggagtattgagagattcaagaaattagtaaagttatgaacatctttttctacaccatcttctagcatatatcattttttctctaccagtatataggatagccaattctccgactcacagcaacaaccattctcatcatcgtacatgctgcggtactatcaagccacagaataatagaatatttaatccctttggttttgctttggacccaaatgatcggtgaactagtatttgtaccaaaaaatgaagtggccagtgtttcagataagtggattt

SEQ ID NO: 27554 - DNA, 2389 bp, Oryza sativa
tggacaaatttatccaacatgacaaacccattgatctcctgaattaggagtattgagagattcaagaaattagtaaagttatgaacatctttttctacaccatcttctagcatatatcattttttctctaccagtatataggatagccaattctccgactcacagcaacaaccattctcatcatcgttacatgctgcggtactatcaagccacagaataatagaatatttaatccctttggttttgctttggacccaaatgatcggtgaactagtatttgtaccaaaaaatgaagtggccagtgtttcagataagtggattttcctcatatactaattttgactgtgaattggtgcttcatataatactttgaattacgtattgcaaattatacaagttcctctagaacagatattaaaaaaaaaatcagggatgagaacaattgaatgctgaaaagtacctatgatcaagtaggcaactggaaacaaaacctcgaagtcaccacattagcaacttttgcagtagaggagtagatacgtagctatgcaaattaactgggtactacaaatttcagacttggcattatcagaaagcccaagtagaaacaacaattcagactgcaatttgattaccacaaagtctgagtaactacctgacaaatttataagtcttcttggttgactatattccctaataagccacttattaggaaataaaaattaatttatagataaaaattttatatatttattcttagcgacttaaaaaccaatgctgaaaaagaaactaagttaagtatatcttaaatcaacttcaaaattaagtttaaaaattcaaattttggcttttgctctagcttattagcccaacagatgggcctattgtctatgcagtgaacagttccatactacggcacagtaagataaaagtttacaaaggttaccattgtgatttattaaggcttgctgccaagatattattatcaagattcctgtttataatttgcttatttgcacacgctactttatcctggcaaatccattttattctgactgtgatttagtgatgcctatattttgttggcgcctacaatacaatgtagatactactagcatatctgcttatgaactacagatctgcaaatgcaatggatctcaaataattatgcccacggttcccacattagatgcgcacgagtaattaaactctctgcaaaatggttccagaaatgccaacaggacaatgaacaaagcctagtcagtttagcttcaaattcaaacacaaccaatttgcaaggaatagttaatttcggagcaaatactatcgaacaacagaactgcgcagaacattcttcagaggtagtacatggctgatcacaaaggacaatgatgtgaccatgactactatagatacaaccgtcgttcacatcaagatcaagctgtccaagttctgcaatccagttcggtcacctgctacagtgtcgacttcaaacggccgccaaatatgcatgcgagctccattttaggtccatgagtacttgatggaaagctctcggagtcatctttccaatggatccagcttcatcgccaaattccatcccagtcgggcgaaatcacaaagagaaggtgttgcgtcacctataatgggcctatgggcttgtaacttcgtctgggaccccggcccaagtggggcccatgtggggtgcgccccaaccaggtggagcacgaccctagggtccccttaggtcgtcctcccacctccttaaatagttaggtacccctttacagtttattgggttttgatagattaaagtttagccattgctacttgcttgcagcgcgcgtgtcggctagaccgtccgtctgcttgttcttcggaaccccaacttatcattcgtatttaattcttatttgcaattcagattacttttatcttgttattgcttgtgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagcagtgctcacctaacagcatttattgcagtctggtcaagcgtgtcacgctgcatgcaacgcagtacagcacgctcttttatccggtctgtgaccagtcacagaccggtcagatcaagggttaggtggcgactggcggtctgacgcacgccttgccccatcccatcaagacgaaagcctctaggcactcgtctcaagccggagcaagcgtgttatt

SEQ ID NO: 27555 - DNA, 25870 bp, Oryza sativa
  unsure (1)..(25870): unsure at all n locations
ccaaatccgcgccgccgagctcgcactcccccaccttcttcacgccaaagtcccaagcagggggaggcgctcgatagagtcgagaaatccgcagcatcaccagtcgcgggtggtgcaggagaacggcgagatggggagcgtcgcctcctcgtctacgcgacggccagcacgcctcaaggcgcgcttcaggctgttggcgcgctcttacgtcacccgcctgtcgtccctgacccggagtctccagcccagcgatggctgatgacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgccattcggctgccactccctcgtctacaccgtcgactcgggaggatcagcatggggagccggatgcccgcctcaacaccgggcgccggcgtaatggccggcgtactccccatgcaacggagggcgcctcctcgtccagagtgtcacctcgacacggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaagaggaagcgtggacatggaactcctccggttccggagtggcagcttcggccgcccccgaatccgccgctcagacagggcggcgggacaggaggaggaagaagaggtcggcccattccgacgacgagggtcatgtcctcgcagtcgagggcgtttcgctggccacccgaaaggggaggtctgcgagcgacagaaagaaggccggcgctccttgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggtttcgggctcgggccaaccccgcacccccccgggcgtgcagggttggccgggggcttatcttttttctcttccgtatttcaacaaaagcattttcgatttcctaaaggctgtgtctgtgcttttgtttcctttttgaagaatcttgacttgaaataggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagctattcaagattggcaggggcctgggggctcactccgacgcgcccgggtcaccagccttgtcgtcgttatcgtccgcaccaccgtcgccggcctcctcgtcggagtcgagggcgaacgcgagccgaggggccgtaccctcgaagctgtgaacgatgtggtcggcggcgtcccggacctgcgcgcgtgcgccgtcctcggttccgaaagggaactcttccagcgctgcccacggggagaagtcagggtccgagaggcccccaagccgaacggcggcccaaggcccccgacggccggagttggccctccgcctgcttgtccgacggtgtcaggcgcccccgaccctcaggatagcctcggggccactgcgggaaggccgcgcctgtcgccctcttaccccgaggatatcggcgcagaagccgagggcgccccgcgctgcctctcggatgaagagcgccctggagatgcggcccctagcgaagaggatcggccccgccgaaaggtgcagcggcccgtctactttgttagtgaggccctccgggacgccaaaacccgataccctcgggcccagaagatgctatacgctattctgatggctccgagaaaagcaccatcaccatatctccaggcgaagcaaatcggctcgcccagattcgtgcgctgctcaggtaatgtggcagtcttgaagagaccgcccattatggacagccaactcaccattaccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagcagtgctcacctaacagcatttattgcagtctggtcaagcgtgtcacgctgcatgcaacgcagtacagcacgctcttttatccggtctgtgaccagtcacagaccggtcagatcaagggttaggtggcgactggcggtctgacgcacgccttgccccatcccatcaagacgaaagcctctaggcactcgtctcaagccggagcaagcgtgttatttcttagagatggcacgttagccctggttagatttataccaggcttcatcctaaccattacaggcaaggtgttacacgaaaaagggcaaacgtgcacgttgttaaactgacgcgtggtggacaagaatgaccggtctgacactggtcgcatcagcaacgggcagccacgatctcacgttgcgcccgtctccgccgggagtggaggtaggtgtgagttgtcccatcgaagtgtcatttggacgacaaccataccaatctccgcccattaaagaaaaaaagaacagtccagtttggaaagggaagggtgcatgtggtatccccttgaagtataaaaggaggaccttgcccatagagaaggggttgattctggccagatttagagcttagagcgggggagaagtgggctcacactttgtagctcattcatacacaaatccacaaaaacacaggagtagggtattacgcttcgcagcggcccgaacctgtatacatcgccgtgtctcgtgtgtcttgccggggagtaatctttccacatacagttaaatttttgagagagagcttgagattgcaccctaagcccccggccgaaccggcaaaggggggcctgcgcggtctcccggtgaggagcctcgagctccgtcagcttgtttcttcgatttgcttgcaggaataaggttgatttgcaccggcaagatcaacaacccacggagaggtgtatcgatcgctaaggcgcaacacaacgtctcgtacggttgtagtcggatcgttaacgtttctcccaaatcgtagttatcacaactcaccgaaagatcgagccaacaacagccttgagtgtcgaaaagaactcagggttcatcaagtggtatcagagctttcgttgctcggtgagtttttatcttcctataactagaaaatagccatacaaaaaaatttgtatcatttacctagccatattgtgccattgcattgttcttttcagtttttactttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttgagttcttgagttgcatctagagtttgccgatccttgtgtgtgtttgtttttgccgtgcatgtgcgcgtgaagaagaaggaagcagaagatgcgcatgaggaagatagaaggagaatattagactagattagattgctttcgtttctatttgggggccacgcagaaaaggaatcggtttccttcttttagatttctcaccgagtcccaccaccttccatgcggcattccccccttgagtccgactccctctcctttccttttggttcaatctacaccgtgccatcccatacaccttggtgaattttttgtttggtgtcggtttcgagatctgtttggaaaaacggaaccggcataaattcagagcattccatttttgtataattttaattttgggtttagacttttacatttgagtccctgtaaattttatatttacgtttgagtccctgtaaccttacattaaggtccttgagtcagtttttgttaaaaaaatcaagaaaaaagtgagaaaaaaaggcagaaaggtgcataaaaaaaagaaaaaaagccgcacaaaaaaaaagaaaaagaaaaggaaagaaaaaaaagaaaaagaagaaagaagaaagaaagaaaagagaaaatactgttatgagttagctgaacttcatatatcagagttgtgcatgagttgttcctagtgctattttgtggtatcgtttgtgtctaggctcgcgtctctagtacgttctagcctaggaccagcacggtacttgactttgaaccattattcaactttgcattctctcatttgagcatttgctatccctttgctacatatttaagcctacccagagctccacagatctgattgcagccgtacagcaagtgtttgccaaggcatcgatacatccaacctccattggggtgcttggttaagtcggtgtacatcaccattccgcttgctttagtaagaacttgtaagagcttggttaaaagcttgagtgtgtgtgatatttgagctgccactacctagtagttgataggagcgtgcatatttttgtgtgtttcttgtttgctactaaccatggtaggattgtgtaagggaatacgagaacatcgacttctacaccttcgacgagatatgacgacttctccatgtgatgcatatgaggtacatgactataattttgaacaagttgcatctaagttaccattctatgatgggaagtatgattctgttgcatacattgattgggagctagtagtagacaatgaatttgatatatatgatttttctgatgctcaaatgattaaggctgctagtaataagtttacctcttctgcattattttggtggacttatgttagtaataaacctgaaacttgggatggattgaaaaccatgatgagaaaacgctttgtgacatcttattacaaatgtactcttcgggagaaattagaacatctgaaacaaggtgacagaactgttagggagtacattcatgaatttaaggtttgtatcatctacagtgatcacaaagagtgcaatgaaaatacaatgcgtagatttttcaatgggcttaattctgaaattcaggttttgcttgataatgtgacatataatcatattggacacctattcatgcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagattagcacatccaagaaaaggagaatggtatacttgagaagaaagaggatgaagcacctgcgaagtctgaagaaagttcgcaaggtaaattaaatggtgctgagagaaatgaaggtgagtattctcaaggtgagctacacttgtccacttttcatgctatagtagagcaaccattagtggaatcaattgctgagttgcctttgtcacaagttgatttacttgctgttccttgtgataaagaagagttgtgcgataatgcttcacttatatccatgccacaactagtgaatggacatgctattcctgttgttaatactaactgcgctgattttaagcatgttgttcacattgctaatagagtagaggaacgttaattgacatcttctttaaatactttgggctatgttcagtttgctgattttcatgagctcgataatttgaaggagaaattatttgctaagtttgattttccatgtccaagtaacgctatttttcatctctttggtgaatataatgatagaggaatatatttggtgcatagagtttacatctgttcagatttagaacctcctgtacatgtggataaaacatgcaatctagagagaaatgttattgctaacaaaattatctcgagtttgtcttgttgtgattggaagaaacaggtagttttaaatggactacacgaagagcaccatatggaaaaaccgaggacggttttccgtgaagaaggggaggatgatgtgaccatggctactatagatacaaccgtcgttcacatcaagatcaagctgtccaagttctgcaatccagttcggccacctgctacagtgtcgacttcaaacggccgccaaatatgcatgcgagctccattttgggtccatgagtacttgatggaaagctctcggagtcatctttccaatggatccagcttcatcgccaaattccatcccagtcgggcgaaatcaaaaaagaaggtgctgcgtcacctataatgggcctatgggcttgtaacttcgtctgggaccccggcccaagtggggcccatgtggggtgcgccccaaccaggtggagcacgaccctagggtccccttaggtcgtcctcccacctccttaaatagtcaggtacccctttacagtttattgggttttgatagattaaagtttagccattgctacttgcttgcagcgcgcgtgtcggctagaccgtccgtctgcttgttcttcggaaccccaacttatcattcgtatttaactcctatttacaattcagattgcttttatcttgttcttgcttgtttcttcgatttgcttgcaggaataaggttgatttgcaccggcaagatcaacaaaccacggagaggtgtattgatcgctaaggcgcaacacaacgtctcgtacggttgtagtcgaatcgtcaacgtttctcccaaatcgtagttatcacaactcaccgaaagatcgggccaacaacagccttaagtgtcgaaaggaactcatggttcatcagacaatctgttctgtccacacaccgccgagttatgactgagcgcttgatccaaataactttttaactgccttagcaggcaatcttagcgcaaaaactgaattcaattcaagaactcgtctggaaggcgatccattacgaactctcaaaaaagaaaagcgttcatcaccaaccttgggccacggcccacggcgaccgcctgggtcatgagaaggagctcaccgccgccggggcccgggaggcgtcgcctcgccctctactgcgccgaagcggcggtgggttctgcgttttgacacgccatgaccattcccagccgtcgatcattccatgtacggtccagatcgcggggaggtggcgcgctggagaagatgtggccgattctcccgctgatacgtgggcccatagatacggtgtgaaaaaaccaaggcccagccgtttcgccttcgcctcgcttaaaccctaaaccaaaacccctctcctcctcctcccctccaccggcgcgcggccaccatgtcgatggcggtggccttccttcgcctactcgcgcgcgggggccgacgccgtgcccgctttcccgcgccgatctccgtcccgggaggccgcgcggcgttcctctccggcgcggccgaggaggtcgcgcaggcggacgcgccgccgtcgccgtcgtcgggacggaaggtgctggagagcttccgcgaggagttcgagatcggtgggcgcgtcatctccttcgagaccgggaagatggcccgtttcgccaacggctccgtcgtgatctccatggacgacacccatgtcctctccaccgtcgccgccgccaagtcctccgaacccgtccgggacttcctcccactgactgtacggatccccattttccaacctggttaccgtgttatggagttttagagagcgttgaatttgattgggaaactttcactagcaggttttgatttgcagtattatatagttaatttggctaatgatcgctctgtctagaatcaattttgtatcactaagagactgcggaagtcaaaatctgatgctaaatgccatttgtaatcctcgccgttggtttgaagggtgtttagtttgaggtgggatgcaaaagagaagctttggttgttcttgggcctttcttacagctgctgatacccatcgacaacttccatttatttaacttatttgaggaaatgacgaattcaatattgaaaacaaatattgacgtgctcacattttaaagacatcacttgtcttgtattttgtgcatctttttagctccattttgttctctgccctaatagatattttgtttattattcatgatgcaggttgattatcaagagaaacaatatgcccaaggtgttattccgacaacatatatgcggagggaaggtgcccctaaggaaagggagcttctatgtgggcgtataatcgatcgaccaatacgaccattgtttcctcctggattttaccatgaagtccaggtaatgaatgctactattatttggttcttaacatgtgtaaagtttttgtaaaatccttaacttatttacctagcaacatcctgcttttctagatcatggtaaatgttatatcgtcggatggaaaacaagacccagatgtgatggctgcaaatgcctcttcagctgcattaatgctatcggatataccttggaatggaccaattggagtaattcgtgtaggaagaattgatggaaattttgtgctgaacccaacggtggatgaggtatatactgatcgattagtaccacatggaattgcactgatctgtcctccataaattgttcccatggtgttgtgaaatgtactgtctgtggatgcgatgtatctcaggagtattgatattggtcattgcactggtccagttacggagatgcatacaattatttgattctctttggtctttttgtgtagcacgaccaactccatcagcatatatgattcaaatgtggtctacattgctagaattttttttcagctgtctcatgttgtatttactttactttaactgtgttttgcagttaggtttgagtgacctcaaccttgtttatgcgtgttctcgtgataaaacattaatgatagatgtgcaagctcgtgagattactgaaagggatcttcaagcaggaatgaaacttgcacacgctgaggtattattttatcttcatattcttgctctattgtaagtatatcctcatgaattgattcacattctcaggcagttaaatgcatcaacccacaacttagattagctaagagagctggcaaaaagaagaaagagtacaagatctcattgatttcagataaatcctatgagaaaattagaacattatcagaagcacccattgaagaagtcttcactgattcaacatacggcaaggtgattatatgttatctgtactcttccttaaaaaatatgtggaggggaaataaaatgctcgattgtgaccattttgtatgaattcaagccaccactatttgttttctatgccctgtcttttgtttgagaagcaaaatgtaacatgtttcaaactttactttttctttacaacatgaactcactgagtatttttctttctgcagtttgagcgaggagaagccttggaaaatattacacaatctgtgaaagcaaagcttgaagaagaatgcgatgaggacagcttgaagtttcttcacaaggcagttgatacagtgagaaaacaggtagtgcacactaattgctttggttaaagccttgcaaatggagggaaaaacctatttttggcaactgatggacatcaaatgcatgcatgtcggtcaacttattattgtacatatacagctaacatatatcctgattttgcaatgcgcgatggctgatgtcattattcgaccttttgcccttctgcatgaatgattttatcacatctagttttcctgcttgaatgattttatcacatccaatttaaatgcatcgaaacttacaagtttggaatgacctggtcatgctaacagaaatagcagagcacttttatttctttatgatttaacagaaattataaactttggcaagtctgtaacttatgtatccaacacattagtgtataacaaatctcattgtttagcactttaaacttagcatgccggttttgcattgagacaagcaaacttctagtcctgatgcatccttttgagccttcgtttgcttcatatgcctagatttacacaacctacataatttattggtgttgtagatcccagatgtactagctatccttgacaaaaatctgatattactttattcagtgttatgttcttatgtagagtcacttctgttatttcagttgacatggatttgtgcccatcttttgtgcaggttatacgcaaaagaataatcgagaaaggacttagagttgatggcaggcaacttgatgaagttaggccactctactgtgaatccagcacatatccaatattgcatggatctgccctgttttcacgtggggatacacaggttctctcgcacacactttaaattgaaggaacattgcaacatttgttttccagtaaagtgaccacccacatggactactttatttgtaggttttatgtacagttacccttggtgctcctggtgatgctcagcgattggattcaattgttggtcctccaacaaagcgtttcatgcttcactacagctttccaccattttcaataaatgaagttgcgaaacgtgggggcttgaatcgacgtgaagttggacatggtacattgtctagtttatgtttgtgtgcagattataggaactagtgagttaattaccctgaagtattagacaaacaactaaggtcatgtttggattgtggcctattggtacgatgagattagtctcacatgggtacgtgtactcagtaagagagtgtgttgaaaaatggagaaaggaccagtgaacaatagatagttgagtccttggcaatgggtacgtgtactcagtaagagagtgtgttgaaaaatggagaaatgaccagtgaacaatagatagttgagtccttggcaagtaacagacttcacagttaggtggcaaaaaccagtagttctcttaataaattagaaatttagcaaaagtgagggtcatcccccttgacctcagtgagtttgcagtggttgtaatggtgttatgttagtttaactagtaacacgcctacccattgcatgggcccatacagatgggttgcatgggcccatacgactgggagatgagctgagggtgtggatcgagcataaagcactagatccaactggttttttgttaaccaaccgcctggttttttgggagaggcagtggttatcagctggtgagttaaccaaccgcctggtttttttgggagaggcagtggttatcagctggtggggaggactggtttttttgggagaggcagtggttatctgctggtggggaggactggtttaaagcttaagcatttggtctgtattgggatactttggctgttgcaatttgctgaatgccatctagtgacaaggttttatatctagactagtcattgatagctcttcctttacatgctgcttcttatattccaatcttattttgcattgtaattttgcaaagcaaaatggttgtcagctgcacagctatttattttgtaacactttgcaggcacacttgcggagaaagcattgctcgctgtgcttcccccagaaggtgaatttccatatacagttcgggtaaattcagaagtcatggcttctgatggttcaacatcaatggcatcagtatgtggaggtacatttcatttgtctcttttattgtcctagtatacttcaaagttaaaatgaactaatataatttccattttggtgttaagaggcatcatgtggtaactagatcctgttatttccttttttattttttttaaaacgttatgtatcttttatctggtagcaattggccctaattctctcattctctcattcgcagaagcctttgtttgaaaggctatacactgcaaccatttgtaatagaatgcggatccatgtttttcatctatagaaaatccaagctagccattctccattgccttcataatatctactgtccagaagataaagttttagatcagtagtcagagactcttagcagagacctgaaaaatatttttgaatttttttaggttatgttaacttctttgtgttcctaggatctacttctgagtattgatatgaatctccttttagtgtcaaagtgcttaaatattgatttgtttcttaatatttctttttttttatcttcattcatctgaatggcaacaggaagtatggctttaatggatgctggaatacctgtaagggaacatgtggctggtgtttctgttggtcttgtcagtgaagtggaccagacaactggagatatttctagttatcgcatattaacggatattttagtaagtatagttgcataccatttctaccatcaatccttataaataactattcctttttcatccaactgtatattttggttggtgctgaactgaacatggccattgatgtttcccagggtcttgagnnnnnnnnnnnnnnnnnnnnnnnnnnnatttgaggaacaaggagaggtattactgctattcaactggatataaaacctgctggaataccgttggacataatatgtgaaagtttggaacctgcacgaaaggctcgaaatcaaatccttgaccgtatggaccaggaaataagttctgcacgtgcttttaatgatgggagctctcctcgattaggtttgttagtgcacttatagtttagttcttttaaggagttcttttttggtgcaaacattgcttgatcaacaccagaattgccctccatttgcagctacactgagcttcagcagtgattctcttaggaaactgcttttccacaggaaaaaaattgagcaagaaacaggtatcaagcccctgtgcaacttctttcaagaaataactagcatcatgtctgcacgttgcaacgaatccttaacatactatagtccaaaatatattatgcaaaaaagaaataattatactaaatccagatgttgcatgcatgatacatgatgctaatcaaacatctacatattgtcatatacttgtgcaaatatgccatttttttctgtaaacatcttacaaaaaatgcacacatgcctatatgtttgtagccacaaacgatgtagagtagcccaactccctcttctttaaaagtaaagatgcatgccatttcactagagtgatagatcaacgtagtggaaatcctggctattgtcgtaccataaagtcataaatttatgcggattggtgatgacttggtgtttcagtgtttgaaaaaagtgttttgcagagcttaacggcacctttttttttagaaaaaaaaacattgatttgatgaaagaatatcatatggatatatttaaggatcagaacttcataaagaatagcccatggacatatgtaagggtcaaaatgtcacttaatttagtatcgaatggttgcaagtttgtatctttcaaaacttcaggagtttgttttttttgcacgacaatatgaatataaaatattggtagagtttcattttgctaccaagcattcatattttatttctctattcttgacctcgcttatgtaggttctaaatttacagtctgtgtgagaatggagtttctcttgaggttaaaaatgatgtttcatcactaatttgtatttgataacctgcatatttgaatgcatgaacatacaatgcactctgttttattcacatttttctcaatcagctgagttttaactcttatcttccatattctcaaggtgcacgggtatctgttagtgatggtacagtcactattgtagcaaaaacccaaccaattatggataaggctatcgagaaggtatgtatcaacaatacaacaatatgctatttattcattgtgcttatgaaagggtctgtgatctttgcttgcactttattcatgatcttctgttctataaaatttgaaatatgagtacaacacaaagtgcctgggaggaagaaccccagaccattctaaatttctaacttttctacctcattacaggtagaatttcttgtgggtcgtgaaattgaagttggcagaacgtacaaaggtgttgtttcctcaataaaggagtacggtgcttttgtggaattcaatggtggacagcaaggtctacttcatatttctgagttgtcacatgataaggtatttttctcttaaaaactctgtaatattaatatatggaacatactgtctattatcatgtgttttatttactatgctaatcttgttcaaatttgtgccagtacatgattgcagttccaactgaacatgataccaatgttattgatgataaaagttcctatacactttttttttgtttgttaaagggttgttgggtttgaggaatcgatgttctagggtcatttgattcttagctccaaacttatcattcttgatttattgtatggtttgaagaatgagaatcatgaatgatcattatcatcatcttccccctccacattgttgtagtcatgatagaggatgtgaggaatagttccatggatgagtgttgatccatcatccaccttacagtagatgatggccaatgagattaagccataggaaacatagagcaatctcatgaagtcacccatgtgatatgagactattgttctaaccaaacacacttgagcaacaagaagaggttcaatcacgtttcacagtataagtgatccattagttcattgcattcatactggctaaaatgctgattaaccagcttttaatcagttgtatttattatatatgtatttagtgctcattttatttcccttctacctgcaggtgtctaaggtctcggatgttgtatctgttggccaagtgctctcattgacatgcattggacaggacttgaggggtaacattaaactttctcttaaagctaccctgccccatgcccatgaaaagaaggatttagcaagtaatcatactgatcctttgccaagtcaagaagttgttggctggacggctgtagagaacatgcctagcaaggatgctaatgctgaaccatccatcagcaaagacgaagacaacatgattgaggagacacctgggtgttctactcctgcagttataattcgaagtgctgctgaatgtgatgcgcaagatgttacaaatgatcctaagaagaaacgcccaaaggttgcaaagtcatctcctaagctatctaaaccagccagcgaaaggcaggaagttaagagaactagtgctaagaaaacttcaggtgcatcaacaacggccaagaaaaataagaaagaaaaagctgactcttcaaatgatgtgctggatgccattccagaacaaaataaaagtaacatcatgaactattctagtccctcaaacttcaggtctgggtctatgaagctgggtgacgtagttacagcaaaggtctaccagatacgagcctatggattagtacttgagttgagtgatggagttcgtggaatgcataaatttgcggtaatttcatacctaaactctctagtgagcaagttaatttgcttcgggatttgcaatattaatatcacattgcttgtcctttttgtccttctattatatgaaaaagaactgctatatgactatcgcatacatataacatctttgatagttaggaaagaaattatgtttccatatttgcagtattgaacatgacaatgcaatatcagatcggatggatccattgccctcaataacaaaaacttagctaaacataacaatgtagtatcattatttatgtattttaatttcattgcactgacattgaaacctttgcaggaaaatggacacaaggattttgaggtcggagaagaactacttgtgaaatgctcaagtttcaatgcaaagggaattccggtcttctcattgctagattagtagccattttgatggggctaatgtcttctctataggcctacagaaatagacgcttgtaaatgtgtagcagctaattcatcgacttgaggaacatgagaaataatactgcggctccctcgacttttgtcagagtgctaccaaaattgtgtggctgtcgttagtagttttgccctgcaactcacaaacgcccaaacattacgcatcacttggtatctgaatctcttttgcagcagttgtacacttgtatttttgccacgctgtttcttattcatcgttgaaactaaccgtaacagtagcattcatatttctctccactcgtaatcccatataattcatttcattctttaatacagttacttctaccatgagaatctctgagcagcagcttcttgggagttgggatatcttcatttcattcattgttgtgtggtgcgaagtgtgaattgtacatacagaagtacagaactggacgcaaaattgtggccttttctgccaccaggtcccacaacgacgaggcctgtggctccgaggccgcctctgataatcgccaagaaatgaaccaaaaaaacgaaccaaagatgaggtgatagactgactagcactgagcttgcccggccagcgccgaatagcgcgacgcgccgacgcccacacatgatacgttgcgacgaaggagctcctcgcgggtcgcggcgatgagcaacgccggcaggaggaggaggagcctgacctccatagctccctcccccgtttcctcctcttctttcccttccggcgcccgggaagctcaggcgccgccgtcccagcttcccagctggaagttctcccaggtgctcggcgaactgccgctcgccgccgccggcgaaggccacgacaacggcacgctccaagatgacggtacgtgtaactctcacgctatgtcgaaagccatcagggattttggcctctcgtctgagcgaggataataatccggttctttttcaggtgatacgatctcggcaatcgagttcgacggccggggcgagcacctggccgccggcgaccacgccgggcgcgtcatcctcttccgaagaaccgacgacgagagccacgtaaattacagcaatatatctcaaagctagctattccagtatggttccctgcagcacgagccgggctgttgaccagcgattcttgtgccccgcagccgccgccgccgccgtctcgcgccgacctggagcgcacggactacgccgcggcggcgccgccggcgtacgcctacatggcggagttccagagccacgagcaggaggtgagcgagtcacccatcgatcgagacggcttacgacatttgcaaatcgtagtacactcttactgatcagtaggcagtacacagttcgacgttctgcacagcttggagatcggcgagaaggtgaagaagctgagatggtgcgcgcggccgaacagctcgtcgctgtccatgctcgccaccaacgaccgcaccgtcaagctctggaaggtatatgtatcgatcgaacacggcattgagatcaccttgttgatagttcaagctcttcttttctgtaggattagtagctagaatgtaatgattttatagcttcaaggcaggtctccgaacacaggtcgaggaaagggaacggccagccgcggcggcggcggagcactccgacttcggcgtcgctgtccgagatcgcgctgctcggggagggtgattcgagcgtaagaaatgggtattattacgagtgggcgagcaagaaagctaggaactatttgtcccctgattcggctgaacattccgaaaaggtaatgttctatctgcagcattggaatcttcggttgaactcgtttgaattgtgccttttgtgtaaccatgtgtgatcaggcaagtgaggttggagaaggatataccgcgaagtgccggagagtgttcgcccgtgctcatgtgtacaacatcaactccatttcgaacaactggtaggttggttgatccagctattacagtacaagtttacaacctgtgtcatgccattctgtctcaactctgagaattaacgaggtcataatgtagatttgttctctttttcatgtgtgcagtgacggggagacgttcgtgtcggccgacgacctcaggatcaacctgtggcacctggaggtgacggaccagtgcttcaacgtcgtggacatgaagcccgcggacatggaggatctcgtaggtgatttagtttcatttgtttgctcaaaaacagtttgcatatacatagagatggattctaataatttgagtggacgtccacccgtttattgcatgtcagctagatggttacggaaaattttcaaaaaaattgacaagagagatcaatatgtaatatatcactccacaaacatgtaagttcaaattcaacttctataagttgtaacaaaaataacaaatttaattgtaaatatacatacagtaatttgagttttgtttgttatttttgttataatttgtagaagttgaattttaacttacatgtttgtgaattgatatattacatattgatctatcttgttcatattttttttaattttttttataatcatttaaataacatgcaataagtgggtggacgtccactcaagcttcccgcatataactgcataataaaagaagtcatgaatgaacggcgaaaccgaagggttgaacactaactgttgcctttttttttttcgatcagaggtgatcacttcggcagagttccacccgtcgtcgtgcagcctcctcgccttcggcagctcgaggggcttcgtccggctggtcgacctgcggcagtcggcgctgtgcgaccgcaacgtcagaatgtaagaggctggctaattaattagctgatgttgtacctttctttttttttctctgaaaaatgcaaaatggttcgttactgtttttcagattccaggatcgtgggaacagcgtgcagcctaggacgctcttcaccgagatcatctcttgcatctccgatgtgaagttcaccggagatgggaagtatctgctaactcgagactacatgaacctgaaggtattctgaattccacttgacatggcttctaaaaaggtccaagtgtacaggcagcgtgtcatatggatggttggatactgaaaccttcagtgttcctgaataacttcagttaacttcgccatttgcagctctgggacttgcgcgtggagagctcccctgttgcaacttacaaggtgcatgagttccttcgtcctaaggtacatcatttatccagcacagaagcatttcactgtcttacatcgcccggtcagctgtgtcagtcagaacacaacaacacaagaagttaagaattcttttgcagctgtcggagctgtacaacaacgactgcattttcgacaggttcagctgctgctccagcaagggcggggactacttcgccactggatcttacaggtttctactgctgcaacacatcaacctcatatctggagtataaggctatactgttagtgcccatccttatccatctcgtggttctttgtgttcagcaatacattcaaaattttctctcgtgctgctgcaaatcccaacggaactacgttggaagctagcacgaacccttacaggtacttagctttgttcttttactgtcgctttgacgctgccaaatgacttaaatttagcaaggctgatctaatacggtgaagaattcaggatacaatcattcccctctgcaaagagtcaagggttgctcagcaattttgctcgcggaatccagagaaaaggttcgaataattcatcaagttattcttttaatgtgtctttgtgcattctttcagtgacgcctctactttagaactgaagcttttagcgtgtgctctgcaaattctcttcccctgcaggtcaagatggaccaagatctgacggccgggaggacactaaatgtaacatgacatcaaaggtgacacatttagcttggcacccgatggaaaacttcatagtttgtgcagctaataacagcttgtacatgtaccacacataggcatatgcacttattttttctccattacccattttgttccgtgggagtactggatactggaggaaaatatagagggcaagatttactaaacacatcgagtgaaagcactatgcattacatatagaaaggcatttgaagcgctgaacatatttatgcgaagctgaaaccttagtcctcgggaagatttttcgctaagcatctggcatattacaatacatattcgggcatttcaaggtatgctgcacaagatcgccactgtgggtcagagaaatgagaagacactcttaacgtcaagaaaagatgcgccagtcccactgctctttgcactcgccaaaatatccttgcaataatcctgaatcgtgagaggttggactgaggctgcaacttgctttgtacattgcataggctggaaatctgcaagaggactgctgaagcagaatttgctcttctcagatgagctgtccattttacctaaaaactgaagagaattctcatctggagtcttgcttagagccttgcttttctcagacgagctgtcccttttacctacaaagtgaagtgaattctcatctggggtcttgctcttttcaaatgcttttttacccgcaagttgagtagagtttttgccttgagttctgttcaggatctcgctcttctgagatatactgtccattttgcccgtaaactgaaaggatctagtttctgcagttctggtcaggatgttgcggcacctctcatctgtattgtttggagagactctagcctcagtacgatcaaagaccataggcgtgacttcatatgcatgcagactgctctgatctagtccaaactgatcgcccgatgtcttcattttcttcagtatcaaaggttcataagaactatccatggatttcgacaacattagattggggaaatctctggatttcttgcgtatgtgatcaaaaattgtgttgttggtggcacttttgcattctgcctctactggttcagaagccaatacatctggaacatctgaacatgataacacaaattttcatgcaagagcacaaatgaaacacaatagatgtgcatagtgtcatatagaattgtgttaccttcataatcttcttcatgcagtagagtaaagcttggggcctccctgtagtcatcaaaatatcaccttagaagttagaacgctatattctatattcagatagtagagaactttcggaaaaaatggttataaataaagaaataattacaaggatgacgaatacatgttagaaatttcactaatagctgtgatctattgcaattctgtggtgacatattgcaatccttgcagaaaattaaataaaaaaaaaagtctgtgtgtagaatgatagccaccggataggtgttctattttctctgcactgattatggaatccttggcaatgtagagaaggttaagcacttacagtgaagctaagttgttgtactctcttgttcccagaatttccagatcattatcatctttgtctggagctttggccctaaaatcatcttctataacacatacctctttagaaagtgggttctgtccattatgatacttagattgatttgtccgagttgttttagagctaaccaaacagctctctgcaggcagattgtacaagggttctgcctttttaatcccaaacactttggtcacatgaaaatcttccctgctgaccacatgcttcttgtggatatcaagaccaacttgaacataaaattaaagatataaactatgtcagcataaaatcgtacacattatagatgaaaatttcattttttgatctatagttccccaatggtaatattaccatattcttcaaaaatgacgtcaaccttcagagtagccctggcatttggggggcatgggacatacagtttgacagagtatggactgcaattttcaaattagccagttaagagtatttgtgaacagctgagctacaacttagacgtccgagctgagaatgcagctaaatactccctctgtcccataatataagggattttggagggatgtgacacttcctagtactacgaatctgatgacaaatctgtttctttttctcattatttttaacggctcaatcaaagatcatttacttttaactttctatagaaggattgaagcattaactgaaataacaacagaaatattacctggaaaattcttgagtccttcacagaagaattagaaatggtgcagcaaccaccacaagaaaaacagataagcaaatatcaggagaggaaatagacagcaaaggacaggtaatatactgtaaaggatatcaactgagagaacaaaaccactgactttattttctcatgaaagaggatcgcattatcttcctctgatcccacaacctgacaaaaaatcatgtaaaaatttaggtttcaagagtgtcaattgatccaaaataaagttaaagagggtaccatatcagcgtaattttgtttactggatcctactgcctgtgataggcgagtcagtgttacaataattgttgattttccctgtctgtttccagcatcctctatgtttatatcaattttggggcctaatgatggcaaataactttttatgctatctccaaatggataatttcgtcctgttacggattctatcttcctagcatcagcagttgccaaactctcaaaagaatcaattccagcagtcttcagtgcctgggatgacagtgataacctcaagcattaattatgcagactgcagatacataaacataattacatacccaataaagataataaagttaataacctttgctgtgacaattccaattccaggcaattgcttcagcaaaaatggactactctcccaaagtttttggtgtaagcatttcgcaaggagcatagaacttatggcagacttgtaattctttttgtatataaaatattctctcatgcatttggcaaccctgcatccatttgagcatattgaattcatttcctgcatcaaatcgcaaaaattaaaatatgtcaaaagaataggtgacaaaatcaaatggtattttgaactggacaaacaaattacctggttgagagatagatcatggactagagggtccccagttaaacaatcatttgccagaataaatattttttcttctcttgtttgaatacgcttcttccttttcccatttgcaccaacaacatggaaccaaagccttccctctttgtcagcatttatctcattaaggagcttcttctcatttcgtcgtagttggatcccttgatattacagaaaaaaaatcaaatcgctaatttattatatttaattattaattagaataaactggagttacctacaagtaatctctgcagagtggcagatgatatgcaacagatcttccaaagtgcaacaggcagaagctttgacaataagcttcatagtatcaaatttcagatagaattttgtcatcagcctcccaggttctgagtagaaaatatatatctcagaagagtcatctttaatatgcaaatgaactgagtaactggaatgctgaggagacatctaagtagcaagggagttgaacagatgggcaaacagaacgagaaacactagaagaatagtaacaaaactattgaagttatgggacagaagtaggcttcaagttgaatacccagccgtcaaaggacctgccatgtttgccagcagaacttcttacaaaaacgaaccccattaaatttggagaagacggtgtacattttagtgtcagctgttaaggtcatgatcagaaaacgtacacagatatttcatgttatctacttgaactataagactgaacgatcgcaccccagatattcaagcatgtattggagctagctgaatagctgtcaatgttacagctcagatattgaagcactggtctatgttagttgttaaggttgctgaggtcggaactcggaaaacctcaacaccacaccaatcataagctcaaactccgtacttgaaacaggttgaagaaatgcatgttgtccatagtgtaatgctcattttccatccccagtcaaatctaggcctattacctaaatgtattttagatacaatgatgtggttcggaattgaatcctttggacactttgacatgcactatacaacgaatccagttcaaaggaacaactgtaatgtatttagcccaaattaatagaaagatttgctatggatcaggttggtggatactatagatggtagtgcttctattctctcctcaaaactgaattgcacaaaagccacagatattaagcaatgctagtgggcacaccatcaaaagcctactttccacaatgtaggtaggtgtgcagatgggaaacacacaaggcgtaccacaaagtgaggacacaccgttttccaactaaagccaaactattttgcagaagcgtggaattggcaaaagactaaacttcaatttgtatagcgtaagcttgtaccaatagacctgtattaatttgtatcatcatttttttaataaaaaaaatagaaaatttacctaatggttttagaaggaaaccatcttcatctgtccaaattagaccatactcccccagctcatggatcttctcaacacatatatctgtaaattgagttcataacgatcaaaatcccatagaaccatgaattctacaaaatccaagaaagatatacctttcatttgcttttcaagaagttcacgtggaatttctttcttaattccgtaatgctgaggattctggtaattcaattcgtcaaagtcagtttatgcatttaagcgaaatggattaaagatttaatatactaatttgccatgcctccttatcctgat

SEQ ID NO: 27556 - DNA, 5117 bp, Oryza sativa
  unsure (1)..(5117): unsure at all n locations
catgcactatacaacgaatccagttcaaaggaacaactgtaatgtatttagcccaaattaatagaaagatttgctatggatcaggttggtggatactatagatggtagtgcttctattctctcctcaaaaactgaattgcacaaaagccacagatattaagcaatgctagtgggcacaccatcaaaagcctactttccacaatgtaggtaggtgtgcagatgggaaacacacaaggcgtaccacaaagtgaggacacaccgttttccaactaaagccaaactattttgcagaagcgtggaattggcaaaagactaaacttcaatttgtatagcgtaagcttgtaccaatagacctgtattaatttgtatcatcatttttttaataaaaaaaatagaaaatttacctaatggttttagaaggaaaccatcttcatctgtccaaattagaccatactcccccagctcatggatcttctcaacacatatatctgtaaattgagttcataacgatcaaaatcccatagaaccatgaattctacaaaatccaagaaagatatacctttcatttgcttttcaagaagttcacgtggaatttctttcttaattccgtaatgctgaggattctggtaattcaattcgtcaaagtcagtttatgcatttaagcgaaatggatttaaagatttaataatactaatttgcccatgccttctttatcctgatgtacaaatacgagcacttgagccactcaatagccaaagttatatcagacaccgtcagctgaacaatctctgcatttagatgctcaaccgcacatggaagtaacctggtcatagcatctatactcagcgagaagtttgaaatggtatgcagtccatgtcaaagtcaactaggtgaaattattagttttcagttgaacataaaacacttactgagactccaccatctcacatccatttagaaggttctcatatagatgcacctacaagatataacaggttagcacaaaagacctatagagccaattttgcccaataatggtatcaaaatatctcagagttaacaagagtggaaaatatagatcctttactgtctctcttcttgtcatgattataattgttccagtatcatcaaatggtggacgcccagcccttccacacatctgtagatcacccaaataaggggaggggcattgttagaagcaagaggaaaccatatagtataattttataattgaatcacaaaatgctctgaactacaatgctttaaatgcatgttagttttaattaaaaaaatatgatcttacacattacactataaataattgaactagtatgtggcatgaaatttgcacgtccaatttcaagtgttttgcagatataagatcaaatgatgtgttttcgtcaaagaaaaggatcaaacgatatgatgttgtggcaataagtatgtcagaatcaactttgctttatgataaacaattgaacttatatgcagcatgaaatttagaacatctgatatacctcttttttcataaataactattccaataataaacttttggcaataagtatgtcataaccaacttaacataacacccgcccaagcaaaaagttattgtataagtatagagtgaaaggtcatgatagattatgttctcatgcactttacagcgtatatgttggttccgataaacttaaccaagtttatagaaaaatatttaacatctacaataccaaataaatacattatcaagacataatttatggtgaatttaattcaactattttgatattatagatgtgggtgcatttttctataaatttggtctaagttagagaagtttagcttagggcaaactgaaacaccttacaatatggaacagagggagtagcattaagactacacatcaaagataacaaaatcacatatactttcatgaagcaaaactgaataatattattgcatatcaacaatgatgtatttactggtggaaatgagacatgatagtatgtatacctgaagaaccatggatctctcatattctacatacagacccttctctttgttgctgaaaaatagaatgaatatcagagaaaaatcattaagatgatagaggctaactcaatcactgaatatttaaaatgaactcacaaaaattgtgttgactttatcaccactgtgtgagcaggtaagttgatcccatgtgccaaagtattcgtcgtgcaaagaatttgaatatcacccttcaggaaaagtccctcaacgacactcctatcctttaggcaaagaccaccgttgtgataaccaactgaaaagttgaaataagatatgcatcaccaatcagtgtaatgttaggcaacacatcaaaacatgggaaaccattgtaggttgtgaaggtatcgtgggtcgagaacaagattcaacatgacctccatgtacgagacaagcctgcaactgcttgtcgctacaggttagtgcagcctcctttagatgttcatactgctgcatcgatttcataaatggatttgaatagcctagagaactcgcagtttgtgaaaggcactgtgctgcttcttgtgcgccttttctagtagaacagaaaacaagtgcagactttcctcttgaatgttgcatcagtatatctgtatcaatattatcctttattttgaatcctgaaattctgctaacttaacttaaagtacaattgacagataggtagatgtaacttaccgaaaatgaaactttggagtctctacaagtagaaagaaataaagaaaataaatatatcagattcgattcagtgattatgcacaaattatcagtacagtagtacagctcaaggagatgaagaagacatctgacttagcacacgccctaattgtcccttctcattttaaagaaggaacattctcagatagtaagaaaatgcataccctctcaaacaggaagtcatttcttgctggagcataacctaaatagcacagtgaaacagatatagattaggtcaaacatataaattgctggtttaagtgttgtaaggctgtcaggacatgctaagtaatcaaagtggcattttcaagagttcatgattttgtggagtaaaacaaaaataatgatctattcgaacatcatttcatgactgattctgtgaggaagttgcaggtgtaggatggaggtattcatgacacagtttcttctcactttgacataataagtaaatcaaatgtcctaattcttacgctttggccaaatatttgcaatatgatgagaaacaagaaccataccaaaaaccttggttgtcaacttcactggcctcatctcttctccaaatctgcaaaaggaatatatagataaggaagttctagtggtggtatccttgatgaagttgcttctcatcacctttttattccttcagacggtactgcaagccactccgctgagatccaagcaaagccaaaacgtaagtaatctttaacagaacataatctggtaatgtaaataaaatagagacatgttgggaccatactgcttggagtttaccaacctatatcctcaatattagggatagtggcagaaactgctatgaatcgaacatttgccaaaggagcaatcttcattgtgccaagtcgagaaagcatttttattctactgacaattgcttctagggcagctccacgaggatcgttgaggagatgaacttcatcaataaggaccagagcaatgtcactgaagaaacccagtccaccatctcttattccatgacgactcacagaatcaaacttctgcaaacataaagatgttggttaaaaaacaaggaagtggctagcagttgtgccaatcctctttttacaccgtgtaaagcaaagcaagcagtcacatatacctcaggagttgtgagaattaagtcagcatcatgtatggatttggtgttatagaattcattgtcaccagtcatctccaagcaactgatccccaacgagcccagcttcatgttccagtcacgcaacttctcctgcaccaacgccttcattggagcaatatagatctaccaggcagttcaaattaagcacatggtaaaaattagacattcgtatcctcaacatacaaagtgaatccctaaagtgtatagaaaagctaagaaggtacttgacacatactgttttcagggttcctttgatcaaattaaacctccactctgatgagaggaaccttgagagaagccttagaatgcagagctcgaacagcacggttttgccactcccagtaggcgcagagataaccatgtttacatccgagaggaagcatgcagggaagcactcgctctgcaacgaattgaaatacctgcacggaacgcaggatgccactgtaaaaccccatcccagctactccacgtttcataccgtaatccacattccacagaagtgttttgttagcctgatgcactacgactacaaggctactcaaaatctcaatctactgaatgtgtgagcgcgatcatacaactacacagaaatgcaccgtgcaaacaccgtaaccgcggcccacggagtttgatattggcaaatgcgatgatgcatcgcgcgcacctgaacccgaaaacggagcggaatggcgggggaaggtccgcgacggagcgcagcgcgtacgggtcgccgagatgtcccatcgccgccatcgcgtgcggtccctgcagaaaaatcgagcgatcgcgggtgagtagccccgccgccgaggaatttcgtcgaacacgttgcgcgcggcggccggcgatcggagccgaaccggctcgatcacgatcaggaactcgcggacgaaccgagcgggcggaggcgcgcagcgtaggaagacgagaggcggagagggagaggcttgcttactgctggttggtggaaccggatttggaggggggggggggggatttggaccggaggagtcggagagatggcgagagagaggagcggctgcttcgcgagggaacgaaggtgggagaaggaatggcaggagaagccgcgcgcggataatgcctctggtgtctcgaggtgagaaggagaaggcggaggagatgagccgtggatgatnnnnnnnnnnnnnnnnnnnnnnnnnnnnnnnnnnnnnnnnnn

SEQ ID NO: 27557 - DNA, 33736 bp, Oryza sativa
  unsure (1)..(33736): unsure at all n locations
nnnnnnnnnnnnnnnnnnnnnnnnnnnnnnnnnnnnnnnnnnnnnnncgaagtcgttgcctcccagcgtgatgagcaccagagcaccattcacgatccgcttcgcctgctcctcgccgaccagagcccttagcttgcgctggtactcccggaagtactgcagctgatcgccgatcctgattatgttcacctgtgttcacgcacaaacacccacatggttgcacatgaaaatcttgagaagaaacacggaaacacaatgacggccgtgaattgaagtgaaatgaattgagcattttttatcgtacgaattgcaccccggtgtcattcaggatcccgacgccggccgacgcgaagttcgcgccgacgagcagcttgtcccctcggagctcagggctcaggtacggcaatgcaggctcggccccaagatgctcgcctgaagaaaacgcccatggtcgtcagctcttcggcaaaacgtgtcgacacactgtttctgaaatatgcaggagttaaagtactacgcactgataatgtcggggatgttgagcccgttggagaaccggcccgtggcctggtgcgtcgggtagtcgatgccgtacggcggcgcgtcggcgcgcgccgtggtgatcaggtagttgttgttgccgttgtcgacgagggagtcgccgaacacgaagaaggcccgctccgcggacgccggcgccggtgcagcagccacagccaataggccgacgaggagaggaacgacgagagcagcgaccattctcgctcgcggacgtgagaagcactgctgactctctacctgtccttactgtgatcaagatgcacgctctactagtccactagtgccagtggctcgagtagtagctgggtagatcgatccctctttttatagaggccttggctagctctggctcgatcgacacacgaacaacttgttttgcagcaaaggtaaaaaaaattgccaggtgagatactggcaaatgcggtgaatgatgcgaggtggttggttgatttggagccgcatttacgtgccccggccgggaggtagctaggccggcttgccgccttggatcgtgttcatgcgcgcgcctgcaggaagagtgtgaccacaggggcggtttcggtggtggtctggtggattgcacgtccggccgttgcccgcagcgggttacagaattcagatgcatatgagagctgttaaataatggggcggtcctcgatctgctgtcttgtttggtgtttggggagagatttgggattgttcgttgaacagtattaatttactcaagtacggtgtgcattcattgtagatttgtattatgtagtccgagttttgtgtggtaaagaagtgattaccttattcactggttgatctggttgttttgcatcatctatttagctggtgtttagcagtgaatctagaataaaaattatggagtgtcctatatgcatatttggcatgtataatacttcctccgttcagtaaaaagttaatctagtactggatatgacacatcctattactacaaatataaatataaatatgtgcagatacatagtactagaatatgttacaatcacatccgatattaaattctttttttaagggacgaagggaagtggcactaattgttgtgcggagaaaatttgcgtgatgagcaagcttaacaccctgtgtcctgtacatagggaaggcccacgtggcttcgcctctgtatctatattgttgagaaaatcctttctatatataccttttaaaatttagctttctatactcttgaattttgcttatttctttatatatctccaaaatttgattttgatcccttccatacttctcccgtcagttaaccgttagttgactgtctaattttaataaaaatgactattttaccttttggatgaacatagaaattcatgaattacattgttaaaaatgcagtagaattttgtcgcataagactactagagttatgagtttgttgtgtgatgcattatttatcacaaaatttatttttagataaataaataaaaaaatatgtatttattttttaaaagaaagtcataaaaaatgagaagcattcatacaaagataggactaccaatgttcacaataatttttttatgaatgttttgatgcgaaaaacacacactggcctggaagatctgcttaactcctgtgcaggtccaaaatcttgcttttaggttcgtaagcgtgctagtcaatttgatcttgcaatcaccaagaaacaaaagacaagaaaaaccgcggttaaatccataaacgatagccgatcggctagttgtcgatgacatatcatttatctttaagccgatgtcatatgtgaatcgatcggctgttataaataagcaagataagactaaatctactcgatcggctgtagatattaacgctatataatcattctgtcaatgtatatttagactaggtgattgggatagatcggtcgctatgccgagacagtataaatcacttagatcgaagtatacattaatacaaagattataaatgtttatagcatagacgatcagatagatctagcacgtatcggctagtactccgataccatttactagaacaaatagaatatatcaaacagaaagcctaatatactttattgcaataagatcttaatataaagggcagacttagcatatcaattaagcatataagatataaaatagctaaattaggtaagatcggctgaaaccccgatactatctctcttgataatcataaaagaagccagatatcataattatagatattacttaatagatcgaacctaaccgatgcaacattaagcataaagacaagtataagatctagacaagatgatgaaaacctacaaaagatggtatatacacgatacaatctagatcaataacaaaacataactctaccgattgcttcctaacaataagaaccaactgataacaagttatatagcgcaactaacatagattgcaaagtatatatgataactcgacagattacataatcaagattagagtgtcatagagatggaagcactaatcccgacaatgcaagctgccataacaagttttacctctagttgaagatcaaaacgatgtagctcaacccgaaagcaagaactcgtcgaaatagaacgaaagtaaaaagggtggcgatgcaccaagattgtattgaactattgttaattgattacatgggttcgggttctatttatacccgagattacaaaatatgtccttgccggacacgacacttatctctaacaaactctaagataccataagtctttgcggtaaacttttgcccaaatatatctctaaggaaattacatgaaatatcctaattaataaatacaattgcctatccgagagctttatctccatcatggcaatcctcgtgaaacacgttgatcgattctagaaacatctttgaaaccattatcatcggaatcggctacatcacctctatcggctgtgtcggatgttatctgtccgatccatctcagtcgatgcagactccagccgatgccttcgtagccaatgcatgctctgttcttcgaatccatctctctaccgaatccgcctcgatttcaatatcgaatctggttcatatattaccaaatttggtcgtcaacagaatgcttccgatcaaaaatatccattgtcctattaaaatttaaaatgaaaattttaatttattacatttgttttatttttaaaatttatgttaaatttttctacactaattatttagtctcattagtttcataaaatgcatatactgtgcactcaaacaaaattttcaatcttttttcaagtttatattcaaaactaaagcatcaaggataaaaaaggacacttacaaccaaacgtaatagtgaaatgaagaaaaatgtaatggtaagggcatgtaagggatcaagctgaaatttcaggggtatagaagggatcggtaaatttcagagagtatgaaagagattgagtgagttttcaggggtacacaggaaatttattctatattgttttgcatcatatttgtaattttttttattgatagaactatgtttcttcataaatataatatttttatacttatctatatagttagtgaaaaattcttatatttatagtcggaggtagtagttctgaacatcattgttttttttttgaaaagcaaggtaagaaggttgtcttatatattcactggccgtgggagttaggattatccctgaccaaagaaagaaaggaattattcttgcaacagatatagctctgctagattcttcactcccttccgtaaaaaaaaaatcatttttccgtcaaaaaaaagattcttcactcccgcccacgccattacccacaaatgtgcttcctccttaattcttgccatgagcccgtgatggatcttgaagtgttagtgagatttctgaaaactcttgagtttctctccttcacaactctcgggagactatgataatcatcgacttgagagtactttctagggcatgttttgtgccgagatggttttccctcaccactcttgcacagttgcatggttcatccattctgttggtttgatgtgtagttgcaactaggagatcctcttagaaagacggtggtgagctagtaaatggactacaacgaggacaaaagacctcattttgctgaaaatcattgtgagcttctccgctcctatcctattaaatacgtagagctcttgctgttttagatggaattagtgttttctaatattgatagctttcttatgtagtactatcacatgtcattttttttagtaatggaataacgtacattttggcctttgctcagcaagctacattcaattattacaaagttcatacatgaataaactcagcacacactgatatagcataaaataaatataaactaataaatatcaacacaagataaaagaacccacaattactaaattctatttgagaatctccactcccaagcacatagcaatgctaactggttcttagtgtacgagtatataatactatgaatttttttaccctttgcacttctcattcatggatgaactgacaaagattgaacataagttattctctacaattttctacttttactactactcccttacatacacatctgaaagttgaaaatagatatactgactgataatctgcataaaggccccactcacacagtatatcaaccacaagaagttagcttcatagttcggtcattaaaatccatggccatactaaacatgataacctgttttccgacttcagtaaaaccaatgcagtactccaagccttcaacgaacacctaatttccaaaacttacaaaaagatacaccttccagtcttttgacactgttgatcccgccttccatttattacaatgcagaagcattccatcagtaaagtagcatgccatgtgaaattcataaaacagtggggtagaattttgaagttgaactgaccaccaacaaacagtatgcaattacagattacttgttttagctacaaggaccacagtaaattaatttccacactggcactgaagtgagattggtattaacttggtgatcgatgaacggaaatgagaagaactgatgattcttatttccctcctcacgcattaatgaaaaaaccatagtaataaaatgtcatgttcactagattcctatgggattttaaaattcatgaagttttgaaacttccgtttgattgacacacaaaaaaaacacaggaaaccaaaggaagaaaacatgagatgagatctcataattttttttcttcaaatttactctagaaaaatttgtgggaatcaattctttgtttcaaatgtcagtactttcataatatataaatcctgtagaaaatcccctctgtctaggccaccacctcatttgatcttgatctctctttcttttctcaattttttttccttttcttttcacgaataagctaaacgataggaccgttatatatacacttatttcatttaaatattccgtagtaacgtacaggtacaataataataaatatataggtaccccaaaagctgaaagagagtaagatggcgtcgtgatcgtcgttaagtgtacccggaccggacggcatcctggcggagatcctctggggctccgagcctccgaggccttgacctgcgccaactacggcctttgtgaatcaagatccggtgcagttattatagtgactgcaagttaggcagtcccgtccattcataaccgttggatcaagctgatgaacgacagatagctgtgccacgtcacaaccaagcagccaatgctacaataacatgctatagtgcgctacagtgttctggtcgaatctgatatgttcttttttgatctaacgatcacgcgaggactgctaaagttgcagtccacgttgcaaccgcaggtgatctcgatccggcctttgcttgcctctggtgactggtgggtggcgctgcccgccggtccgcgtgccaccgatcgcccatgcccctcctcggcatctgcctgctgggatgatctagcctaccgcgcgtacggcgcatcgtacgccgccggcgtccagcaagcccgtccacgccaaggcgacgcgcgtggtgacgaatcgatcggaagttcggaacagctgtagcctgtagcccgtggacgcatatggttcctgtgtgaccatccgaccacgggctcatgggttttccgtcaccacgatggacgcaaggtagagtttgatgcttgaatacttgtattttgtatagttgtatgcgctcttgtattttgtatatatagttatatgcgcttattgcgtgtgtatgaatctaagcaagaagaccttagtataatcttgtactgtataatctaagcattttctggatcgtacaaagctttatatattaggctctgttttgattccctgataaaaatttttaccctattatattgaatgtttagacacatgtatgaagtataaaatataaacgaaaaaataactaattatacagattgcgtgtaaattgagagatgaatcttttaaccctaattgctccatgatctgacaatgtggtgttacagtaaatatttgctaatgacggattaattaggcttaataaattcatctcacagtttacaggcggattctgtaatttgttttgttattagtctacgtttaatactttaaatgtatatccgtatattctatttgacacaacaaaactttacacccctagatctaaacacagtcttaatgtatcccatttccgttctgcaaataggtcgaacagaacatggcttttgtattgctgcaggctcttgaagttgagaccttcttgttgccttatgccgttgagtggaatgatccaaagaatcgcgagtgcatttactgaacactgctgcagtagtacccaagatgaagccatcatccgtgccttgctactgctagtctggctcttcgcgtcggagaaacgagaaaggtggagtttttcaccgtcggagaaagagcacatttgcctgtgctttgcctgcctgctgagctagtccattgtcaccgtgatttggctgtgtttagctcacgctaaaattgaaagtttggttgaaattcgaacgatgtaacgaaaaaatttaaagtttatgtgtgtaggaaagttttgatgtgatgaaaaagttagaagttttaagaaaaatttagatctaaacacggtgtttgttgaactggacacaagaaattcttccagaattagtgattcttcgtagtaccagtatcatcgtcttcatgccgtcctaaaagtgagaaaaggcttcccgatctggtgatacacgagttgaacaatcaacctgtactctttcgccgatcgattgctcctgacatgttttgggtagcagtacaataatactgcggtgatcaatgcagatctgtagctggcacagcgtcggggagattgtcgcgacgaacgcgcgatgttcgtgacggtgagttagctgcgagccacggcgctacgcaggagaaaatggtggctgcgccgtcgcgcggtgcgacccggaccgtgaaaaccgtatgtttatcatgaggattatcaaaaactaagaagattacggtacgcgataatcatgataactcacgctgttttgtaaaccactagccaatttgcacttagcattattatccaggagggcatacggatcggacgaccgatcatgacattagcgtccgatttacgtgcaaaactactttaaattgatttttctcttaaattacttatccaaatcatgatccgattgcaccattaaattcgttgcaattaaatcttcaaaacaagattacacatggatatattccgacgaaaaaagattagcttattattgaattttttataaatgttgcacgatgttccaccagctatatcggaattgtctcactaggtgattgaaaatgtttcactcgtttaaatcgggtgttgtttcaccttatataaaaacaatgtttcagcaaatagcgaaaaaatatttcagttcactgcaacattatatctatatatagtgaaacattgtgattacattaggtgaaacatttttcggtgaaacaaaaaataaaccaaattctcttaatagggggtttccaaaatatgtgggtttttttgttgcaatagaatatttcgttcactgcaacattagatctatacatagtaaaacattgtgagtacactaggtaaaatattttttatggaaaaaaataaaccaaatttccttaatagagagtttccaaaatatgtgcgttttttgttgcaaaagagtattttaattcactgcaacattagatctataaatagtgaaccattataaatacactaggtgaaacatctattgtggaaaaaggaaggaagaagtgtgtgggacaacaggtagcacgtgggggagaggcgcgcgtggggggagtgcttgatccggctccccccgcgccggtcgcccggcgacaagcattatcgttattacccaggtgttttaaccgaatgggtcgtgatgggctagatcgttacaggcccaagttggctgagaattaaaatcattcggcccgtcctcttttcttttttttttttgtctcgtgggccaaccggccgtcagaactcagaactgtgcgttccgtgaagaaattagacggggaaacagtaaaaagaagtagccattgattatttcatcgatctagatcttgccaatgttcatatcgatctcgatccgaagaagaacggcattgattggtgtgtcctgcatcgcctttttctttttctttctttctgaagactctgcatcagacatcagttctgtggaggtgaaaacagccaagaagaggcgagcatttggcttgttgtactgtaccaatgtaccgtttcatgtgctcttcgctggcgctgtgatgaaccaattgatgatcagctctaccgccttcaagttacatggagtttggtagtatacgttggtattccatggcgtgacagtgcctgtgcttttacaggagtatctcacattcagtcattcagacatattctcacccaaatgagaagctatgggagatgggaatgtgctttttacctagagaacatatttactccctccgtattaaatataaacatttctaacattcaaaatttatactgcaatataatcatttatgaggtactaattttaatacacgaaaatccatacattttcagccattcacgtacttgaggagatcatactataaaagagaatcttttttccttaacctcaatatatggtatttttcacgaacgcgcaaaatgattgcatgtcatatattagaataaaagagttatagttacatgatgcaatcagtcagaccggcttatgcaaagggaaggggaaaaaaagcaaaataagaagctggagcttaaaaaactacagcggctaaatacaaactccaagcagtaggaaggggctgagccacgctacactcccaacaggaccccaaaagcggcaacgccagctaaagactatagatagccctctgagtggatggactccagaaccactgagactaaagagagcgcagagtcgaaaaccctagagttccgtttcttccacagctgctaagagaccaggagcaccagggagtcgaagccagcacagagatgctcaagtaagcaggccctagaggacagccaccagtcctgtaaccagctgccacgggggagagagggcagcccagccaggaggtgacagcacacggagccaaacctgccgagcaaacacacagtcaaggaggatgtggttcgccgtctcaagatcctaagcacaaaaaaggtaggccaagtgactatcgatgctacacttatggaggagatcagccgtccagcagcgctgctagaatgcataccaaaggaagaacgtgtatttagcaggaccctttgcgtgccatagaagatcagcacaggcaaaggaatgctgaccatggaagaatgcctggtatgccgaacgcgcagagtagcgctggtcagacgtccaacgccaaacgagatgatactagtagaaatacttatattttagaacataaaaagtacaacacacagtagaaatattgttcacatgccctcgagagatattactcgagcatgttttatactgttttgcaaaagagagaaggagagcaatttttttactgaaaccgtgagtaccagattgatatatctacaacaaagcgataaaaataattttagaatatgattttatatttctgttcttagtggtataaaagctaagcctgaaaagataaataaaaaaactccgaaatcagctctaacataaatttctaaaatcaaattatggttacgacctaaatctgcaaccttattactacctccgtttcaggttataagactttctagtattgtccacattcacatatatatatatatatatatatatatatatatatatatatgggttacgctagaaagtcttataatataaaacgaggaagtagttcaatatgttatttgaaacgaacagcttggcttcaatacgaccgagagtcttgaaagaactactactattaagttctaaactcgtaatgctcgctacaagtacaatacaaaacctggcagaagtggtccgtatatgtacgtacaaatgctggtggttagcacgattaatggcgacggttcacctgctggcaggctaaccacaccgtcgtgtgatatgtgatgaagagtcttaactgtagttctcatcgatctgttgagtgttgactggtgaagtggtgattagggatgaaaacggtcggaaatagtcggaaatagtcggaaacggtattattattttattaactttttaaagacaaatagaaacagtcgtaaaattttcatatttatgaattcatcaacttcaatgccacgctgacagaaattaaaaaaactaaattttgaaaatagtaaccatcggtaaaaatattattattatattaattttacggaaacgatatcggtatggtcagaaaatttccataccgttttcattggtgattgcgtcaaaaaaaaagagtgttgacttgtggtggtggtggtgcttgaccacaatcagcttccttttcgggtctgttcactttgatgccattttcaatcttactaaattttggtaaagttgtcaacaaaaaatggctacgggccagtttggtttgcgacctaaattggccttaccaatttttggcaatgccaaattttggtaagttttggcatgacaaattttgggaaggtaaagttgtgtttggattgaagccaaaatagcctaagttaattattgaaatggcctattttcttaggcatgccaaaatttggcttcaaaccaaatagacactaaacactattaaaattgccaaatattggtaagccaaatttaggcctcaaaccaaaccagccctacatttagtttgctgccaaattttggtaactctataagaaatcatgtcaaaattttagtaagttgccaaaattttggcagctattccaaaattttggtaataccaaaatttggtaaggttttttttggcattaaagtgaacccttcttttttacaaaaaggctgcattgtcacaaaggccacgaatcagaaggcccggtctccgttgtgcggtctcccggcccaatatgcatgcggcgtaccaaacggatactactttactactctgaattttctctgaattttctgaagaaataagggtctcaaacgctcaaatggacgcagaggctgaggctctatttatggcgtcagccaacctgcaattgcgatcttttggtggtggcatactatgatcattcggtattttgatgactgatggatatgtgctaagacgtggagaaaagcaagataagataaagaaagcaagcaatgctagctgccacacacacacaaacagagcaaacagacagagagagcaaaacagaccaaacaaacagagagatcgaaagtgattagtgggtgtccggctgctcttcccctcagcctgcgctgcatgctgcagatgcgtcgtcgcgtcagcaggatggagatcgtcttcgtttgcttctgcaggagccgagcggaaatccctttctcctcctgctgctgctggtagcccgacctcatcaatcatcacaactcacaagcatcagagcaagccaggatggaattgtgaattttttgaggttttggaggttcagcttgagcacaatccaatcagctgctgatcgatgcgtcgtcattctctacggctgccactccagctaccagtcctgactttgcactgagtacctaccaagtaccaactgtttgatgtcagggctctgctccacgctcatcagctcatgcagtatgggcctcttcttcacaccaggctgctagccgcacaacataactaatcaatggcttaattgatcatcattgttgtttaaaggagaagattactcggattagctcacttgctatcaggcccgagaatattgattattggactttggagcaggcaggttactctgtcatgtaccagatgtcgctccgctttgtaagctattaacaacactggacggctcaccagacatgcatgattatcggtttagatggtaagtatactttatgctaataattatatgctcttgtccagataagatatgtctccagtaccaaacgggatttttgctaacgacaataagaagctaattaaatcagggcatcaggcataatttaggcttgaacttgggcagctatgtatggctgtgaaaataatcattttcattctctgatgaacaggtgtaatactcttcttacggtagtgattttcaggagacggtatgtacggataccgttaggctgtagacatcaacgatatctcgagacgactggcggcatctcgatcgatttgtgatgaggagaaaacaagctttcccatactgatccaacggaacagatgaacaaacacactttgccatcatctcgtttgattaatttctgatccattttcccctcataaataagccagcgcgacaattcgctgcatcagaactttccatcatctcgtctgattaatttctgatcgatttttccctcataaacaagccagcgcgacaattcgctgcatcagaacatagttaggtatggtgtatgtagcagtactatatagctttttatcacaacttgtaggagtaggactccaaggattggaagctttatccaacttggtacttattaaacacaacaactttatccaaagccgaatcgaggtcttagtacgctcgtattacagtaccatctcaaatcgagttttttttttgaacgaaatcctcatcgagatttatttgtttttgttctgcggaggaccacctatcatcatgtcaatcataagatgcacttgcaccaactatgatgacattacgcttcaactaatcctagctttatcaccccggctctcctctgttttcccccaaaaatagccctatgcttttgcaaaattacaagcataattggggtgttcatctcactatctcaggtatatatctactcccataattctgaaggccgcctaatttcagcatctgcttggtaggttgatttagcttataaacattgagcagacaaatttaagaaagggctttctttattagactgaaacatttctaaaattgaagtgaacaatcacgtgcggtggcttgtaagccggagctcaacgaatcaggtttacatgctacatccaatagatatccaactaacttgaaaagattgtggcaatgtagagaccaaatttgttagatttcacttactgaagggatatgttgttagatgacagtgccatcccagcttggttaggtgacttcatgcatgatagattgaaagcttgactgcttaacttagaaagctcaacaaactaagatgcgagttcaaatccagcaaagattagggatcgaaatttcggttgctaacggcatgggactgatggatggtattgaaacaaatcggcacatacgattcaaacttttaattaccaagatttcacatttgaatgatttgtgatattatttgaggttacaagcggatgaattaaatgctataaagttgaaaaatggattcaaacaaatttataagaattttatatattgaatgtttttaataactgaatgtctagaagctcggaaaacatgtgtatttgtccatcattccattccatgaaaaagaacagggcctcacatacgcttgttaaccctttctttcacgtgatgactttttggttggactttccaccctactactatctcattatgctacgctcgttccatccttttcatgaagaatggagttctagtggtacaaacaataattgctgtaagtcacaaactcataaatttgctaattcaccaattgcacgacaaactacactaaagttgaaaaataaactaaaacttgtatacttattattagcagattaaaaagcctaggtcgaaaaaagaagaaaacgaaaaacaacccaaaattaactctaaacttaagtttcaaaatctaaattaagctgcagtagtacatacgagtcaaacggtagtcaaatatacggcggtagtacggtggacttctccgggggtgctacatgcgacattacgaaatgacagggaccaacgtgcacaaaattctctgaaactactctgctcgctgctgtctcacactctctctctcccctcccttttcgtctctctcagatccgcgaccactcccatttcccccaaaaatcatcgcgagcgcgcgacccaaccaccgcctactggtcgccgccgccgccgccgccggtgaggagtaggaggaggaggaagcttcggtcggttggttgtcgggtgggggtggggcggagatggaggcggcgctggaggcggcgcgcgccaaggacacgaagcagcggctggccggggtggagcggctccacgaggcgctggaggccgcggcgaggcgagggctgacgtcgccgaggtgacgtcgctggtcgacgcctgcatggatctgaccaaggacggcaacttccgcgtcgcccagggcggcctgcaggcgctctccgccgccgcggtgctcgccggcgaccacttcaagatccacctcaacgccctcgtgcccgccgccgtcgagcggctgggcgacggcaagcagcccgtccgagacgccgccaggcagctgcttgtcaccctcatggaggtctggttctcttcgctgtgtcgccttctgctagcgacatcgtttgctcttaccggtttaggtttggggaaaatgcgggttcgattatgtgtatatttagttatgataaattactcttcgagcggaaaatctcaattcgtctgtgctttgatactgcatggacgccacttgcgggttaaatggcgtgggttaagtggatgatgagtggagctttggggttggcggccttgctcatttcgagctagattattagctgtaaatatattagttggccgtgatctaatggattatcgttaaatttaggtaaaaaaatgtgccatttggatttaagtgcagctgtgaaattgaatccttgaaatcattagcttgaactttctacaatatctgctttgtaaatgcatgcagtacataatttgagtttaaggaggtagttacttatttaggccaaatccattggctggttctgtaaattgaaaatgtcccttgcccttttaagattatggcttcaagccttgattgcaaactagtttagttgtgcactttgatcattcactgtagtttgaggatggcgatattggagtataatttattttggtaagtaagccgttgagcaaaattgcaatcacataactttcagggatatctttggatgcctttcagatggtcacattattggtgtgcgtagtcatgtttggtactatgttataccaacaattgttggtctccttgtaaggttatgcatttttttttgttcttaacaaaagagaccattgctatccactctttcccgcaatcaatattccaagggaatagtgatacttagttgaagcaggtgatagttactagttaaatgaacagactcgtgaactggactaaggctaaatattgtgacctgaacaaggctaaattcccaagttttcaggtgaatggaggcactagtttggagctcgttatattcctatgtgctattaatcaacaaatgctttcatgagtggatgaagatagaaatttggaggagaatatgtgcatatagatatacctaatttgttactgtattttgctttccagtggaaggatgttttagtctgctactctgcttcatgatatatgttttaaggtgcccagtgtagattttggagaagcagagacaacatttttactcctttaaaagatgacagtagtggtggttgtcgatctgccaccacatcttctctatactggattttcccttaaatttcttcaatattacacaatagtacttccacatgttaattctccttgtttgccattaagaaaaatcaaatttaatatggaacagcccaaaacgactgaattgtcatgtctataacacacacgcacacacaaaaggtgaaaatacatgtttgttcgaaaatcatattcacttattttggatatagaacatgtttgattatttttttccatagccaattaccaacacacagaatttagctagttgaacctatatttctccttttctgcatgctgcttcttttttactccctttgtctcaaaatatagctacctttagctatgaatttggacagagcccttcaaaatcaatgttttagttgcatttgaaacatggcattgcctgttgctaatttgctacaccattgaaaataaatacttatttgtactttgaatttaaaaaatgtccttggtggcttgagcttattttccaggctgtatattctcttgtatgcatggagatttctcatcttttgttggactgttgcttttccaatgttaatattcatttatattcttatggacctttatggttctgatattattttgcggggtatactaagctgtttttactctctacattctcaggtttcatcaccgacaatcattgttgaaagagctggaagttatgcatggactcacaagagctggagggtgcgggaagaatttgtacgcactgttgcaacagctgttggcctctttgcttctacagagctccctctacagcgagtgttgctttcacctgtatgtcaagataatttttatatttcaatctgttctgcttacaattattttgtttgcatgattgctaatggtagctgctacacttgtttggctttacaggtcctgcaattgctgaacgatttgaatcaaagtgttagagacgctgcaatctcatgtattgaggtgatccctttgcaaaatgttgtgcaactcacacttttgctatttgttcaaacttttcattgcatttttcaggggttttacccgcatgcaatgttcacactttgcacccttcatatgctaagtagattgtatagtaggtttactttcttctgttaccaagataatatatgcaatggatgcaaattattttgcacattttcttctgtgaactttccatttccaatatgcagtctctgctgtttaatccattcttcctttgaacaatgtttgaactagttaatataacagtggagtattacttctttattacttggatgctctctgggtaacaacattcactttagcctgggaccacttatctggatgcaaaaataagcaatactgattttgtgtggtcatgtgatttgcctatactcaaattctaggaagtggaatatgactgaagaaaagaatgtagaggtagccttcactttccattggtttggtacacggtagaccggataatcttgatgagtgaacctatgaataaaacgagaggaatgttagaatcatctgtattctgtagaatgaatgtgctacaagtttgataaaatgtgctacattatattttacttttgttcttttgaccaaactatattttgcttcatttattttttgccaatgtagaacctgttgactattcttcatctgtctttgcctgatgcagtgatgctctgacatatattttgttgaagtgctttctgtagcttaataatttacattatctattctcactgcaggagatgtatagaaacatgggatctcaattccatgaagagttgcagcgccataatctgccttcttacatggtaatccatgtggccaatctgatctccatcattattggttgctttcctgtcaaagttggattagtagtaaactgcgtgagcttgtcttatccttgcatgtgcaaatttaaggtaggcatcctgtcatatgctgattaatctttctttgcctttttttagctgaaggacataaattcaagattggataaaatagaaccaaaggctcgctcatctgatggtgctagaatgcaatataaggttattgaaagatctgtaagtgctaatgcaaaaagaggcagtccaaggaaaaaaagttcaacaagggaaagcacattatttggaggcaagttttacttttgaatttcctggaagctttgtttctattttgattaaaagtacaaatatgaaaaaaagtgttattggtttgtatcgacaaaattttaagtaatggctaagcataactggagattccatgctcttcgctgtaaattcctattcatctgagtggacttttttggagttccagatgattgttactagagcatgcaatcattactatgactttactctaaacaaatgttaggcccttcactatcttctcactgcggtcagctgccttattgtagctcctcttatactgggagtttacactattagctcttcttgattgtatggtcaatgattttaaactttttggaagaagtatgtgttaacacatataagtgttgatatagctctttcaaattgccaaatctattgccacaatttggtgctgatctaacaacgcaatattagcatcttttccatgcacagtgagtcagtgcttttttccacatgtcatttttcttatataatcatgcaactgtgatttagttggttcatgattttaaaattcttgcagagatcattggcagatgccacatgtagatcaagggaaacacatgtagtagatatacatgtttgttctatatgcatgctgatccttcacaaaattatactgatataggccttgaaagattttgcgtattaattgttggcaaatactgtacattcctgtttttgtgaaattcattttgatgtgttaaaatgcacctctttttaccaggtactcaaggtaaaaggcatgcactatagaaacaacatctttactttgcttagtttatacattagaggctttggattccaccattttagtaggagcttttgtagcaatttaggaaatttattagttattggtcagaagacagttcttttctggcaacattgggtctagacaaaacttatcatatgtgaagctttttatcattagcgacatcagcatattgatcatataccactggattttgtgccatttacaggtgactcagatattaccgaaaaaccagtggaacccataagagtacattcagagaaagaattacttagggagatggagaagattgcatctgcccttgatccagaaaaggactggtctatacgtattgccgcaatgcaaaggattgaagccttggtatatggaggttagatatttgtcactgctgtatctttttattgaacattggatagtgttgataagtagctttctttagaaagtatatgtcacaggcttgaagttcttccagcatgtaaaagttgaaaagggaactccagagatagatcatgttagtaacaaaaacagtgaaatagaactgaggtaaccaatcccctttttcaaagtcaaggggggaatgtggcattgctttgttacttaacttggtaacccaccaaccaaccatgattttgaatgccatattgataagttcatatcagatttaccaataatgatgcatatagctggtagaaattcattcaagaaagacaagctaagtgatgaaaataaatatattggaacagtgaaattaaatttctttacgtttataattttacagggatgttttaggtctcactgttgactgtacaaacatactgttacataattatgtattattccctttcttgttaacattgttttgcatgtttttgtttgaaataaactcttccttttatcaggtgcaattgattatccatcatttcttacgctcctgaagcagctagttcctcccttatctgctcagctgtctgaccgacggtctagcatagtaaaacaggtatttgatttaacaccaattcttgaggggctgtcaaattagttcatccaaaaatatttcattttagaagtacatgtgtgttatggaattctgttagaaaaaaaagaattcttattgaatttgcaatgactgaacaaaccttggtgagaaaaaattgctgaccaagtttttttccaggcatgccatctacttaatatgctatcaaaagaactccttggtgattttgaagcatgtgctgaaatatttattccggtaaccatagaagctgtttcagtgttttgcaacagtaagtcagtactcttatacttcctcagtagggctaacatactgatcaaattatcaggtacttttcaagcttgttgtgataactgtgcttgttattgctgaatccgccgacaactgcataaaaactgtgagatacctatattcttgtatgtaactgtggcacaacctctcagtactcatttttctttttgacaattattgtctttcagatcctgcggaactgcaaggtttcacgtattcttccacttatagctgacacggcaaagaatgatcgcagcgctatccttcgtgctaggtacttgtgtttagcattgtcttttttctcagtacctgtgatccttgtttattaaagccactcatgcctatttcctgctatgtcagatgtagtgagtatgccatcctaatattggaatattgggcagatgctcctgaaatacagcgtgcatctgatatatacgaagatctaataaaatgctgtgtggctgatgcaatgagtgaggtagggctaacaccatccatttttcctgacttaagtcaccataatgttcagtattaattattaaatgcctgaaaatttgttttgatgttattcttgtgccgtgttgcaaatgcaggtccgtgcaactgcaagatcttgctataggatgttcaccaagacatggcctgagcgctcacgtcggctttttatgtcatttgatcctgcagtacaaagggtatacgattatacttttctgcatgtttttccttgtaaagaactaaagatcaatcaaacattcaaagcattcctcataaagtttaggttgacatcttaaagtgctatggaggttgacttacatgtgctattgccttgtgttgccagtttaggaaaataagaggaaacattagctctgtgtaccatgtacctatcatcatatacctaagtcaataactttttatacctttctttggatcttactgaaggaaagctccagatatccttttgtaatatcttctgctagtttatttaagaatatatgccaaattatcatattcttaatttgcaaatacaattctgtatttggctattgctgtaagctcttgtaaagcagtgttcagtgtatatcaattacccatcccatgcatctgcatgtagcaaataggatgtttcaagcttactagttcaaggcagaggagtattctctcaagatgagttgcacacaccaacgagttcacccgaaagcttaaccttatagaggaggttgggcaatgtacttatatttcaatactccccctcacgtggaggccccctcaggcctcgcttgtggaaccaaagtgggctgcaacagttcattgcgctctaatactacattgagtttcatgcaccatacattcacctagaaccttaagcttatggagaagggcgagcaattcattcatatttcaggttttcaacaagttgcttgtactagttagttgtgctaggtatcctgtgtaaattctttcaagcctaaccttgcagcatacgcatttgaaagaaatgatttttgtataatgaaaatcgaccaaattatgaatgaaaaattatattttgttacagaaaaatgatattctgaactaaaatagtatggttatttgactctgctattacacagtataactgtttgtttgatctgataaatgcaagcacttgcagataataaatgatgaagacgggggcctgcagaaacggtatccttctccatcattgcgtgagaagggtgtccaactttctcatgcttcatctcatgcaagtggtacacatttagccggatacagcacttcagctattgttgcgatggacaagagtgcagctatttcttctgaatcatctctttcgtcaagaagtcttctgtcgcagtcaaagaaaataggtagaactgctgaaagaagcatagagagcgttctcagttcaagtaaacaaaaggtttctgccattgaaagtttattgaagggtgtaagcggccggcaaaatttctcagctatgcgctcaacaagcttggatcttggtattctttaagctgcttaattggagtttgctctttcattatgtagtttaaaattcttagctattgctttccgacttatattataaatacttaagaaatctcaatttcttttttcttttcctcctagtgcaggagttgatcctccatcctctcgtgatcctcctatcccacttgctgcaactgcttcggaccatctgtctttgcagaattccatattgctggattcatccctgccaagcattaataacacaagaaatggtggttcacgcttggtagatacagtgaaccctcatgtggccaataaagagaggtcaaggtcaccatatttgagtagtctgtcgtctgaatcaatatcaggatcgtcactgccttatgcgagaagctcttctgggaggtctccatatggtagcactatggaagagagtaatgatacatggtcaaccaggcggatgccacaaatgcagatggacagacactatcttgatatgacctatagggatgccagccacagaaatttacacaatcaccaagttccacacttccagaggcctcttaggaagcaagtggcatcaaggacatctgcaagttcgagacacagttttgatgatggccatatctcatctaatgacatgtcgcgatacacagatggtccaacttctataagcgatgcactctctgggggtcttagtgcaagttcagactgggtagctagagttacagcctttaattttattcagacactactgcaacaaggacagaaaggcattcaagaagttatgcagaattttgaaaaggtcatgaagttatttttccgttatttggatgatcctcatcacaaagttgcacaggcagctttctctacacttgcagatattattccagcttgcaagaagcaatttgagagctatgttgaaagaattttaccgtatgtattttcaagacttattgatccaaaggaattagttaggcaaccatgttcatcaaccttggaagttgttggccgcacatatcccattgacacattgctacctgctctagtacgttcactggatgaacaaaggtctccaaaagcaaaactggctgttcttgagtttgctaataagtcattcagcaggtacaaagtagactcagaaggttatagtaacagtggctttcttaagctatggctttcaaagctagcacctttaatacatgaaaagaatgcaaagttgaaggaaacttccatttctggaatcatagcagtttattctcattttgactcaacagcggttctaaattttattttaaatttgtctattgaagaacaaaaccttgtgaggcgagcactgaagcaatatactcctcgtatcgaggtcgatctggtaaattacttgcagagcaaaaaagaacgttcacgtcccaaatcttatgaccaagttgattttggaaattcttctgaagatggttatgcactgacaccaaagagtagttatgcatttgggcggttttctgctagttcccttgataatgcatcagggaagaagatgaatatggttcatggatcaatattccttgatatttctactggccgaacatcctctgatgtcagcattgataatgttaagcaatgtttcaaacctgaagctgaagttcttgcaacaagtagggaatcaaagaacattgctcgcacagttgtagaagctgcacgttcatggacagactatcctggaaaatcagatgctaccattgatgatgaaaattctactggtactcctcgtctggagtttggtcgtcttgctgtttctgatggacgtggtgctgttatttcaacttctgtggaagacgctcaagagggaaatccacttgtggagcttagttctgtgaagattaccccacacaccagtaatggccctagcatcccacaacttattcatcaggtacgcctgaaatatctcctttttccatcaactttgttagtaatactggtatgtgttaattttaccttttatcatcgtatacataaatgctacttttttttttatgtttctagataagcaatgtcagtgaagttactagtctagacaagcgggaggcattacaacagttggttacagcttccaccaataatgacaactctatatggactaaggtttgcaaccttacctttataatttcactttaattttataagaaaaaaaagtttcaatactatagctttgtttcatatgttcttttgttcatgtgaacttttctctttaattgggttaaacagctgcagtaaatgttttaggccattcaattatatagttctgcatctcatgctgcattccttttgtgactactagtatgagaataaatgagagtttctggagagagagagcatagttctgtgaagggatggagggaaaaagaatagcaggataatgttacgtgttatgtgagggaactcaaactgtttccattatcccattgattatgaaatactgttatactactatagcttaaaacatcaccattctagaacaatttgcctgatttatcttgatgcagtggttgctgaaaatgatgaatgcttcaccgtttcagtaacagtgaaaagaacctttttgattgtcattgttctatgaactgttcattgtgagtgttgttctccagaatgcatagctacagtctgttactcttgcagcttagttgacaggttttcatcattttatgctgcctttgtattgatagtatctttatcctgatatgggtcctctgtctcaatagtatttcaatcaaattttaacaaccatccttgaggtgttggatgactcggattcttctatcagggagctttctctatcgttagttgctgagatgctccacaaccaggtacgctgtccgcaaactgcatgcatgttgggtaatctagctggtagcttattgattaataatgtattttatcattctcagaaagatcctatggaagaatccattgagattgtccttgaaaagctcctacatgtgaccaaggatgtcgtggcgaaggtaaactttcctcatttaggaagccctcttgcttctgggctaatccctttttaatgccggtgcaggtttcaaatgaagcaaaccagtgcttaaatgtcgtgttggcaaaatatgatccttttagatgccttgctgtatgtacagagctcccttttttgtataaaagagtatatattaatgcaacactacttgtttacacttcttgttactagcagcttatacttttctttatctttgtgcttgcactgcaggttattgtacctttgttggttagtgatgatgaaaagatgcttgtcgtgtgtaccaactgtttgacaaaggtatcttagttacacgctttaattatcattgatgcaacaccaactccaaagataattgaataaaaacatcagacaatgaggagaagtaattgacctacatttaatttgtaataactttatatgtctatattcgtaaattcaaattcaaaataatctcaaaattctagattcctgaagtgttactagtacaatgaggcagtcattaatggtatttttatctctaataaggcctgtcacaacttgaatatcttggcaactaccaactaccgagttgattactggtgtaccttatacaactatttcattgaagcttcgttgctggtttacttgtgaatgagattaagtaaatattttttatattacaagaaacatgttagcttgtagagctgttccatctcatactggaattttattgttcatacataccatactaaccttatttggttgctggttttctcctggtaattttgcagcttgttggacgcctatcagaggaggaattaatgactcaactgccttcatttttaccagcactttttgatgctttcaataaccagagtccagatgttcgcaaggtgctttgcttgttctttgacactagtaatatgcccgtgcattgcaatgggcccatactactgagaatgggttgtggattagcctaaagcatgcaatttttttaaccaattgtttttttttgtttttgtccggggaattttctatttttatgtgggagcacgcgctgcgtgcgaggggaggacggatgactccacttttatgtagtagagagttttcatagggatatgctagtaaagaaggcaatagactgatagttaacatgatagaaacatggtaggcatgtaaagaaggcaatagactgatagttaacatgatagaaacatgtaaagaaggcaatagactgatagttaacatgatagaaacatggtaggcatgtgatagactgatagtaaagaaataagtacggaatccatttatacaacaaaagtttacttcatacacaggaacagtatggcccatttgtagtcattcctaaaattatttaaactgatttatcatgattgtttaaattggatatatgaaaatgatatgtttgggtttgttcgaatattatttccattatattataatttaccatgctctatgttagtgccatagtgcattctctattttgagtttctaataatatgtccatgtttggtcactgtcaattgcactttaatcacaagtgaccatctgcctgctgtctaccattgttatctggattatgtatcaatatgttttagataattaaattcattccagcctttgcttcacagaagctacgtgtaataatatatgactatgtgcacgtttaatacatatcacctttaaaaaaatgaatgttttgtgtttggaatctgatatcgtattcactttcttccagactgttgtattctgcttggtggatatctacattatgcttgggaaagcatttgtaccatatctagaggggcttaatagcacgcagctgcgcctagtaacaatctatgcaaacaggatatcacaggcaaggtctggtgcaccgattgatgctaaccactagatcatattgttttgtgtatcatatgggtatctctttggatgagctggtttcattcattcgatctgtatataacagacagatgccgttcatgtattgagcagttggcttttcgtgtgtgtatgtattccttttatttttgtttccttttccccttgtgtgcagaggcattgagttatgcgttaacttgtactaccatcacactgtacaaagataacaggatgtagctgactgttttcccttgtttacctgaggggtttgttggtgggcatatccttgtgctgtaaacattgggtgtgccggaaacagagaatttgctcaacagatccttgaatggttttgcttactactccttccttccatgaatgtttgacgctgtttgacttttttaaataatgtttgacgccgttggcttttttaaacatgtttgaccgttcgtcttattaaaaaacttttgtgaaatatgtaaagctatatgtatacataaaagtatatttaacaatgaatcaaatggtagaaaaagaatcaataattgctgaaattttttgaataagacaaacagttatacatgtttaaaaaagtcaacaacatttagggaaggagggagtacatgtgaaattatcgttggagattagacctcgagattgtttgcaactgaaatgtatgcattccaagtgcggggatccagatgctccaggtgacccggtcgagtctcctctacaatatttgtcatctaaagttggttactgatatgtggtgggtctgccggatatggggcttttatatgtggcagtactcccaaggtctcttgtgtttgctagatggtattggtagatatacaatgtcacgttctttgtcaatgctagtgctacatgcttacattcttcaaccgtattgatatcgttatgtaaaaaaaaagtttttgattgtttatgaatgtaaaatttagtttttctaatttttgcgggtatggtattgaagttgtcattaaatatactatatgaatataaaaaattcccaatcatacctgtactgttttcttaaaaaataataagagtaaattttacaaaactacacgttttttttatccaagttacagaaaaccacacactgacacttagcgtttaagtacatatattttggtagtgtagttttacaaaaccacactatcaatgaattgattcacctgtgatatggcgtggctgttccacttatgatgaggacatggcatcctattaccagccatcgcacaaaattaataggatgccatattctcgtcctaggtgtaacaaccacgtcatctcacaggtgaatccatttatttactaaaaaatatatatacttaagtgccaagtatcaaagtgtgtgtggttttttgcaacttgatcataaaacgtgcagttttgtgaaatttactcaaataataatgatgatttcgttttgacgttgtgaaatccctgggccctggcaccggacaagctaattctgtctccggtcgtcgtccctggaccgtgcacgtctgatcggacggctgagatgcgatcgacgtttttttaataaggctcgtggacgaatccgtaaggctgatactaacgcgaggaccaaacgagaaaattgccaaagggcgaaggcttttcctcgggttttggcgcgcaccgaccgaggcggcggcggaggcggtggcgatggatcgcctccggcgtcggaaccctaaaagtgtcccttccggctcctcttctatgaagcccccacggcccccgcgtggcccgtccttccaggccccagcggtgccgaggccccttccagagccctcctccccaggtatcgcccagctccatcggtggcgcttcttgtttctttctttcttggctttagggatctttttattgccggtgcatgatgcgagctaggttcgtggatcgaggtagaagtttctagtttctgggctggttgagttgggattgcgtgggattgggggttcgtgaatgaagtcgccgagttcaattaatccgcggttcaattctaaacaactcgcaatgcgattccttgcctcttgctgaatacaaaagagaggcgttcatggcttttatgtgtagatttgggatcatttcattggcaatttggtacgatttggtgttggtttaagatcgtgagccgctgatctccacttttaagtttttttaaaaaaaattaatctgccctttcaagaaaaatatttatttgttattagctatactgtttcggaattgatgagctttgatttctctataagtttctaataagcattttttttggggtgcctttgcttatagtcctcttgtagtctttgttaatttccagctaatttatccctaagtactatcatgttggttattgcaacctttattcaatgagattttctccagaaaattagtccgcatttctaatttgattaaatagttgagtatctaatgacaggtgggaggccaaggaaaagggttcgatttgctagtgaagccagcagtcatcagatatgcgtgagacaggatgctaacacaggcaaaagaccccaaggtacatttccatatggccctggcctcactgtaattcctttcttaacagtctggattttgataatcccctttaggtttcatgacgtatgaaaattctatcagaaggctacccatttccgtatcttcatgttgcgtgcttcggcttgcagggggattggtttgtctttcaaaatatattgtgggctccatgccattgtagtcttctcaatgttacagggtccttattttctcatccatattcccagttgtaataaccaaacagatctttctttgaggtgtggtgagttgcgcaatttccaagcatgaatcaatggtggatgaatgctacatatccctttgaagttcttttagtattttctgcaatgccatcagagggatgaagcatggaagcaccactctgtaaatattgctgttaaattgttgaggccatttgcttgttgttccttacgatagtgattttaatttacatttacatggttttctttgtgtttctatgtctttattctatttcacaatcattctccatgcaggttgtgatgcgaaaactactgaatacaaattctttaagaaattgtgggagcagtcaggctgtagacctcattctttctccaaacaaaacgaagaaaaacagatgggtttgtaactctgtatacatttccatagggtgtactatactcctgttctctttggcgctcttactaaatgacttgaaacagatcattcatatgtatcttatgtgatttttctgtgccttgtagaatcgcataatgtaatgccaggcagaaagctccctgcccagaagagcactttctcttctgaggagacccccgctacaccttgtaagaatgaagaaatctaccatgagcaagtcaatgcgaaagcttcccattctggttgaattcgttttctctgatctcctttagccatgaatgatgcagttttagactcttctaactattaattgtcttctctgcagaacatggcaataatgatacacctcagttgaacccacatgattacttgactgttcatgttcacacacccataactcaggtttcgtttgaagccgtaggaatttcaagaaacactggtgagacattttcatctttcaataagaaatacatagcatagtgactgactactatactgctgttgccggaaattgtcactatgatatatagacatttcctgtgtatggatgttaacttgttttagaaatgcactattttgtagggttatcattccatcataaataatggcgcccatggtagttgaggtttttcttatatacatatactctttgaatgaaaataacagaaattactatcaggcaaggcagtaatcctaggctctttgtattatttatgtttgttttcctcatgctgcctacgacacatcttttctgaagtgtgttggttgctgatatttggtctgcaaccgttggctgatacaagaacatgttactgattcaccatgcataaattagtattgcgagatacatatgattagaagtgttctcacagcaatttacgtctgctatatttatctaatgtgctaagctcatattcttttcacttttgatgatagacatagaaccttggagtggacggatcttttcagaaaagagaggaaaattattaaagctagctgcaaaaactatgtcaatggaaagttctgagtttttgcagagaaggttgacattacatattgaagaactcctttactttatattttcatgttgtccgataatggttggcctgatgacataaatttctcagatcagaattttttgctgacatcctgcaaaggctaggcgccaacagcatgataaaaaaggtatcctttgctgaacctatgtaatgcactatcacccactcaaaaatgtttgtctattatttacaagttccatgatttgatttgattttttttttttgctgtaatgtagcaccgtaaggagtccatgagaatgatgaaggtctgtggccatactcctactggcaccggatgccattttgaaaatatgcttgattacaggattagtgactttgatttgcgaactaaactgagaacagaaaaagagtcatcctcttatgcaacccaggaatcccgtcaattcatggctttgccatggggatacaatcagggcccttcaggttctcttgattggaaaattgatttacctcacaggggcaatgaagcacgtgagagcatggcattaccatgggtgcacactgtgggtcttccaaattctggttggaaaagagacactgctcacaaccaggtttctaatttgttgctagaggatgtccaaccacactccgaaggcaaactggcttcagctactgagttgaactgtaatgttgaaccaaggccatgcacttatcatggatgggtgcctatgttgtcacaaggattctctggatccattccaaatagatttttcaccccctgtcagattgaggagacacatgtggtaccatatgaaatatcaaacacttaccggcgacctgacccttgtaaccccttggaacaatgttttcctccagttggattggataggcaaggccaaaagcaggcaagattctctcataattatggtgctgaacttctagagcaatttacttctagttcagttggactggaaaggcaagaccaacatgggtcagaattagttaattttgacactggacttctatctagctttgatcagttatatgcaaaatgttctgcttcaagctttttggacactagaaatggaattctcaatcacagtgattttagctatatctccaacttagctgcaagtgagagcaacgatattgtgtcgaatgcaagcatgagttgtctgaattccatattttcaacttcagagcatccttttcaattgggctcaaagaggttgcatgaaacttctttggctggactggaggagaaatattcgaaggaggcagagatttttgataattctgatattgggcctatacaggaattggatcagttacctgcgaaattannnnnnnnnnnnnnnnnnnnnnnnnnnnnnnnnnnnnnnnnnnnnnnnnnnnnnn

SEQ ID NO: 27558 - DNA, 583 bp, Oryza sativa
  unsure (1)..(583): unsure at all n locations
aaggtccgcgacggagcgcagcgcgtacgggtcgccnagatgtcccatcgccgccatcgcgtgcggtccctgcagaaaaatcgagcgatcgcgggtgagtagccccgccgccgaggaatttcgtcgaacacgttgcgcgcggcggccggcgatcggagccgaaccggctcgatcacgatcaggaactcgcggacgaaccgagcgggcggaggcgcgcagcgtaggaagacgagaggcggagagggagaggcttgcttactgctggttggtggaaccggatttggaggggggggggggggatttggaccggaggagtcggagagatggcgagagagaggagcggctgcttcgcgagggaacgaaggtgggagaaggaatggcaggagaagccgcgcgcggataatgcctctggtgtctcgaggtgaggaggaggaggcggaggagatgagccgtggatgattgcaacggaaaggaatttcaaattctggtttgcgttagaagctggctcacgcctgttcgtgctagcgctactgtctcgatgcaggtaggagtagtccatttttctctacaacacgaaagcacc

SEQ ID NO: 27559 - DNA, 603 bp, Oryza sativa
acccaatgttcacagcacatggatatgcccaccaacaaaccccttatgtaaacaagggaaaacagtcagctacatcctgttatctttgtacagcgtgatggtagtacaagttaacgcataactcaatgcctctgcacacagggggaaaaggaaacaaaaataaaaggaatacatacacacacgaaaagccaactgctcaatacatgaacggcatctgtctgttatatacagatcgaatgaatgaaaccagctcatccaaagagatacccatatgatacacaaaacaatatgatctagtggttagcatcaatcggtgcaccaaaccttgccttgtgatatcctgttgcatagattgatactaggcgcagctgcgtgctattaagcccctctagatatggtacaaatgctttctcaagcataatgtagatatccaccaagcagaatacaacagtctgaaagaaagtgaatacgatatcagattccaacacaggacattcatttttttaaaggtgatatgtattaacgtgcacataagcatatattattacacgtagcttctgtaaacaaaagctggaatgaatttaattatttaaaacatattga

SEQ ID NO: 27560 - DNA, 693 bp, Oryza sativa
  unsure (1)..(693): unsure at all n locations
nnnnnnnnnnnnnnnnnnnnnnnnnnnnnnnnnnnnnnnnnnnnnnnnnnnnnnnnnnnnnnnnnnnnnnnnatgatgcgagctaggttcgtggatcccggtagaagtttctagtttctgggctggttgagttgggattgcgtgggattgggggttcgtgaatgaagtcgccgagttcaattaatccgcggttcaattctaaacaactcgcaatgcgattccttgcctcttgctgaatacaaaagagaggcgttcatggcttttatgtgtagatttgggatcatttcattggcaatttggtacgatttggtgttggtttaagatcgtgagccgctgatctccacttttaagtttttttaaaaaaaattaatctgccctttcaagaaaaatatttatttgttattagctatactgtttcggaattgatgagctttgatttctctataagtttctaataagcattttttttggggtgcctttgcttatagtcctcttgtagtctttgttaatttccagctaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27561 - DNA, 8383 bp, Oryza sativa
catctgttttacttgttgctagcaatggttgtaagatacaaatattgaattgtaaatcttcagccgaagggtcaaaagctcaaaggtaaatccccgagctctgcctgcctgaggtcaattttccaagcttttttgactgaagctttttaccccccgacatgtgatgttttctttcaagaaattccaacgggatcaagaactatgctaaacagtatcgggccacagtaaaaggctacatattctctgcacaaggccgcacagctcaattcctgctttccttggaagtatttgggcgaccagactgaactttttaccagcactccagagttatcgtctgacattagtatggtacaaacgcctccaaggtaccgttcaatcgttcatatcacacaagcttcttggtgaatcgatagtttcttgagatgctttttacatgcaaggagttgtcaagatgcttggtacttgagctattacgttcattcaggaaaaaaaaagggagagaaggaattttgaactagcactaaagataacaaaggatagagtgagataacaacccaagaatcaatctcagctccaagaaagaaatattgccgatatagtaaacttatagtgaaactgatcataactagtgggacaacatgaaatgcaactggcaacgtggtgggacaagtttttacctttccagttttcacccatggaatcaactgacctgtagcggttaccgcagaagctccactactcatatcgtttttactcccaaactggacgctaaatcggagaggaaaaaaaatgtgtagattcatgtagcctcatatgcttccctgaccctgcaactgtactgcgaattgccgtagagttgccgagttgggcagggagatcgatggaatggtgctcctggccataaaaaaaacaggtccagcaattgattgccttcgatcccaatgctagttaattttatctctccggtggcctccctacgtgacaaaacgatgttgcaataattgacatgctcatgacagaatgatcttgcaataactgccgtgcgtgcaccttgcctcagtgaaggcgcattgaagttcttattttggagttggtacgtggtataaatgtataataaaatccaatgaacatgctgcttttgttttatgactatgaacatgttgttagaaatgtcaaaaatggtcaattgaatgctcccaagaagatagcaaacagggtttacaattcctacatgctcttccgtttcgggcactggcggaattcgaaatttcgcgaaatccggtggaaaaccggtaaattccgaacaaatttcataaaccaaaatttaaatacaaattccctaagttgccgacaagttctcaaaaaccggttggttttggcgaaattctaaccgaaatcatcgaaattttgatcagtaatttgtaatagaggtaatttcctgaaattctttttttttcatgatgaaaatttcagtaaatacacacaatacatcatttttttaaaaaaattatatcccaataggttctatgaatatcatagtatttataagattttatttgattttttcttttttatcaatttatatttgaatttggataaaacttctcgaaatctcaaacagtttctactttcaagcctcgtcggaacgtcgaaatttcgcttaatccgattggatttcgtcggaatcgtaaaccctgatagcaaaccaaacatattctttggactttcatgctctttgcatggaattttggacttggttggtttgtgccaaaggccctgtttgggggagcttgtcccaactatagcttttcccaaaaagctgcttctactagaagctaccccaaacagtccacagcttctaagaatctgtagttacagattctgaaaaataaactaagaagctgggtttcagagctcttccagattctcagaagctggctaccaaacagctgcttctcagaatctaaaagcttccccaaacagacccaaacttacccaagccaaaacaattggcaatgccaaaaaataatcattcacttggtttatgtaaaggtttatgccaaaaaaattgacaaagtgattaggaaatggcctttatttcctgatgcgtacggatgtaccttgcctgcttggcatgcttggtagattcattcaatcgagaacctaaacaagtaaccgcaccagtgtatgacacgaaaaaaacacaacacgtttccatcttactgccataacattgaactatatagaacttgtggtagctcaccatcaagctgcacatcaatgttctcctcccccatcgtcatcatggcagcggtggactagctagcttcggttccgcgcgtcccatcaccatcagcatcgatcgccggcatcttcaggtgtcacgggtgctagtttttttttttcccctggtgatcgtttgtccactatcctaacacgcgccactgttgtacacataaaccgccttctcttctcccccgctgcatcgcacgatttcgcaacgacgatcatacgattattccctctccctctacgtcgcctgctgcacaacggaacaaacagccgttttcatgttcgcgcccgcctactcgtcccagctcgtcctgagtcctgacactggcttgggctgacgcgtcatgtacatgttctcatacaatttgttcggaataaaatcctgtggcgctgtgcatatggctggctggctctggctcggctggacctgaatacgtacgtacgtatctgacatgcactggtgcacggtccgcagcctacaggtaggcagcggtattttaaaaaaactcgcgatttgatcttgacccctcctcattaattcccgaaaggcacgggtccagccagccgggaaagcgcctgcctctgccctgccctgccgcgcgcagagaaaaagaaaaaaaaagagaagaggctacgctacgattcgatgcttatagccatgtgaccggcgggcagccggccgggcatcgctgatgcacgcagatgccgcgacagtggaagcggcgtcgcctgccgttggtcatggctcgcgtcgcgcactcgcgctgctctgctccgtctcatcgtccggcccggcgcgacgtcgcgtagcgggaggcaacattcgcgcgcgcggatatgccttcctctgctctgccgcgcctgctactgctgctggtggtagccgtggcggtggcggttggtggggagggttttgggtttagcggccgagtgagcggggcgcgcggtgcggacggtgtggctgtggatgacgggcgctgcgtgcactgtgcgcgtactgtttgatccactgtgcgcgcgcgcggggcatgcgccgctatagctagccgcctagccgcgcctgcgcggagaggggggccgggggcggggggcatctgttgcgcgggcagcaggtggcgtcgtgtgttggaccgtggcgtggcgcggcgtgcgcagcgacaaatgttaagggacggtgcctaactggatggaaacggataggtggcagaggtgttcgcgggtcgtgtgactcgtgagcgccgagccgccgaggcgtggggtggggtgggcttgtgggcttgtggccgtgtggtggttgtctggttgatcttcttgtgggaagaatggcgcgcggttacgttttgctcgtctgtttattccctttgcttaaagtaaggacaaattagttctgtttgtaaatagcacttgtagtacaaagtttttattatattgatactgttgttgtagaaaaggctaatgcacgaacgccttggctttacttttttttttctccctcgagcgaatgctgtgctttcctttctagcgtatgcaccgtcgccgaacttttatacaccgacagtttcttacaattactctcatgccactaattatgtcgtgttgtgtaatttctcttccattggcgctaatttcagtcctgcatttgatatggtccttatatttatatttatgattatctcttttgtttgtgatagataacataattgtcaatagtgagttgtatgtgataacttcataaattttagaaaatactggtacattttcaaaaaatttataagcgatataatatacgagtagatactaatatttatagaagggagtgcgcatgtatatataagcatatgtaccgtgtttaaataaaaataacgatacgttatagagcgacatctccatccagtggacggttgcttaggcttttctacgtagtcctgataaaaatgttgttggtttcatcactggtactatatcacacatttattgagactaatggatcatgtcttttaagaaaaaaaatcaccttaatttggaaacacatgtacttaagaacatactccattcgttctctaatacaagggattttaacattttgcttacactgtttgactattcatcttctttaaaaaaattttaggattattatttatttattttgatttactttattatccaaaatactttaagcacaacttttcattttttttatatttgcacaaattttttgaataagacgagtgatcaaacagtgtaatacataccaaaatcccttatattataggacggagagagtagtagtctagttaatgtttcacaaaaagaatgacatagcagttaataaaaagagaatgacatagcagctactcccttaatctatttttgatatgcatatttccaaatctgaaaaatttatttttgatagacatatttcaatccaacaacctattctcttaatgactttttcggatttgatgcgtgactctccatttttccacacaagattggctacatggcatcgagaaatgtaaatattaatgaatcgcttgtttacgagaaataactagtagcatgtttaaatggatgataaatagaattacttatctttgatttatgtgtcaagataaatatgacattcgaaagtagatcgaaagtagatggagggagtaataaaaagtcttcacacaaaaaatgaaggaaaaagaacgcacgagaatatccttcgatccaatcccagtaagaacgcacgagaatatccttcgatccaatcccagtgaccaccaacttctggtttttgttagttaaggcgatccatggcgcgcgcgcgcacgtacgcagcccacgacgcgccacgggccagaagcacagctgcacaagcaacaaacaagcgaacgccccgcccccgcgaagaaaagaacggcaaacaaacggctcgcaaaggctttttccgcatatcccactagtcccacactctccactctactccactctgcttcactgtctcctccgctccgttgcttaccccctcccaaaacccaccgccgccgccgcctccgccgcgcaagccaagctgctccctcccctccccggccgccggcggcggccaagaatgctccgctgccgcatcaccccaggtgtgcatactagcgattctctctctctctctggatcacaggctcacttaacttcgggcctttcttgtgccgggattcccatgggatgggatgtgatgtgatgtgcctggttggatttgggttgtgctggatggaaaatgccagcattctgtttcatttggtggagctttggtatgcaggattaggcattgtttgggctgtgcattttttttttctcccgtattcggtttgtgatatcaatactggaaactcaatgtgtgctacatttgatttgattgtcatctgggaagtggcaaatgcaatttttctaggggtgtccgacatacgatttggggataacttgtgtcagtcaagaaaatgcaccataaataaaatggaatgccagctgttatacaaggtctagtcatgatgaacattcgtcggtttggcataaacatcacacctgtttgatcaaatttccaaactcttcatgaaattcgtaaatttccagtgaggaatagaacaaaaacagcgcagatcaccagacctcgaagtctctcttatctgcaagattctttggatgctttcctgtaccctctggttgtaatgtcgtgttctggtttttgtaattacttcagtgttgtgcacttctttttgtaacagtggaatctagttacactcagcaagccaagcttagattttggtgttttttaacctgcgaaagactacagacctgaggaattgtctcggttgcagtgctcatttggacatgtataaacctaaacatctcggtagtttcacccattgttgttttctattctacgtggagtacatctcctcctttactttttacagtctttttttcctccccccctccccctaattctcttccactgtcaagattcgaaattctgacgaattttcctgataaattctgaagcctttggaacgatgtctacagagattcctctgtcgcctgtacgtagagtagaaatcctgggtattttgtacttgctcggtttctgttctgtttcgtgttttcacatttgtctgatctaaagacatggtaaaatacgccttcctacctctcataactgatttttatttctgacagaaaatacagtctttcagagattatgtttttgctgcaagattccttttggaagtatgtacgatcttgttagtgccatgggtccatatttttttgtaattgtttctgctcatatgcttttatcctgtccttttttctcccgccttattcttttctatgttgccaagtgctgccatgtccccgtcgaatcttatcgttctgctcgccatttctcatttcttgtgattttatacaagaacagaccatgaactgtgctacctctttcaccaatctgccttacaagtgcctgcagaattccagcttttaagcatgtgtctcttgaaattttgtggaaagagggcatcttgctacagcaatatctcagaatcatgtcccctaagtacaaaccctaagtgctttaaattctgagagcttttcagatatattcaccgtgctcatcaatgccagccactacccactagtatctgaaatggttcctgtaattaagttaggtcacttggctttagtttgtggaaaattaaaatcacacatggttcatgggatgtcactattttcaggattccatactccagaagattgagttgcagctacctattgccagaaggcaatcaatttgttgagggatgtctggagcaaagccagctatgggtcaaactcaaggagatggtatgtatatttatgtgggtattttattagagggatttgagggttttccataaatttcaatatttcttgccattatatcaaattattatgcccttcagtacttattcttcttcattttctcttttttgaaacagaaatttggcacttcttgaatgtgttctacatctagttagttctatgttatgtgtgggaaattggatatgctatgcatctggaaatattagctagggccattgggccaatactttgcagtattgctctatcaaaggccatttttctctatttggggggggggggggggggggattacacaacattgtattattcttacgctcttccaagataatgagatgttttggcagttttgctattcctttttatttctcgcttcattttgcttttgtggatctttagttttttcgggtatatctctaaggtttgtgctatttgcagaacatacataattttaaattttaatcctttcaggttgtcctgtccaacagatctattcatatttggagaaagccactgactctgacaaatttcatgcggacagaaaacctgtgagcatcctgtggcatacctttcttctgtgtggttaacttaggctcctctactcctatgtgacaattttattttgatatgaaatgtggtagaaataattttgagaataaaaggcacatgaaaatgaagtgtaaaactatatgtagtgcaatatgcttatgccattaaactatgctgatccagctagtattttttttcattcctgtgatgattcttgctcttttttttattattaatatgggtttctctgcaggcaccttgtgatggttcttcacgtagaaaatcaaatgcaacttcattaaaagtgttattagcaaaagagatgactaaagaagtggaattaaagagaaagccaccaggtgtcgttgcccgattaatgggccttgaggaggatctacctgctaatggaccagttttacaccaggccaaaagtggttcaggaaaagtcaatcatgtaaccagttaaaagcactaaacaaagacttaaagcaacaagagcagcatcgtctcataaagtcaacgacacaagatatccacccattttgtcaggaagcagttcaatataatgatgtgtatgaagtatctgaagcacaaacacggatgagctattttcaggacaaaatttcgcagaaaggagggtcttctggga

SEQ ID NO: 27562 - DNA, 7467 bp, Oryza sativa
  unsure (1)..(7467): unsure at all n locations
cccagtgatttcaagggtagcattggatgccaatggggcaaccctacgatctacaaaagtagagcctggtatcattcatacccagcaagatggctgtcataaagagatgaatcttttttatcttcctcatactcaaatgaatatgaagaagatgaaggttcattaggtgattcagaaattgatcagaacagtgattctgatattgattatattaaagatgaaggtgacagcttcagtgactcaggggatgtagtcctgtgtcaaagcgaacatggcattataccaaaaaacatggaaatccctatctgggatcgtcttttagcaagatctcccactttgctgagtcatcagttactaaggaagccaaggcacggctttcagagcgatgggcaactgtaacttgtgatgagatcagtcaagagcaagtagaattgccaaggagcacatccccttaggagagatgctctcccttcaggatgtgaagaatgataatttcatcaatgagttaccttctgtttctaccagtcgctgttatgacagagaaaatgaactacctactcaagctaaatatgcaactgcttgtaggaaagatgaaaaaaatggtgagagacctatggggttgccaagatcaacatctgttcctctgattccatccacgcttaataacatggtggcaaatgtgaaaacttcaaatcatcagggccatgaaagaacaaaacatattgtcgcatcaaataaagaaaaatcatttttcaggggtagagtttcagatttcttctttccaagaagtaaaagaacaacaaggcagatatctgccaatcatacatctgatttgtcttcagggaatactgaagactgtggcggtgatagtcaacaagatgccaaccatgatttggatggtaatgaaaaatccaccatttgtgaggacatacttgatatttgtgctgtgcaatcaaccagcacttcagaggtaggcacttcatctcatctatcttgcaagccaaatcttatgttcttttcatatagctgggtaattgatatgggcacatttattcttgagctatgacatcctttcttccatttgtaagaaatatttgttcaatgcatttgttcggccacagagaatttgatgagaaattttattacagggaacaactgctttaactgatgtacctgcatcattggattgtcgaagtggaaacctgaataaactaggactgaatgaggtcctaaatagtacacgcgaccaacccagccctacgtcagttcttgatgcaccctctgaagatagcagttgtaatgaacctgaatcatctgcaagcactacatcaaaaaatgctagtaagtctagtttccagcctagagttcttcaagtctcagattggttagtttatatactgacatttctgcttaactttcttcagaagctgtctcaagatcttcagcaattgaggctgttgcttgttccttatcatgggacgacaccacttcagaatcagcattacctggcacccgagggcagtcttcttttctccctgatgtagatgacgatgaatcggaatgccatgttcttgtgcaaaatataatgtcgtctgctggattagacgatgcgcagtcgagtatgcttttcactggctggcatttacctgactgtcctcttgatccgattctgttcaacaaagtcttggagcttcgggagcaaagttcataccaaaggcttcttttcgattgtgtcaatgttgctcttgttgagatcggcgagaacaccttgctaagtacattcccatggagcaaagcacactcaagaacatggatggacgcctcctctcctgcattggggatagaagtctggagcatcctgaaagattggatttacggggcacggatgttcgtggtgagcaggagagataatgctgggatcatgatagagagagttgtgaagcaggaggttgaaggaacaggctgggtgaaaacgatgaggacgcagttggttgacattaccgagcaaattgagggtggagtctgggaggagctcgtgggagaagctgtgctggattttgttcctgcctgtcaacgatgatatgtctttgcaagttacaactgatgaatttctcccctttttttgtacactgtttatgtcattttacgccagaaacaaatgtgtactcgcttcgtctcaaaataaatcaacttctgtaattcaaactttgtcccaaaataaatcaacttctattttcttatctactctcggttcgcaaatcgaaaaattttatttcttaataccccttgccacctacccaccaatactaatttattatcaataaagggtattttggtcttttatcctcctttaattttacattggaatgttaggaggtgcttcattgtgagacagagggagtatgtatttctagctgattggaagcttgtagtagcattttaaacttttgataaactagcaaaaatacccgtgcgttacaacgggtaaataaattctaatgataatatacatttttcatgcataatcatgtcaatgataatgtttatattttaatgagcggcttgtttttttataaacggtgtattttttttcttgtgcgattttctcaaaccatttttcagaaatagtgtatttctttctaacagtttcttcctagcatgttttcttttttaattttttttaccgacgacgaaaaccatatgtttctcccttttttgcttttcttttctcgtgtgttttttgccggtttttcttgacaattattttctcgcgcgttttttgcttccttttttttaatgttcatttttttgcttttttccaatacagaagaatatatgacgaaataaaagccgtgtagtagatggcaaaaaatcgatggatcctatccgactcaagcgtccatcaatttagcgttttttttttctgacaggtttttcggagcgatttgtttttttaatagacggtgtttttttcttgcgtgttttttcaaatcattttttagaaatggcgcattttttcttacagttttttcctcgtatgttttttttaaaaaaattaccgacgatggaaataatatttctcgcacgtttttttatggaagatggaaaacctttttagcatttttttgcgctttttctgacttttttctcacgcatttttttgaactgtttttatttttctcgtgtattttctctttttaaatagttagattagattagagatagagaagagatatatactgattagaaatcggaatttgttttgccctttctatttttttctcgcgcgtattttttattttgtatgaactagctttttattttttacgaaccctttttttcgccactttcttagggaattggacgaaattttttagatgttttttcagattttctcacctttataggaatcagacttcatttttccgtttttaaagtaatcggatctagcctttatttttcaccacttttttttttgccttttataggaatcggatctacggtttttttcgccacttaggggaaacaaaattttattgttgttgtttctcttttttgcagtttttctttttctttttctttttctttttatgcacctgtctgtcattgttctctcccttttattattttttcttaaaaaaacgatctcaagtatcttattgcaagattatagggactcaagtgtaaatataaaaattacagggactcaaatagaaaagtacaaacccaaaaattaaaatcatataaaaatggaatgctctcctccggtaggttccgtttttgcaaacatattttcaatccggcacatcaattttttttcaccaagatgtatgggatatcacggtatagattgaaaccgagaggactgtgcctgggatctcggactcaaactgagaccgagaggagtggtgtgttttattttctgtttttaaggggagaatcggatttagagtcggacttttttttttcgtttctgagagggagtcggacttttttttttggctatttattttgttttgacggatgaaggaaacatttctttttttaagtaaaatagtaagagattttgcaatagtataatcaaagttttttttgcataatttattagtggacatcgaaaaacgtgacatagctgaagaatatattttagaaaattggtaatttgctttgagacaaaatatttgattaaatcaagttaaaccgtgaggtactgatgctagaaatggactaatcacgggggttagaagtaaacctttaattagtactagacgttaagttaaacattgacgtgtcaacaaataattggtcccgcacgttgttgcgtgctgaggagtgggaccctcctgcctgcgagcggactctcctagagttgaaaggcgggtggggtttttggccgccgatcgccggcggcgtcggcctccgttctcaacctcaagcctacctgcattccccacctagggcaccttcagaatccggcgatcggcgagcttctgcggcgtcaagccgtatccgcgtcgcgtgcctctgccgccgccgccctctcccctactgcgcccgcccccagccctccgcctccgcgtcggcgggacgaatcaaacagcggtcgcgtttgtcttggcagcaggggacgcatcacggcggaaaaccctaggtacgcgtttgccttgatatgttgctgcttgctataaactcgattcgtgcgtactggaatctttccgtccggttttgctgttgattatttaggcacccttgcgtcaaaaaaattccagtacgctccatttctagggcactggttatagaagaagcgaaacgaaagttattgacctcttgcgatgtgaaacggggtacataatcaggggtaaacaatccgcttgtttttttgataaagattgtcggttcttgtgaagatttctattgcttttcttgatggagatcctaatgttatttctaagttacacgctaattgttattttttcccctttgctgttgctggctctaaacttcattaattagacttataagcatatagcagaattgtacatttcttgaaaactaggatatgttgttattgtatggtttttgggcccggtttttcttataaactaggtcaattctcttcttctaaatataaaagtggaacaaagttccgccttaggtttttttttaaaaaaaaagatctgttgttatcgacggtactgcaattaatactactatactagccagttctttcttttcttttctctcacacctcacagtttcttcatatttgtccagaatttttttttgttagtagatgtttcagacatctcttaaatgcgaggaaatgtcggtacagtggcagtactgtgtgtttctttaaaaacgaagtaatcacaagatgtttgtacatatttattgatatatgggtgcatatcacacatgcaccttcattatctattccactattccaagtttaaattgtttgagatgaagcagcagtacaaggagaagctgaacagtgcagtgttttgaccagacaccaacggaaagctcaagtacattgtacaggcacatcaccccctctatcctctccaagcatctgaaggtatgtgtttgtacatatttagtttgattcaagagtatgtgtcactattgctttatctgcagtttgttgcttactaagcatgtacatgaattctgagtcagtataatatttcaagaatataatgtgtgcgatttggctgcctagggatttggaatacgcaaatggattgcgaatcattgtattacttttatatgttggtcagcaaaagccaaaagaaccagaaaaaataaaagaagggaaaaattactggagggattaggctatatcattgttgagatgttacattgtagttgagtaattatttaatttgttggtggatttatttttctgtgtataaaaaagctaagttgattacatctgtgtgtttaataatgttgtcgatattttgattgcagtgatatatccaacacaacttgtctatcagctcgtttctaattcagaatgggtgatgaacagtcatttggagtgtatgacatgccatccgaactgctatttactttagacctgaagttaactcatgctaatgacttcagtgctatcctgagatcatctacccaaaaaattgataaagcccgcaaagaacttaagcgcaggttcagaaggattgtgaagggtactggttccaagagaaaggaattctgtattaccccagaagggattgaagtctttgctgtagcctttactgatggtgcttcaactgtactgcccatagtgcaaggaaaaaacatgtggatgagagaatttagaactgctgatggccaaatctatgaatttgacgataaggaggagatgcagatgctgaagggttctataaatgagaaaggtaaaccaagggaggagggtattatagaggcccagaagcgtgagaagatggataagaaaaccaagcaaagagacaagtatgaattagcaagttcaagcaaggaacatgtggtgaaggaaaatgcgccaccaaggccaaagaagtatattaaaggctcaatacttctacaacacaacagcaactatggtgaccttgtaggcaaagaaccaaatgaattgtcacgttttcaggtgggatatagcgtaatgaaaaacatggtccaggatttggcacattttgaccgatacaattactcagcaaaacacaagagagcaatggcagccctgatcattttctcagcagaaagtttgaaaaacagctacatatctcgtcttattttgaaatctttgaattcaagggttggtgcacagctccaaccattgggctatgtgggggcaactcatatcaatggctgggcaagtgcatccagattgatcttaagatctcttcatatcgcagcaaaagtatgggatttccaggagcaagctcttgtcaaaagcaaggaattctatgcagacgattgctggacaacagatccaaatttggcaataaaacacattgagtttatcaagggggatgcatttcctggaagtaaacttgctgttaaggatcgtgaacttgttgctttatcaggttgtttgcacgcttctgttggagttgtagtaatgggtggaataaatcgcgtgttggaacatcattcaaatataccatgtgcagcccagattgcactccaagcgagctctttgtccacagcagttcagattgttgaaggggaacttcctattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27563 - DNA, 651 bp, Oryza sativa
  unsure (1)..(651): unsure at all n locations
nnnnnnnnnnnnnnnnnnnnnnnnnnnnnnnnnnnnnnnnattaaactcattattgcaaccagttttgctctaaactcaactacaataaatccaatgatatctaaaatagatgcagcacggcggagtaatatgttgtatatagattggagagcaaagaagacgaaatttagcatatgttagtatgtacaataaaaataaccagaagaaagaaaataacagaaaaaaaaataatccactcactttccacatccaattcaacagccttgtaacttgctgccagctctgccagcaatcgcttcactcgggcgcagaaagggcaataagtcttgctatggccagtccaggaagaggaatgacacgaagaaagatcaaaattggagtttaggacagcataggtcacaattttgcagaagtagggagataatcatgttaaactctgttttatatgattgcttgattgggtttaatttgcatgatgtaatatggtgtatacagacaaaagtaacaattatttctcatttctttcagaagctacttaaaaagtgagcgcatattaaatcaactcgttccacattatacctgtgcatttcttacaaacaaaatatttcgatttcattatcagcagacaacgacgtgatacaatggtaaca

SEQ ID NO: 27564 - DNA, 546 bp, Oryza sativa
  unsure (1)..(546): unsure at all n locations
nnnnnnnnnnnnnnnnnnnnnnnnnnnnnnnnnctgggtggcttagggaggtatgaacaaaccggcaagtcataaatcggcaatagtgagctccgactggatcttactcctcagtttatcaaatttagtttcattcccttgtaaccttattccagttgtttcaactttctattgttcccccttacaaaggtcattgcaattgtatcttgtggaagcagataagaagttgtctcggtgtaatcttgttttgtggagtcaaatgtttgcttgtgtgttgcttgggaatattttatccgagatgctcatatttaccttgaaagatagcattattgttatatcttcttttacatcaagttatttcctttcgttcgaaaaaaaaatgcataaagttatttgcacgaagagacaggattatgtgaggtcggtgttggaagtacttaaggctctgtagcttcagtcataaatttttttgcttctgatnnnnnnnnnnnnnnnnnnnnnnnnnnnnnnnnnnnnnnnnnnnnnnnnnnnnnnnnnnnnnnnnnn

SEQ ID NO: 27565 - DNA, 688 bp, Oryza sativa
caatcctcgtgaaacacgttgatcgattctagaaacatctttgaaaccattatcatcggaatcggctacatcacctctatcggctgtgtcggatgttatctgtccgatccatctcagtcgatgcagactccagccgatgccttcgtagccaatgcatgctctgttcttcgaatccatctctctaccgaatccgcctcgatttcaatatcgaatctggttcatatattaccaaatttggtcgtcaacagaatgcttccgatcaaaaatatccattgtcctattaaaatttaaaatgaaaattttaatttattacatttgttttatttttaaaatttatgttaaatttttctacactaattatttagtctcattagtttcataaaatgcatatactgtgcactcaaacaaaattttcaatcttttttcaagtttatattcaaaactaaagcatcaaggataaaaaaggacacttacaaccaaacgtaatagtgaaatgaagaaaaatgtaatggtaagggcatgtaagggatcaagctgaaatttcaggggtatagaagggatcggtaaatttcagagagtatgaaagagattgagtgagttttcaggggtacaccaggaaatttattctatattgttttgcatcatatttgtaattttttttattgatagaactatgtttcttcataaa

SEQ ID NO: 27566 - DNA, 937 bp, Oryza sativa
tcgtagggttgccccattgccatccaatgctaccctgaaatcactggggttaattgatagaaatggagttgtcctgggggttagctttgcatttgttaaactcggcttccctggagtaggcctcaggagtactattctacttggcaaggagggattttcttccttaaaattagaactctgatggaactctctcattgctgctccattttgctcttgaatttgctcagttccagtttgtcttgtgccatcactctcaaaagaaccaagtggctttagtaccgtaatccgttttttctgaggtggtgctagattggtgtgagaccctaccaactgtcttgagaaaattgagttaggttcttcaagaaatttcagaaacaaatctttgtttgaacttacaaccctaagagcttcttgtaagtcctttgaatgaagcggcttctctgccatgcctaagcattttttctccatgacacttcctcgcaaaatatccactctgttacttgtgttcccagaagaccctcctttctgcgaaattttgtcctgaaaatagctcatccgtgtttgtgcttcagatacttcatacacatcattatattgaactgcttcctgacaaaatgggtggatatcttgtgtcgttgactttatgagacgatgctgctcttgttgctttaagtctttgtttagtgcttttaactggttacatgattgacttttcctgaaaccacttttggcctggtgtaaaactggtccattagcaggtagatcctcctcaaggcccattaatcgggcaacgacacctggtggctttctctttaattccacttctttagtcatctcttttgctaataacacttttaataaagttgcatttgattttctacgtgaagaaccatcacaaggtgcctggcgagaaacccttttttattattaaaaaaag

SEQ ID NO: 27567 - DNA, 688 bp, Oryza sativa
agcatccaaagaatcttgcagataagagagacttcgaggtctggtgatctgcgctgtttttgttctattcctcactggaaatttacgaatttcatgaagagtttggaaatttgatcaaacaggtgtgatgtttatgccaaaccgacgaatgttcatcatgactagaccttgtataacagctggcattccattttatttatggtgcattttcttgactgacacaagttatccccaaatcgtatgtcggacacccctagaaaaattgcatttgccacttcccagatgacaatcaaatcaaatgtagcacacattgagtttccagtattgatatcacaaaccgaatacgggagaaaaaaaaaatgcacagcccaaacaatgcctaatcctgcataccaaagctccaccaaatgaaacagaatgctggcattttccatccagcacaacccaaatccaaccaggcacatcacatcacatcccatcccatgggaatcccggcacaagaaaggcccgaagttaagtgagcctgtgatccagagagagagagagaatcgctagtatgcacacctggggtgatgcggcagcggagcattcttggccgccgccggcggccggggaggggagggagcagcttggcttgcgcggcggaggcggcggcggcggtggattttgggagggggtaagcaacgga

SEQ ID NO: 27568 - DNA, 1993 bp, Oryza sativa
gtaccccattgagccaatgccccttgcaacatccaccagcaatccctccctctggattggtacttccgtgctcgacaatgacacggatgcaggtatgaggccttcctcacggagcttcttgaggcggtcgttgacaatcttgaggtgtgcatttgccatccatccgaggctggtaatttgctcgatggtgagaccctcgaggctcgggcggtggccattgatggcttcaatgaggagtagcttggtctcgctttcatcagcatcacgtcccaccttgtgcaactgctctttgagcttgttgacctgctcgttgaggatgtcctctaggtctgtcatcttcttgtatctgaccagatgcggcatggccttgaagtgctcgagaactctggtcgcctcccacaccgacggccaaaccttcgttgcttgcacctcaacctcaccgtacaccatgaggaatagtgttgcgaactcactaaccttcttcgtcaagcccttgagactcttcatgaatgtcacccgctgcttcacatcaatgacgatcccctgaagcttcaccttcttgcgagccatggcctacgcagttcactactttctagcaagaatgcacctgtagattgaggagagatggttagattgatgtgaaatcaaggaaaggggaatatggtggatttatagtgggagatcggattgcaacaatcgccatgttgtggaaagaaattatttcgcaaatccaaaaatatcaaatgaatcaatgcaagttaatgctttcctgacaaaaatgctcgggttaatgtgtagctggcaagcatatctgtcaacctttaatcgtgcctgtcaatagccaatagatattactcgctagatgataatgagttcccaccaaatatacattcatgcccagttattcatatatgtttgagttaatcctctttgatatgtgcaattggaattcaatttacaactacagaaacgatttttgctacattcaaagagttccaaggattgatcctgtcacgatagctgccatcggatgggccatatctgccacagaatggatgatttcccccatcactcataaacttgtgaacaagggagccgccttcatgctcgctcgctgtcccagcttgcatctgttaaaaagcatacatagttatcttgttaagaaagagaacactagataactcgcaaaccgtatttttatcaactctactattattggattatttatccatttattgcagttgagtggagagaacagtgaagctagctatgtaatttgaggctcctattaaagccccattggtctaaaatctcaacatatttgttgcaagtcatcaattatattattaaaatttagtaaagccacaatgctcagcaaaaagaactagcaaaacagtactatattccaagggaaaaaagaatttacatctttgatcatgtagaatttagattgtatcaatttagactattctaccacctccacaacatcaattggagaaaaacaagaaagattaacaccgctatgttcgatgggtccatattttctcactatactgcagtaaattggtctgcctcaaccatataagaagtatactagtataactctattttacagcgaagatagcatgaaaacctcgactagttcgtaaattttattctcaaatctgttagtggatttcaggaagcacataagcacatataaagttggcttgcaaattgcacaagaattacatttgggagtttccgtgccgcgatcatttccttcagttcttggacagaaggtgacttttatacctaaccagatcaactttgcatgcatttgtaggatgttgttccaagtataattaagtccaaaaatagcttgaagaaacagttggagaaaatagaaactcccaacgctgaagcacagaagattgttgacctgacaaacttcataagcaataaaaaaatgaaaaccataaacccaatgtttttgccctatatacatcgattc

SEQ ID NO: 27569 - DNA, 735 bp, Oryza sativa
  unsure (1)..(735): unsure at all n locations
nnnnnnnnnnnnnnnnnnnnnnnnnnnnnnnnnnnnnnnnnnnnnnnnnnnnnnnnncaccctgctaattttatccttacacgacagcaacacgtcgtggatgactcggtcaaggttggtgtccccgggcccacctggcagcgtcactcgtacagccttctctttccactcttgtgcacgccgccgtatctcacgccccttcttcccctccatggcctcccgtatcatcgccgccacctcccctcgccgcgcgttaccgccgatctccatcccgatgccccactccgtcctcttgtaccggcagttcgtctgctgctccgcgaagaagggccagctcagcatcggcacgccggcggctaggctctccagtgtcgagttccacccggagtgcgtcaggaacacgcccacggcgtcgtgctcgaggaccttctcctgcgggcaccacgccgggaggacgccacggccctcgacggcggcgtggaactccggcggcagcgcggcggcgtcgccctctccccccttgacgaggtctgggcggacgacccacacgaaggcgtagccgctgtcggcgagcccccacgcgaactccagcagctgctcgctcgtcatcaccgcgatgctgccgtagctcacgtacacgacggagctgggccggtggccgtcgagccactcgaggaggccgtcctgctccttccagaggttggaacccacgccgtgcagcgggcttccggtggg

SEQ ID NO: 27570 - DNA, 611 bp, Oryza sativa
gatcaatcaaggatgctatctttcctggacacttaaaagctcccaagaaaagtactgagtaaagcatctgtctccagcattacaagcacttcttttggctgtatgttcatgtccaagaaagcttttctggacatctgccggaaatctgtgctctagtactagcctgcagtatgcgggaagcactttggcagcatcagcttgcaagaataaccaagatgcaattacagtgcttcagtctcagtacatgcttagacgttcgtagattcaagtattcaacacatacatgctcttcccattctttctatcagaagcaaaaaaatttatgactgaagctacagagccttaagtacttccaacaccgacctcacataatcctgtctcttcgtgcaaataactttatgcatttttttttcgaacgaaaggaaataacttgatgtaaaagaagatataacaataatgctatctttcaaggtaaatatgagcatctcggataaaatattcccaagcaacacacaagcaaacatttgactccacaaaacaagattacaccgagacaacttcttatctgcttccacaagatacaattgccatgacctttgaagggggaacaa

SEQ ID NO: 27571 - DNA, 882 bp, Oryza sativa
  unsure (1)..(882): unsure at all n locations
gatttccactagttgatctatcactctagtgaagtggcatgcatcttactntttaaagaagaggaagttgggcttctctacatcgtttgtggctacnaacatataggcatgtgtgcattttttgtaagatgtttacagaaaanaatggcatatttgcacaagtatatgacaatatgtagatgtttgattagcatcatgtatcatgcatgcaacatctggatttagtataattatttcttttttgcataatatattttggactatagtatgttaaggattcgttgcaacgtgcagacatgatgctagttatttcttgaaagaagttgcacaggggcttgatacctgtttcttgctcaatttttttcctgtggaaaagcagtttcctaagagaatcactgctgaagctcagtgtagctgcaaatggagggcaattctggtgttgatcaagcaatgtttgcaccaaaaaagaactccttaaaagaactaaactataagtgcactaacaaacctaatcgaggagagctcccatcattaaaagcacgtgcagaacttatttcctggtccatacggtcaaggatttgatttcgagcctttcgtgcaggttccaaactttcacatattatgtccaacggtattccagcaggttttatatccagttgaatagcagtaatacctctccttgttnnnnnnnnnnnnnnnnnnnnnnnnnnnnnnnnnnnctcaagaccctgggaaacatcaatggccatgttcagttcagcaccaaccaaaatatacagttggatgaaaaaggaatagttatttataaggattgatggtagaaatnnnnnnnnnnnnnnnnnnnnnnnnnnnnnnnnnnnnnnnnnnnnnnnnnnnnnnnnn

SEQ ID NO: 27572 - DNA, 845 bp, Oryza sativa
  unsure (1)..(845): unsure at all n locations
ttccttgtgtcttcattaaagggaaacatattggtggctgtgacggtgagttccttgttcttaatttgtcgtgaacttgtgatactaatgtcatcggaccaacaacattttcatgcatttttatcgctgtttaacttttttctgaacaagaaaatcgctagaacaagggtcacttaggccagagtttttctacactattttaacgtcgatcttcattgatgtctttcaaacagataccatggcgatgcacaaaggagggaacttggtccctctgctgacggaggcaggagcaatcgccactccttccctgtagataaatacctttgccaaaacgtgtttgtggtgtgtcaatgtcatagaataaaggcgaatatatatggggacttccactgtcagaacaacttattgctgatagtagtagctttgggtgactttcaagcctgtatgcagcactactctagctaataactcattttgtatgatttcattggtagcaataaatatgattagtgcgtcctgtgaatgagactgatgacatcggcactccaagctcctgctactggctgccagcctgcctccagatttttgagatcgagatgttgttgtgtcgtcactgataccaaccatccactcctctcggtggaagaaatacagccagtgaactggaggaaacacccttcgtcaaaatgattgttttgcctggccatagttcagagctgcaatcaaaaatcttggttgtgtttaccattctgctgaattactgaattacagcgctggtaacagatcagtaaacaaacgnnnnnnnnnnnnnnnnnnnnnnnnnnnnnnnnnnnnnnnnnnnnnnn

SEQ ID NO: 27573 - DNA, 705 bp, Oryza sativa
agaggtgttgaagaaacttttttgattagtaatagagaaacatatgaacccaaacagaagtccagtatcaggtgttggttgcaaacatgaaagcacgttcaatcatatatgatttctaactggcacctagttccctaattgtttgttgaatggcagaataaactcaataccagactttgcacctttggtatttacatctctgcacacatttgtacaagtagcttcaaaattagtataactggatgattcgcttcccatccgcataccattcctcatatcttggcacttctgttaacagatcaaacaaaaggaaattgcagtgagcacaaatcctccagaggaagcagtcaagatttcactgaaggactgtttggcttgcaggttttctttactaccttgcactgttcattcaatcagcagcttgtccaaatccaaataatgctgactgtttcattttaatcccatagtggttgcataacatcagcagaaacagttatgcttgagaagcaaagcttgggtgacttcattactcgcatcaactctgacaaagctgtcatagtatcggtctctccacagtcaagagcatcgctagctgcattctttggtctttctcaatcacaggtgattaaatatttttttcagttatctgcttccctgtcaaatctgtccttataaaatgttttgtccgaaatgctagtttatttg

SEQ ID NO: 27574 - DNA, 880 bp, Oryza sativa
  unsure (1)..(880): unsure at all n locations
nnnnnnnnnnnnnnnnnnnnnnnnnnnnnnnnnnnnnnnnnnnnnnnnnnnnnnnnnacttgctttccaagttcatcggcgaggctagagtcagcaaaagggctctcaaatagacccatggtgaacttgactcggagaatcctgtagacagcatcgtcaattctgctcatggggataattttgttgttaacttgctctgtcaggtcatcaatgaattctgtgtaggtataaggaaccatgatctgcaaacagcacatatacattaggcatgataaattgataagaaagggaataaagcatcgcatctgtattagtatagtagaaaaaaggctcatcaatgatgtgtcataaactcgtaataacaagacaagaccactcttctaacatgatgtatgttttaattgttgaatccaccttttatcccacaaactaaagttggacagactaacaaatcaaatgctttattggattttcaaaagagaaattaactatgactttatgcgtccttgacatagaggctagggatataattcaatcttcctaaaaaaaagggaagaagttaatgcacatggtctgcatatctcaccatgtcaatgccggcaccaattccagcctcgattgagtaagaatagttcttatgcggaggagaagtgatccggtcaatgccttgccagtcagaaatcacaaaaccctgtttgcacaagatccaaagcaattaaatacgcctgcaatatctccaaatatacattgaagaaaataaatcaagataactattttgtttttttagaaaaactaaccctgaagcggagcttgttcttnnnnnnnnnnnnnnnnnnnnnnnnnnnnnnnnnnnnnnnnnnnnnnnnnnnnnnnnnnnnnn

SEQ ID NO: 27575 - DNA, 762 bp, Oryza sativa
  unsure (1)..(762): unsure at all n locations
nnnnnnnnnnnnnnnnnnnnnnnnnnnnnnnnnnnnnnnnnnnnnnnnnnnntcctagttttttatcataacagggcatcacagtaacatgataaacatcatgtggcctacacaacaaattcattcatgtacaactgtaagtccaaatatttaagggtctatagtatataaaatatgaaggtaacacctttacatcaactatggcaaagtgctcacttcagaccaagttttccaaccatatgatgcttgatagcagcaccaatggcctgttgggggctcttcacagctgagatgtaaggcaagataaatgaaccgagagtcttttctgcatagcatatccaacctgcaagttgaagaggtttgaatatatttgtgcactaatcttactcttgtttataaaataagatgcaactaataagctaccccctacggtaaaaaaaaaaagggacatttaggacaagatcctgcccaacttaaaattccaacaatcaattttatattagaattagtttataaaatctaataagtttatgatattatgatagtacttttcgaggtaaatctatgtatatcatttgttttgtttttaaactaagcattcgatgagaaattattgatggtcaaaattttaaaagtttgagtgaatcttattctaaacatcaaatattttttaccagagtacaagcattatgtggaagtacagaattcatgatacctaaattacatagtaccctgcaaacaattttacctgggcatgcagat

SEQ ID NO: 27576 - DNA, 694 bp, Oryza sativa
  unsure (1)..(694): unsure at all n locations
cctggctatgtgcgtgcttcttacgtaagtgattgaacatggtgggtttgcttatgtgtcccacatgataatgtgccatgaatgcacaaactgatcctatggtaaatgattctaaaagacaactaaatgagtgtggaagttataaatgtaacaaacagctactgaatctacagaactattataaatgctctttcatgtcaacattcaggcaaaatttatctactctcttcaccaagaacaacctaattaagattcctactaataatgaaatgaaatgcagctctcctgcgttttcgagaaaaaaaaaagattcctactaaaagaacagaacagttccgcaaagagattgaatgtttgacacagaagagtgcctggagaacatcaatatatatctggcataaaaacaacacccatgcagccttatctatacaatgaagccaatgggagatatttataaaagaggccgcacgatctacattgtcatgtcaaagaaatttggaaggtcgttgcgaaaataaatttgttgtaccactgcaatattctaggacagtgcagaatgtgttgtgatcaatctcaaatatgtcccatagcctgacaatgtttggatgcaccaaagtcttatggatgttatattnnnnnnnnnnnnnnnnnnnnnnnnnnnnnnnnnnnnnnnnnnnnnnnnnnnnnnnnnnnn

SEQ ID NO: 27577 - DNA, 971 bp, Oryza sativa
  unsure (1)..(971): unsure at all n locations
nnnnnnnnnnnnnnnnnnnnnnnnnnnnnnnnnnnnnnnnnnnnnnnnnnnnnnnnntataggcaccggatttactataaatagactttcacggcgaactatatatgtgaaagaatctcaccgactcgatggccttttctcgattgagattggagatctactacagcactacagacaggagtggccgagtgggtagatccgcacaagtagtgtagactgtgcacttgtgcagcatgtatgctgtgtggtccagccagaactttgatcgctagctcttgattatatttggaaaggactgtttgttgtctatttttttaatcacatgaaaatgccatcaaaatttagttacttttggatttttggaatcgtgtggcccttcacagtgttcctacgtggagcatggccacggctcaccacgtaggatagcatgctatcgtggcggtgagagaccattacttcgtgggtaacacaagactaacttgagagccgagagcctcagctgaaaaagctaagaaaaacaaggaatcttactgcgaggctgcaacaatccccaccatccccacctccccatccttggaggagaagagaggggagccggcaatggacgacgaggaggacgccaatccactaccgagctccattactgctgtcgccgtcgccctccgagccctcaagccccatctcctcgtcgtcggctgggaggggaggggccccagcgagctgactaccgctgaggcgcgggaaaggagagagttggctatggtggagctcaagttgccagccactgtcgctgacctttggctagatccaggcggcgccgtcgagctctaggccgaatcccgctcctccttaacgcttgagaggagagaggcgatgatggtggcagccgagcgcacacgccgctgttgtcgaggtcgtcgttctttgaggaggggcttcgtcttctcatcgcgggcccggagaggaggggc

SEQ ID NO: 27578 - DNA, 892 bp, Oryza sativa
  unsure (1)..(892): unsure at all n locations
nnnnnnnnnnnnnnnnnnnnnnnnnnnnnnnnnnnnnnnnnnnnntttatttttgttacaacttgtagaagttgaatttgaacttgtttgtttgtggagtgatatattacatattaatctatcttgtcaatttttttgaaaatttttcgtaaccatctacttgacatgcaataaacggatggatgttcaatcgagctattagaatccatctcccttgcgtgtgcgggaagtgtttgtgtgcttgttgcaaccattgcagacgctgttccgatttagttggtgtgcatcgtgttcgtgtgcttgttgcaaacgcttttcactctagttggatttagttggtgtgcgtgtgcgggtagtgtttgtgtgcttgttgcaaccgttgcagacgctgttccgatttagttggtgtgcgtcgtgtttgtgtgcttgctacaaaatatgtttcaattccaatcatgtttcatctaatatttttttggattttgtcagttgtttgacaaatcatttaaaaaactaaccgagctcttaaaaaaaaagatacgcaatataaaagacgaagatatgattggaaaaatcactaacacatgagacattatgacccgctggatgcaaacactggttcaattccatttttgttctatgtttcaatcagttcatctaatattttcttggattttgtatattttttgacagatcatttgaaaaactaatcgagctcttaaagcaaaagatacacaatgtaaagggcccgctggatgcaaacgttgtttcaattctatgtttcaatcagttagtatctaatattttcttggattttggctattggttgacatatcatttcaaaaactaaccaagctctaaaagaaaaagatacgcaatgtaaagggcaaag

SEQ ID NO: 27579 - DNA, 795 bp, Oryza sativa
atatatagaccatatttatattattaaacgtagtctaatgacaaaacaaattacagattctgtcaagaaactatgagacgaatttattaaacctaattaattcgtcattagcaaatgtttactatagcacaacattgtcaaattatagcacaattaggcttaaaagattcgtctcgcaatttcctggcgaattgtgtaattggttttctttctacatttaatatttcatatatgtgtccaaatattcgatgtgacagcgtaaaaaattttgttttggaactcaacatgcccttaatattatactgctggtagtgattcttttgagccgtacaaagcttctaattaaccaaatcgaagttctagacaagttcacatggccaagcctgctcttccctgttctctagaatattccaaggcgatatggtgaattaattttccgcatttttcatatgctcgttgctgaaatctctgtaaaatcaaagcaaaaaaaacagtgaagagatttaccgtgtcaagcaaatagagttacaagtttatacgcgacaaatatataagttgcggccgtgtagagtgtagacccaacattccaacaattttcactattcctcatgtgtctcaattgcataggattattcatcagtgtaggtcagttcccttgtttctctccaacatgtccatgtcatagtggatgcgtttatatttttcaaggaattattgatgcttggaattgaccttgcacttgacagggagcatgaacctgaacatgaacttgcttttccaggtagcaggcgtcct

SEQ ID NO: 27580 - DNA, 750 bp, Oryza sativa
ctttaaggagacaatagagaaaagaagagcactagattatagacttatagccagctataatatagatttcaagacacaatgattgtatgacaggtgggaccatgcattaataatgtagcatatgtttataggtaactattatatataaattggctactaaattgattatacatgatttagagttagtagttagctatactattaaacttgctttttattactatgattactataatgtaccctcaaagcgtgtagattcacggaggatatttagttagcctgtcctctcacccaaaaaaataaaaataaaaatcgaacccaaatttaaaagtcgtttggtaaaatttattaagatggtaattaaattagttgcgtccccaccgataaattttgccataataaaactgacccccctcgagccgcggtgagggaagcagcagcggcggaaggcgagcgccaccaccaccctctccacctccgccaccaccaaaatccgcgcggcgccgccccaaaaccctaatccgcgcggcccaccgcatcccgcggcgctcagatctagggcatcccccggcgatggcggaggcaagggcgacgaggcggcgggcggaggaggcggagatggaggcggaggcggggacggagggggacgacggcgacggtggcggcagcagcgactacacgtcggaggacgagggcacggaggactaccgccggggagggtaccacgccgtccgcgtcggggactcgttc

SEQ ID NO: 27581 - DNA, 834 bp, Oryza sativa
  unsure (1)..(834): unsure at all n locations
atagcatgctataagctacctgcaaatatatttaagcagataaatgagaagagagagggcagcgggctacagatttgtagccagctgtagcatggatttcaagacgcagtgtatgtataataggtggacccagatattaaaaatgtagtatataactattgtatgaatgagctattaaattggctatagatgaattggagttaatagttggctaaactattaaacttgctctcacatgcaaagaatacagagctcttgtcatcattccgtggtgggaagcagacggcgacggatgtgccacttgacccccgaccgagctggccgtgggcccaaccaacgaccgttccatttgcacgagaccatatcacatcgccctggggggcccacctcgcccatcagattagattaaccccacggccccgcgccaaaattaaacaccggttttataccactcactaccccacactgacggtgactggagtgtgggcccagccgctgccgtgtcattattaggtcacttaatacagtaatcacccgaaaaaatattaattaatttaattatactagtaagcaagactggtcttgtttacaggtcaggagagatggcgccgccgcgaagcaaactcagcagccagcatgtctcacaagtaacaccccgaccctgcgaaaatactattttacccctcgtaccatccatgtgggtgatatggccgtgggcagaacgggtattacggcctccgaggtggagtttggttcgtgtcgcgtaaatannnnnnnnnnnnnnnnnnnnnnnnnnnnnnnnnnnnnnnnnnnnnnnnnnnnnnnnnnnnnnnn

SEQ ID NO: 27582 - DNA, 559 bp, Oryza sativa
caatgagggcagccccccgctcctcctacacttgcttggcgatctccgccagcaccttcttacaggtctcaagctccgagacgtgccggcggtgagccttacggcccacctccaccatggcctccaccgagcgtcgcccctcttcgacatgcgcccacgcggcgtcgagctccgcccgctctgcctgcaggacctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgctgatggaagtgccggactcggggatgtcccccggacccggttggtcctgagcgtcgcccgagggagtgggcccaagcgacgcgcccgcagcctcgttgccagctgccccagaagttgtcgcctgagcgtcgcccgagggagtgggcccaagcgacgcgcccgcggcctcgtcgcgagctgcctcggaagtcgccatcgcctcgtcctggcgaaatccgacttcctc

SEQ ID NO: 27583 - DNA, 635 bp, Oryza sativa
  unsure (1)..(635): unsure at all n locations
cggcgttcgtcggcgagatccacatcctggtgacgacgccggccgtgctgacttcgcgtaccgggcgctggcgaaaacgagcgaggcagcgtacgacgccatgttcggcgtgaacgcgcgcggcaccttcctgtgctgccgcgaggccgcgaaccggctggcgcgcgacggcccgggggcgcatcgtgacgttctcgtcgtcgggcgtcgggtcgctccggccggggtacgcggcgtacgcggcgagcaagccggcggtgaaggtgatgaccaagatcctggcgcgcgagctgcgcggcacggggatcacggcgaacgcagtggcgcccgggtccacgggcacgccgatgatgtacaccggcaagacagaggaggacatggcgcggtacatcgccgaggcgccgctgggccgcctcggcatgcccgacgacatcgcgccgctcgtcggcttcctcgccagcgacgccggcggctggatcaacgcccaggtcatccgctgcaacggcggcactatctagctaccctggcctgcgcgccaaaataaatgatttctccgttctaaaatataacannnnnnnnnnnnnnnnnnnnnnnnnnnnnnnnnnnnnnnnnnnnnnnnnnnnnnnnnnnnnnnn

SEQ ID NO: 27584 - DNA, 702 bp, Oryza sativa
  unsure (1)..(702): unsure at all n locations
nnnnnnnnnnnnnnnnnnnnnnnnnnnnnnnnnnnnnnnnnnnnnnnncccttctccgtaagtattattattaccacattatgtgatccatttgtccctcatatcactctttattgacattgggcatggaatataggtaaacacaagtggccagtttgttggtgttgctgaaatggttggtcctgttgattttgagaagacagtggattattggcaacaagacaagtggaatgggtgttttccaatcaagtggcatgttgtcaaggatgtacccaacaacatcttgaagcacattacattggataacaacgacaataagcctgtgacaaacagccgtgacacacaagaggtatcctttctcaataacttgccaagttctgttgattgtacaatggtcaattgcaggccacgggccattaagggtactattaatgtctctgttattttagatagttaatttcatcgtcattttcttgagataattcaaatttcttgctgtggaaccagattagtcgttcagtaaatgagaacttaagacatgatatatatcaatttcttcatcatgcttatggtcatgagtggaccttcatgtataagaagctgatgaattttatttttatctattgatatggcatgacaatgtgatgatcctttcagtatgctccatgtgcgttacttaccaagtagatgtaatgcttcagg

SEQ ID NO: 27585 - DNA, 537 bp, Oryza sativa
tgtggtacaatccaattttgctagctaccctgtggctcatttttttaagccacaacttaagacaagtgtggcacaaaaatatggtgaatggtggcaaacttagtatagcatctaaacagcctagagcgccatgaacgccgagttgacggcccacttcttcaccgcgccgcagtcgccgtacaggatcaccagcctcggcacgctctgcagccccaccagcgtcgccgccgctagcggccacgcgttgtcccccttctccacccactccggcgccgcctccgccgccattcgcggccacgaccgaggtgaggcgagggaaatggatttggaaatggcgcgaagtagaggcggagagcgagttatatatatatatatatatatatatatatatatatatatatatatatatatatatatatatatatatatatatagagagagagagagagagagagagagtgtgtgtgtgtatatatatatatatatatatatatatatatatatatatatatatatatatatatatatatatatata

SEQ ID NO: 27586 - DNA, 743 bp, Oryza sativa
  unsure (1)..(743): unsure at all n locations
ttgagcaaggagggcacccctattgtcggcgaaatgctgacgcctcaaaatctgcagttgaaagcagtgtacaatggcaattagcgcgatatatattctgcgttaattgccacagccgagcagtcagattgtgcaatttctgaaggttcgcggcgtggctgagcgatagctacttgggttgggacttggcaactaaatttcgtaacagactttctataggcttggtgcctggggagtgggtcagttcttactttgattttagctcgtgtgactggttttttgcgtcgttaggtctcatatattactcttatgacatcgggttttatgtaacccttatcctttttgttttttttagccttttcatctattgttattgttagcgaagcatccaaatttcgataaatctgaacaacagtaaggtagttttccgagttttgcagcactggagaaggtaataagacaagaactctggttttggttggtcctcccttgtgttgtgtactatctgctttcaagtgtcaatgtgccaaaatggcatcaatcatctcgtgcattttaggcatccacgatgtgcatgagaagaggtcttactacctactttacaattggagaaaatcctctatatatccttgagagagatgctctgaattttgcctattcccttatatactctcgagttttcattttgatcttctctatgtaatnnnnnnnnnnnnnnnnnnnnnnnnnnnnnnnnnnnnnnn

SEQ ID NO: 27587 - DNA, 390 bp, Oryza sativa
aagcaaggttctttattggcattgcaagtcaagttttcaacatactttcgtactgattaaccaattacttatatatacaccacatcaacgaccaaagtgatattcacaacataaaaatgagcttacatcccaaaaattgcgtgtcagaatgctcgatcgtcgtcattaggatcaggcatatcaagtggatatagtggaatggttggaaggcctgacactgcatcaaaggtagaggcaaaatactcagcactacgtttcaaacagcaattaacagcatatgtcgagaagatatatggaatgatcagagataacctgaagaaggaaataaacccgttcttgattatgtgcatacaggtatgcaccccagacatttccatgccaatcgtgaat

SEQ ID NO: 27588 - DNA, 669 bp, Oryza sativa
agacagataaggttcttgagcgatggttagaacgtctggtctttctgcttggttgtatgtcaagcagcgacgaatcagttcctgcgagttttcaggtgatgcagggtcaaacttttgccaaactatgtgcaatgttatttaaactagtgtgttgagggacaaaagtttaaaccaaacggacagcctcaaaggcacaacatggaaaatatagtaaaagggatcaatctaactgatgactctgaaatcagagataacagtaaacatacctttgcctcatttgatacagctggctttgaagggaattccactctgcgtgcgttgatgattgtatcttcccgaagtattctctcctgggtctggtcatggccaaaaggacgccttccgaagagcatttggtaaaacattacacccgctgaccaaacatccacctgcaggaatgcaaacatcaattttaccaccaatcagaacaaagatgaagttgcccataagtggtttaaattgattactcagggggttcacaaatgactctaactgaaataagggttaagaaggaatcgcgtaacattttgagtaaaaattgcatatccacatggccattgcctgcataccactaagcccaaccagtattccccatccccatcaacagcagatcaattcaccacctgtgac

SEQ ID NO: 27589 - DNA, 912 bp, Oryza sativa
  unsure (1)..(912): unsure at all n locations
tcatccagcggcacagaatgtctcataagtaagtggtttttccaattacatctttgccctttacattgcgtatctttttcttttagagcttggttagtttttgaaatgatatgtcaaacaatacacaaaatccaagaaaatattagatactaactgattgaaacatagaattgaaacaacgtttgcatccagcgggccctttacattgtgtatcttttgctttaagagctcgattagtttttcaaatgatctgtcaaaaaatatacaaaatccaagaaaatattagatgaactgattgaaacatagaacaaaaatggaattgaaacagtgtttgcatccagcgggtcataatgtctcatgtgttagtgatttttccaatcatatcttcgtcttttatattgcgtatctttttttttaagagctcggttagttttttaaatgatttgtcaaacaactgacaaaatccaaaaaaatattagatgaaacatgattggaattgaaacatattttgtagcaagcacacaaacacgacgcacaccaactaaatcggaacagcgtctgcaacggttgcaacaagcacacaaacactacccgcacacgcacaccaactaaatccaactagagtgaaaagcgtttgcaacaagcacacgaacacgatgcacaccaactaaatcggaacagcgtctgcaatggttgcaacaagcacacaaacacttcccgcacacgcaagggagatggattctaatagctcgattgaacatccatccgtttattgcatgtcaagtagatggttacgaaaaattttcaaaaaaattgacaagatagattaatatgtaatatatcactnnnnnnnnnnnnnnnnnnnnnnnnnnnnnnnnnnnnnnnnnnnnnnnnnnnnnnnnnnnnnnnnnn

SEQ ID NO: 27590 - DNA, 448 bp, Oryza sativa
  unsure (1)..(448): unsure at all n locations
gtttttcttgcttattgtgagccaacatgtacaatgaccattgttttgttccccagcagcattgagtcgccagctagcctgtcttgtcttgtctatctagaggtttgggttgcgcaggtactgagcccctgaccatgtggccccaggtgacagcacgatgggctccagcatggcgggccccacgcacacgtaggcgtacttcccgtaccactggtactttgaccccgggctgaacacgtacacctnctcgaaccctcttcgctgcacgcaaatggagttcctcctcccctgcaccatcaaacgaatttgatcaaaagttcagatcgaatttgagaaatttatttcacttttattacgaaaattgagctggcgtgtgtgaattttttgtgtttttttaagaatattattttctttctacctcagtattccttaacacatttcttaaacc

SEQ ID NO: 27591 - DNA, 301 bp, Oryza sativa
cctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagcccaaccgcaataaatgtggttaggtgagccccactgcgctcacctaacccatacac

SEQ ID NO: 27592 - DNA, 722 bp, Oryza sativa
  unsure (1)..(722): unsure at all n locations
ttttaatcaactttccaaagttcactttgatgtcttcaccatcaaatgtcaacgggggcaaagctgtatcaagttcaatgaagaagacaaacgtctgtttcacgcacgtcatagaagaagagaaaaagatcactgttgtacataaaacaaattaaggaatcataagataaatgctaacgaataggccctgtttgaaaaattgcaatggaattatcagctgagtagatcaactactatttggttcacttcgtttttacatgttacaatctcatctgtgtttcccagtgaggaggtagtatacaatcattaccaagaaaagctggtaaaacctacaatctaacaaaattcatttgcccgcatgcaaaatctttgatgacgtgtatttcttttctgtgtgttcagtgtttgcttagtgtgggcagggcaccaagatggcacaagcaactgcccacactgggaaatgctttccaccactgtgttatcaccaattctgcaactgcgatgccacgcttttcaccactgggtgatacttcgtgtgtagatacttctttgcgttttctgaaccaggttgcccaagccattcatcatataatcttttcgcaatagggttctcgaaggggttggataccgatacctggtacataaggccataagctttacagttagtggannnnnnnnnnnnnnnnnnnnnnnnnnnnnnnnnnnnnnnnnnnnnnnnnnnn

SEQ ID NO: 27593 - DNA, 697 bp, Oryza sativa
  unsure (1)..(697): unsure at all n locations
nnnnnnnnnnnnnnnnnnnnnnnnnnnnnnnnnnnnnnnnnnnnnnnnnnnnnnnnnnnccgtgttgcagggaccccgacctagtaaagaggataggagaagcaactgctcttgaagttagagctactggaattccctacgtctttgctccttgcgttgcggtaattaatactagatgatacctcttctatagtgggtgatctcaatctggttagggtgcgtgttcccttttcatcagcactatgaactcactgttgtgtttacatgatacctctcaggtttgcagagacccaagatggggacgctgctacgaaagctatagcgaagacccaaaggttgtccagtcattgaccacactcatctctggcttgcaaggcgatgttccatcaaatgatgtaggaagaccatatgttggtggaaggtatacctctgatactgtatagctttaaaatcatctttgtggcttgtacctttctgcctataattgacaggtgaaattggcgtatcactgcaatatactactatatgactaactttggtactacttgcttactgtgcagtaagaaagttgctgcatgcgcaaagcactatgttggtgatggtggaacggtcaagggaatcaacgagaacaatacaatcatcgatactcacgggctgttgaccattcacatgccttcttattataattctatcatta

SEQ ID NO: 27594 - DNA, 728 bp, Oryza sativa
  unsure (1)..(728): unsure at all n locations
nnnnnnnnnnnnnnnnnnnnnnnnnnnnnnnnnnnnnnnnnnnnnnnnnnnnnnnnnnnnnnnncgggaaacaggagaatagtgccattccagataagggccaattcaaccaggaaggttttccagtaacatacaaagatgcaaagttctttgatatcaaatcttacagtgaggatgatgtgcacaaaagtataaaatacaatgtgtgggcaagcactcctaatggaaacaagaagctggatgctggataccgggaagcgcacgagaaatgcagtgaatgcccagtcttcttgttcttctctgtaagtattattattaccacattatgtgatccatttgtccctcatatcactctttattgacattgggcatggaatataggtaaacacaagtggccagtttgttggtgttgctgaaatggttggtcctgttgattttgagaagacagtggattattggcaacaagacaagtggaatgggtgttttccaatcaagtggcatgttgtcaaggatgtacccaacaacatcttgaagcacattacattggataacaacgacaataagcctgtgacaaacagccgtgacacacaagaggtatcctttctcaataacttgccaagttctgttgattgtacaatggtcaattgcaggccacgggccattaagggtactattaatgtctctgttattttagatagttaatttcatcgtcattttcttgagataat

SEQ ID NO: 27595 - DNA, 750 bp, Oryza sativa
ggaagattataaatgccattacaatctatgtagttttgcgcatatgttactccatttcattcttcttagtgcaaaggaaaactccccgcatttacacaagcagaaactagcaacgcatagcagcttaagtatgcaagttaggattcttgctggcacttatttttgctagccacttttgtattgtagataagggtgatggcagtgatgctgaaactagcatgtctgaggaagatgtcctgttgcaggatgagatatgtaaatcacggttaacaagtataaagcgggtaaaatactttgctgattattgtttttggctattaagcatcctccttccttaatctaattcccctgaactgtattttaggaggaagaacagtacttgagagaaagagatcggtatgaattggaaaagggtaggcttatacgtgaaatgaagcgtctcagagacgaagatggatcacgctttaataactttcagattcttcacaatcgctacgctctgttaaatcttcttggaaagggagggtttagtgaggtttataaggtatgcccttgcttcagctttacttttcaaaaactattcaactaaggtcagtcatgacctctttaaataccaactgcttctttgcttataaagaagaaacatcgaactttatgattatttgtttatgactttgatacacacaattattaatgtaacataaagaaggtaagcccctatcggtgggctgcagtgggtcccacccgaaa

SEQ ID NO: 27596 - DNA, 446 bp, Oryza sativa
  unsure (1)..(446): unsure at all n locations
attcgagctcggtaccctgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccagttgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcannnnnnnnnnnnnnnnnnnnnnnnnnnnnnnnnnnnnnnnnnnnnnnnnnnnnnnnn

SEQ ID NO: 27597 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnnnacccccggaaatcaggtgtgccgctggtggcaccttctgcaagaactgatgatcctcctccaaaggcacatgcaccatcagtgaatggtggtctcaccaggaaccaaaagaagaagattcggaggaaagccaagcgtgcagccgctgcaacttcagaaggaagtgggactgttgcatctggggagacggatgggtcagatgataggggaaatttgagtacggcaaacgagggtagtccgaatcaggatggagacaagaaagaagaaggtgaagggagtagacggggtagcaaagggaccaggaaaaaaatggcattggaggctgacctgaagtgcaaactggtagacttcggaaatgcatgttggacatacaaacagtttacaagtgatatccaaacaaggcaatacagatgccctgaggtgatactgggatccaagtattctacatctgctgacttgtggtcctttgcatgcatatgctttgagcttgccacaggagatgtgctatttgatccgcacagtggtgacagttatgacagggatgaggtatgtctatttatttcttttcaagacatttcatatctatacaaaacttaactcaaactattacctgttaacactttagcttaaaaaaataggagtctatcacatagaaatttgagtgatca

SEQ ID NO: 27598 - DNA, 560 bp, Oryza sativa
  unsure (1)..(560): unsure at all n locations
nnnnnnnnnnnnnnnnnnnnnnnnnnnnnnnnnnnnnncttgagagccgagagcctcagctgaaaaagctaagaaaaacaaggaatcttactgcgaggctgcaacaatccccaccatccccacctccccatccttggaggagaagagaggggagccggcaatggacgacgaggaggacgccaatccactaccgagctccattactgctgtcgccgtcgccctccgagccctcaagccccatctcctcgtcgtcggctgggaggggaggggccccagcgagctgactaccgctgaggcgcgggaaaggagagagttggctatggtggagctcaagttgccagccactgtcgctgacctttggctagatccaggcggcgccgtcgagctctaggccgaatcccgctcctcctcaacgcttgagaggagagaggcgatgatggtggcagccgagcgcacacgccgctggtgtcgaggtcgtcgtcctttgaggaggggcttcgtctcctcatcgcgggccgggagaggaggtgcactggcatgcgccgcaaaacttgtcgtcg

SEQ ID NO: 27599 - DNA, 721 bp, Oryza sativa
  unsure (1)..(721): unsure at all n locations
nnnnnnnnnnnnnnnnnnnnnnnnnnnnnnnnnnnnnntatgtgaaatattgtactggagcatgccatatcatataggttgttatagatactaataatgtataatataccagataaatatgttaagagtcttttctttctcaaatgtaaatctaaagcaaatccattcaatatttcaacaggaagagttgtcattgctgcgtggtaaagttgctattttggaagaagagctttctaaatcgcgtcaagagtccacggaataccgtcaacttagtgataggctagcgaaggtatggagttattcaatgcacaccctaatgtgatctcgacttatccaggtctctgacttgttggttttgcctcattcttccaggaattgaaggatctcaaagaacaagatcaacaaaagaaatcaaaggtttcatcctaagaaactcagatgctatagtggcagattcttattatcttttatctaaccatatttgtttacttactttttggtctttcctttgtgtaaattagacaaatttaccaaaaaaattagagttcaccactcaagcttatcattgttgaataatttgggaaacgatttgcattcttctatttgcattggatcttgaataccagaacctgtcaaatttcatatatgcaagaacttttttcctgattacattggtagagaaggtatgcacatcgctgcatatgggatccttgtgaactgt

SEQ ID NO: 27600 - DNA, 29627 bp, Oryza sativa
  unsure (1)..(29627): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttacctgtcagtaacagcaggaatgagccttcaggatgtgcgaggaaagataccgtcttggcaaccttctccaagcactccttactctgcacgaacaaccaatcgcaatttcttctaacattttagtccaatcgaatataaatcaagaagaagaagagggagaatctctctctgcataccaggtagggagggtcggcgacgacgatccggtaggcgtgcttcatcgccgccggaagctcctccggctggttgtagtcgtagaaggtgaagtcgccgccgtactgcccgaaccgcacgtcgtactccagcagctgcgcggtcacatcagggctgctcgtcttgaggtaggtgtagagcgtcgggcacgcgacgcaggccaccgctgcggaggaggccgggccggagagggagacgaggcgggcgacctcctcggcgagcgcccgcgccgtgcgctcgtcgtaccagaactggctcagccgccagtcctccgccaccagctccaccccgccgccgccttcctccccttcctccccaccgtcccgcccctgttccagaagaaactcccgcagcgcctccgccgccgccgcgctcagctgcggccggtcatcctcctcccctctcacctcgcccctcactctctcctccacaccgctcgccattgttgtctcccactccccactcttcgccttcctctccgatagaggcggcgcttgtaaggaactttccaccacgacacgacgagcccatgggcctcaatgggctggaataaatgggcctaggtgggccgaggcgggctgagttcccgttattccgctgcgcgtagtggcgtcgcggcgtaggagtacgggggaagaacaggaagagcggagagaggaaaaggagaggagagagatgcctgcgcctgtgtaaaatcctgtgaattccaactcgcctccgaatcctgcgtcctctggtcggcggcgccgccgccccagggccaccacctcgccgccggtaaaccctagccgtcgccgcacgcgggggaggagtcaacaacaggcgggaggaggggaggaggcggaggcagcgactgcccgccgcggctccgttttggtcggtctcattcgctcgttcctccgcccgaggcggcgccgccgcccatcgcctgttcgtcgagcagccgcgggtagatccatccggtggttcgcgtggccgcgttgaggagggtgtgctcggggggagcgggggcgtagtgagagttggcgcgtgcgtgcggcggttggtttgcttgttctggaagcttcgtgggcggccgatccggtttgggtgcaatcagcggcggcaatgtcgggatcgtcggcggcgggggaggatatagtgcagcacctctcgtctaattccaacccgtcctcgtccaagctcgccaagctggaggcacggatggctggcaaggccgctccggtgccatcaccgccgccgccgcaccatctggtggttccttctgcccccgccaccacgttcatggaccaggaggagctgcccgagtcctcctcttccgacgatgatgtcagccctaaacctcgaactccaacctgctattttcctttccccctcaactacagtacagtgtcatatttatctccatcgatttccttacttgcacattacttttcgacagtgatgcgatgattgtgctttttagtgcttggagccatttatagtgtatactgtggtaaacctgtatgattagcttgattaattgtttctagctacagatttgccaatattttcacctctagtttgtttgttttttttttttgcttatacctgctaatgctacttgcattccgtaaatcagaatggcgaggagttcttgatacagaagaacatactgaagcgcccgagatcgccagatggtgatcacggcctagctgttggaaattttgaggtatgcaatatgaaatcgatagaattaaatagtatgggatagtctttgttgtacttgcttatggctcactcttgtcattcttctgtttggtgcactctttcattgaaaatgctagggatcagctaatgaggcggtaaagcattcagaagtcatggacacacggccatccatagacatctcaaacagaaaaaagcaaggccgtggaagggggcgcggtggagcaggccgagggcgtggttcaaaaactgtagatcaaacaagagcaacttcaacttcatctgctgttgtagcaaatggtcgacatgatattttaaccaacatggtatgctgtgtattttattctcaagacctcagttgatattcttaaccttttgttctcagatgggtattaaggccttacaaccatataagagagacatgaaagcgaacggaaattgatatatcttagtttgctacctttcaatatttttagatacataggattttattacgataaagtgcacatgtttatggatatatcttggtcatttggataatgctgaatgcctgaattagatcttgtagcaaatatgagcactagaagaattagttttcaaaccggtgcaaattacatatatatatatatatatatatatatatatatatataagaagtgatcatccagagcacgtacaaatgcgtgtagagcaggaatagcatgattgaatttagagttttgttgactgggaaaagaattaaatggtgaaattcctttgtagatgaaaatggtgaaatagtttgaagataagtttggactgatttgattttaacaatcttattatgatgatccccaaaggatcatgcattatgtgatcaagatatggttatctctggggcttttctattttagggcaaattatctctgatacttttgaagaattcatttgcagcaactcagattctaggtagttacggtgcattatgtttgcctcttgcacatatatttattgtacagtaccaattgaatccttatggggacacacttcttctgtttgcaccgtcccgtcttccattatatgcaaaagaaatatcttacgcagatcaggtgtatgatggcaacctactacatgatgatccatcctcatcttctaaattgttagtatctttccatcaggaatcccgatccagtgctgtgcttggcaatgatgataaggctgccttacaggtgacactttctttacatcattttctgtgaggtgcactgtgaatatccctcttctgatctttattatagtaacatagatgttctctgatagattatgtctatccctcttgacccttcttctttgagatgaccttttttatttgctttcatttgtttgtttaaactgtgcatcttaattccattaagtaatcttctacagaaagcatgaacatatttatgtgaaatattgtactggagcatgccatatcatataggttgttatagatactaataatgtataatataccagataaatatgttaagagtcttttctttctcaaatgtaaatctaaagcaaatccattcaatatttcaacaggaagagttgtcattgctgcgtggtaaagttgctattttggaagaagagctttctaaatcgcgtcaagagtccacggaataccgtcaacttagtgataggctagcgaaggtatggagttattcaatgcacaccctaatgtgatctcgacttatccaggtctctgacttgttggttttgcctcattcttccaggaattgaaggatctcaaagaacaagatcaacaaaagaaatcaaaggtttcatcctaagaaactcagatgctatagtggcagattcttattatcttttatctaaccatatttgtttacttactttttgttctttcctttgtataaattagacaaatttaccaaaaaaattagagttcaccactcaagcttatcattgttgaataatttgggaaacgatttgcattcttctatttgcattggatcttgaataccagaacctgtcaaatttcatatatgcaagaacttttttcctgattacattggtagagaaggttatgcacattgttgcatatgggatccttgtgaactgttatgtgattgtgtacatatgagcatgtgcaatgtgatagttggttttgctttgtgtgtgtacctttggaggctgagatgggtgcatagtgaggtcaggctgaccatattgtgtactatttgttctctttcatcagcacagctcagaggacttagtcctacatgctattcatggaataataactactccctgactatgtaatatttatgctcatatggtgatttccactattgcagcaattgaaggttctatctgatctgctgatagctgtgtcaaaagcagagcggcaagaagcacggattcgaataaagcaggaatctttccgacttggtaacgttggtgttatgaggtaatctccaacatttccatacatccatcacttaatttaaagagtaaaaatttatatattaattgatttgaaaatgtataatgatagatttaaagctccttttgcttgtactgtatttctttgctatgtggttcttgttaactatagcattggagtgctatacatctatgatagcctgtacgatacccaattttcttccagaaacagctgtggtagcttgagccttcagtttatgtattatgcagtgtaccttctagtatcgactactaaaattttgattgcaggacagaactagtcactttcagttttatgttctggttattgactatctattgctaccttttttttgactgctctctgtcataactcagagctggaactgtcatatctgaaacatgggaggatggccaggcaataaaggatcttaattctcaccttgtaagttctgcagatctgtgtatatgccttaactgtgttccgccgtaaaattggatcacatatactttgatctggataacctgtctaggtcttttcccccctataaggcgattagttttaaaactaccagatactaataatggacacatctttgttccataagctttttgtacaattttgagcacagccacacattactagcagccttaggtcaataaagtccaaaaagattataagatatatctatctattcaattaagcagttaagcaccaagctggcatgaaaaatattacatgtctggatcaggctgagtctactgatgtaacgtggagtcgtggacatgcagtaccactttctataaagcttcatccattaaggcacagttcctgttttgcaactttagaagccatgtatccatgaagacaaatgcttgctattaatgcaactgattttagatttcctatagttgtgcatttgtttatcaggcacagttttttttctcttgtgaactgttatagtgttattgctattcatatattttatgtgcctttaacctttattcttgatgtatggtggaccttttgctgaatccctcatgtatggtggacttttatgtagaaatctctgctggagactaaagaaactatcgagagacatagaaaatcactaaagaaaagacaatccggtaaagtttcttcttttttaaaagtgttgtcatctcccggcttaattgctttacaaggtaccacttgaattagcttccattggttaggcgaaaactccagtgcatgaccttttattccatgaaaaggaagattataaatgccattacaatctatgtagttttgcgcatatgttactccatttcattcttcttagtgcaaaggaaaactccccgcatttacacaagcagaaactagcaacgcatagcagcttaagtatgcaagttaggattcttgctggcacttatttttgctagccacttttgtattgtagataagggtgatggcagtgatgctgaaactagcatgtctgaggaagatgtcctgttgcaggatgagatatgtaaatcacggttaacaagtataaagcgggtaaaatactttgctgattattgtttttggctattaagcatcctccttccttaatctaattcccctgaactgtattttaggaggaagaacagtacttgagagaaagagatcggtatgaattggaaaagggtaggcttatacgtgaaatgaagcgtctcagagacgaagatggatcacgctttaataactttcagattcttcacaatcgctacgctctgttaaatcttcttggaaagggagggtttagtgaggtttataaggtatgcccttgcttcagctttacttttcaaaaactattcaactaaggtcagtcatgacctctttaaataccaactgcttctttgcttataaagaagaaacatcgaactttatgattatttgtttatgactttgatacacacaattattaatgtaacataaagaaggtaagcccctatcggtgggctgcagtgggtcccacccgaaatggcctaaaaggtagaaatgtaggaagaagtcataaaaaaatgaaacaaagtggaggaaattagatatattgaaacaaatatctgaaacttggtgtttggaattaaacattgagtagaacaactgataacacacatgtagtattacagttttctcatcaaatgttccttgacccgtacacttcctctgtcaagatttgtaaagttttcgataatagctttggtacttatatattcatgttaaagcatttaactagtgttttgagcttcatttggtgaagttacctcaatgtttattgatatagtatctttatctgtttcatagaggattcaattttggtatcaccagcatttacgtgagacagtttctttctgcaggcatttgatttggtggagtacaagtatgtggcatgtaagcttcatggtttgaatgctcagtggagtgaggagaaaaagcaaagctacatacgccacgccattcgtgaatataacatccataagactttggtgcatccaaacattgtcaggctatgggacatatttgagattgatcacaacacattctgcactgtcctagaatattgcagtggtacaacaaatttattttcgcaacgaccttccaaatttctttgacatgacaatgtagatcgtgcggcctcttttataaatatctcccattggcttcattgtatagataaggctgcatgggtgttgtttttatgccagatatatattgatgttctccaggcactcttctgtgtcaaacattcaatctctttgcggaactgttctgttcttttagtaggaatcttttttttttctcgaaaacgcaggagagctgcatttcatttcattattagtaggaatcttaattaggttgttcttggtgaagagagtagataaattttgcctgaatgttgacatgaaagagcatttataatagttctgtagattcagtagctgtttgttacatttataacttccacactcatttagttgtcttttagaatcatttaccataggatcagtttgtgcattcatggcacattatcatgtgggacacataagcaaacccaccatgttcaatcacttacgtaagaagcacgcacatagccaggatggggcatgaatatttgactgatatctgatggataatgaggtcattatttaaggcggtgaacataaaaattaatgaagcttaattggctctaattggttaatgatagaggtttcttacttttttgttgctatcttcgaataggcatacacctgaataggccctttgaggttgtttttaagtggcatgctgtagtatctttaattgttcatgagaccttggcatgtaataatgctacatcaattgctaccttttatgcaggcaaagatcttgatgcagtccttaaagcaacaccgattcttccagaaaaggaagcgagaatcataattgtccaaatatttcaaggcctagtttatcttaacaagagaactcaaaagatcattcactatgatctcaaaccaggcaatgttctcttcgatgaggttggtgttgcaaaagttacagactttggcctcagcaagatagtggaggatgatgttgggtctcagggaatggaactgacttctcagggagctggaacctattggtgagcgtgctcacttttccggttgatttctgtgtactaaattgataaaatactctatctgactacctcttatggaatcttttatctgctggcattaaattggtatacatggtgcaacaatgcctgcactgtgtagtagagttgcacacatttgatgcatcattctagaacctaagggaattaatagttattgcatgaagtacaaccattttcatgctactatctaccaatgaaatattttttttctctagtgtcttatgtaaacaggtgggatagaacaaatgatgtcataaatttagtttttatttatgttagtgttgctgtttcccatttagaaccattgttcttttggcatgtcaatcatttgtttcctaatgttcttctttttcttccaggtacctgccaccggaatgctttgatcttagcaaaacgccatttatctcatcgaaggtatatttggcaacatgttttccttttaatgttaataaatctttcatatcttagtgtgttaaagcaatttgacaaaaacatgcatcaataagatccttctataaggatgttagggattcttgtggcgtttgtttgtcataaacagagaccgcagtcatgcgcaaatcatgctcacttgccaaattttcagcattcattaagtagtaatccctagtatgttaatatgatattagcattactccctctggtacaaattataagatgtattttgacgggcattgagaacgctatgacactacgtggagataagtagagaagatgagctttctatccatacttgaaaacctcagaaagaatatacttcgtagtacaaaaacctggaccattgattgagttagtgagctccttggttctgctttttgccagttggactgcacttcaccggtccaaatgctgatttgagaaaataatagttttgccagtttggtaagtaaaataacaggctgaatatactcgtttgtcattaaagcgaggaaatcaccattatccagttggttaggtacttagatgcattgtgggagtactttgcaaggcctgtcctagttgcagggttcaattcccagcatacataacattttttatttttatttttttgcatttaggctgtgagctggtaggactggatatggttttatcgtagttcgtatacatggaccgacattcttctaagccaaaccagaccattcactggttcagatcatttctagttttaccaccgtccagtccaattcttgcactatggaaaataggaagaagatcaacatcatgagagtgttacttaatacagaacaggaaagaggtggcgaatgaggaaaatcagggaaaactatcaagaaactcacatgcacagcttaaattgtgtcaatatcgagacaattatgtgccaaatagatcagtctgatagtagttcccattggacagatccaggggaaatggccgtgcagatggttagttttcagaaggaggtgcaagagcaggaaggtgcaggtcacaggtggtgaattgatctgctgttgatggggatggggaatactggttgggcttagtggtatgcaggcaatggccatgtggatatgcaatttttactcaaaatgttacgcgattccttcttaacccttatttcagttagagtcatttgtgaaccccctgagtaatcaatttaaaccacttatgggcaacttcatctttgttctgattggtggtaaaattgatgtttgcattcctgcaggtggatgtttggtcagcgggtgtaatgttttaccaaatgctcttcggaaggcgtccttttggccatgaccagacccaggagagaatacttcgggaagatacaatcatcaacgcacgcagagtggaattcccttcaaagccagctgtatcaaatgaggcaaaggtatgtttactgttatctctgatttcagagtcatcagttagattgatcccttttactatattttccatgttgtgcctttgaggctgtccgtttggtttaaacttttgtccctcaacacactagtttaaataacattgcacatagtttggcaaaagtttgaccctgcatcacctgaaaactcgcaggaactgattcgtcgctgcttgacatacaaccaagcagaaagaccagacgttctaaccatcgctcaagaaccttatctgtcttatgcaaagaggtagtcactccgaaagagtgcaggacaagattttggatcggcagccgctcgcgcaagaaccccggaacatatttattttggacggggatgggcaccagcaaatggtaagaatctggcaaagctcaagaatatcccgaagggtgttactgtatatttgtaaatatcacttgtgcccataacagcaatgactagaacggcaagtgaacctcctctttaatctagaggaggtagattaggcgttaatttttgaacgggccatgctcttttgctacttcttgatgctcgcacgcgtaatgtgacgactttggctggtgcccagttgttctgttaaaaatgggttgtttacgaggttgttcgtcggcaaggtctgccaaattaccgttcatgaaaaatagatgaaccctcaaaattcacctcagaagaaattttctcagaaaaaaaaaaacttttttggttgcacaatgtggtactcttgtcatttctgtgtggattcaatttggacttgaggagcaatacatcaattcgggatgctgtgggtttgcttcggcatggcagacgatcagagacttggacggcccacaacatgcccgagaaaggccaggcacgaattcgcccccctctcctttgtgcaaccgcgcgcatcgcttctttctatcgcgctgccgcgtcggtctgaagattctccgccgtcgctgccgccttcacgcccatgctgcctctcatagaagatcaacgggccaggtcggtacccctatatgtgtgcatctgcttattaaagaataagttcactttgactccctcaaaagtgacccgaatctaattcgtgaccctgaactccaaaaccagatatgttgatctctaaactgttaaaaccgatgcaatttgactccctcagcggttttggagggtggttttgctgatgtggcgcctacgtggcgatattgacagagtctttgttccacgtggcgttgacgtggcatttacgtggcattagaattaaaaaatatgcgtgggacccattagtcattcacacaaagaaatgtgggcccactaacatgtggggccacatgtcagtcctccgtgtctcccttcctccttctctcccttccctctctctccccttccaagtcggacatgcgcaagggcgtggcggctcaccgggatccccgccgccacgaccacatcgctctgccggcgccgccctgatgtcgcccaccttgctcctcgcagtgagccgcgccgaccacctcctcccccgctcgctacttgatgccgccatcggcttgctcctgcccgccgccatccccattgacgcatcagtcgggaccaaatgcgtgagacaggagacaaggaaaggcagcgtcctgatggttcggagaactcaatggtatcctgagctaccgctaatgcctttggctaagaagaggatgaggaatcagcaatcatagacaatgcctccagcagagtttgtgcagatgttgcttgccccttctctgcacacctgaagtggaagaagcaagctcaatgagtagaagaacaacttatatgaggagatgcacaatccatattaccaccgtgagatgtaagttagctcacgaatgtgattaagcgttacatgatatagtggtataatttgcaaaagagatggatatcacagccgaacaagtaacatacagattaaccaaaaatcatagaaagccccatcgacaatcacttggaacatagggaacgtagcatggagatggcggagagtaagaagcacgggattagggattggattggtgacacccagcggaagcggaaacgcaaaccaggccgactattcttcctcctctcgctctcctcccaccctccgcggcttcgccttcgcaaccgtgaaaccgacggaggcttcgggatgcggccgcggcagcgagaaatgaactccggcgaggggaaaaatcgaagcacttatcggtcggttcccagcagcatgcgcaaggttgtggcggttcgccgggatccccccgccgcggccacatcgctctgccggcaccaccctgatgtcgcccaccctgctagtcgcggtgagccgcgccgcccacctccttccctactcgcggcttgatgccgccgctttctctaccaccgccaccaccggccgaagggaaagaagaaggggagagaaagagagagaaggcagagatggaggaagaagcaatgagacagggaggactgacatgtgggccccacatggcagtggcccacatttctttttgtgtgaatgactaatgggtcccacgtatattttttaattttaatgtcacataagtgccacgtcaacgccatgtggaacgaaaattcggtcaatatcgccacgtaggcgccacgtcagcaaaaccgctctccaaaactgctgagggagtcaaattgcaccggttttaacagtttaggggtcaagatatctggttttgcagtgcaaggtcatgaattagattcgggtcgcttttaagggagtcaaagtggacttattccgcttattaatatctttactccattattctttagaaaggtttggacattttaaacgcaatttatggtgcatcgagacgaagccatttttggtgtaaatggaatttctcataatcaaattgatcctcattatgctcgccaatgaggatcgagcatacaccaaaacagagaaaaatagtatcaagggaaacaatggcagggagtacgaattcccatttagtgaaattttcatctttcctatatctccttatcactgcagctaagctagctagtaggtcctaggctgggtggtgaggccgaatccgagcgggaacagcgggtcgtagtgcgcgtcgccgtagttcatcggcagctggtccaccgacttgaaccacgtccgcggcagcttgccggtgaacccgtagtcgccgaacagcacgtcggtgacgccctgcccctcggtccccggcagccacgcggcgacgagcgcgtccatggcgcccaagaacggctgcaccaccaccggccggccgctgatgagcaccgtggcgcactgcgcggcgccgcataccgtcgccaccgtgctcggcccggggtccgggatggtcaggttcaagctgtcacccttggtctccgtgtacgggtgctcgccgaccaccacgatggcgtaggagaagccgccgttcttgacgaagtcggcgtcggggttctcggcgaacaccaccgtcgtcgacgggtccaccgccgccttcacggcgtcgaggatggtcatgccgacggtgatgcggccggtgtcgccctgccactcgatcgtccagccgccgcactggtagcccaggttgtcggcgtggctgccggcgacgaggatcttgggcgccttcttggacagcggcagcatcggcttgtcacttgtcttgccgttcttcaggagcaccagcgacttcctcactgcctccctcgccaaatctctgtgttcctggatcacaaattcacaattcaccgtcaataatctcctgaaataaattgaagcaacattatgatttgattgcatcagattgtgtcactagttaccttcttccccagctgatcagccatgctcgaatcgggcatggggttctcgaagagtcccatggtgaacttgacgcgcagaatcctagtcactgcgtcgtcgattctgctcatcggaatgatgccgttgttgacatggctggtcaggatgctgatgaacgactggtagttgttcggcaccatgatctacaagtaacatcacaattaattaatcatcttgaaatcaaatacgcttgaatctaaaacagcaagcacacttgtactaagagtgacaagaaagtttgtgttctcaccatgtcaatgccggcaagaactccagcctggacagagtaggagtagtttgaacctgctggtgttgtgatcctgtcaattccctcccaatccgagattgtgaagccctgaaagcaacacaaacacaaacaaaactcaagatgatgaacatctgaaaaactacattatcacatcaatgagaatctgaaacaagtggtttgggttgatgtctcaccttgaaattgagcctgtccttgaggtagcgggtgacgaggtcgtggttggcgtgcatcttgatgccgttccagctcgagtaggagatcatgacggtggagacgcccttctggagcgcgttgaggtacgccggcatgtggatggtcatcagccctcggcggtcgatgatggtgttgtcctcgttgacaccattctgcgtgccgccgtcgcccacgaagtgcttggcgcacgccgccacgttgttcctggcatttcgtcgaacacccagcgttcatcaggcggacgaacacacaaagagacacttgagtggcactgtgtgtcacgaggtgttcttgaataggacttactttccggcgacgtagggcatgccgctggtgaagttggccgggacgtcgccctgcaggccggggatgagctccgtcatggcttgcacgatgcggtggtcctcgctgtagctctcgtagcacctcccccacctcggatccctgcacacctgttgttgtttgatcaacgtcaacgccatgagatcccccgatccatcgccaatgagagttgaagcaaagctagcactgtggctggtggtgacctaccgcgatgcacggcgcgaacgcgtactggatgccggtcgccctcacctccagcgccgtcgcggcgccgatcctcttcaccaggttcggatccctgctcaaaaacatcaaacaaaaccggatctctcggttagtgaaaaatggaagcagctttgcaaatcttggggagaggagagctgcttgccttgtggcgccgagcgcgacgttgtgggggaagatggtggcgccgtagacgttgttgtgtccgtgcacggcgtcgatgccgtagatcatcgggatgccgagccgcgtcgagagcgaccccttctggaagtcgctcaccatgctcacccactccgccgccgtcgcctgcttcctcggcacgctcccgccgccgctaagcaagctccctgccacgccacccgcaaaacaaacacctcagctcgccgccgccgccgccgccatggccgacggctgtgtctctgaagaagaacaatgctcaccgatgaagtagtccttgaggacctgcggcgacgcgacctgccgctcgatctgcgtcatctggccgatcttctccgcgagcgtcatccgcgccaggaggtcggtgacgcgcgcctccaccggcttggtggcgtccttgtacagcacgtattgggcctcgccgtacgccgcccaggtgagcagcagcacggcggcgaccaccggcgccgcgagcaccgccatcctctgccggcgaaggagcgggagcagccgcctccggacctgcgcgtgccattccaggagcacgatgagaaaccccgtgaagcaaccctccagcgactcgagaacgccggagcagtgtctccggccgccgccgccgccgccgttgccggccattgcgggcggtcggtcaacggcgagaggagccaagaatgcagagaggaaacgcggcaagaggaaaccatgacgtcctaacaaactactgggtcaaaatcatcagagctatttttaatttattcgcaactgtgaaagaaaaagacactgtttttccactgtcattgcagatctctagcagatgttaacaatagtttattagcattctctaatggacattttaacagaatgatttactcctaacaaagagattaactggccactctactgtagagttgctgtgcttttgtacttgaaaaaaatagtaccaaaaacatttggcaaggtgtctaaattctcaaacagtaacaagaactaaaattttactttgcaaactaacacaaaaactgaagtttggtatgaataaccaagcaaaacagaaataagctatgccatccatgaaggcaaacaaatcaccagaagcagaagcagagtgctcctcttgcagttgcgaatttgcactgctgcaaattgtggagcctttgcaagaagaggaaggagccaagcttatatcagcagcagttcagcacagctgcatttctctgttcttgcactgcacaattcccatgagagaaaaggcaagcaaattcaatgcgtttgttgcaaccgactggaatctctcgccccacacccaaaccccaaacccaaagccaccatttttgccttcctaaagctcactgtatgcatgagcaacggctagatagacggcgagccctgacacgcagtaaacgccaagcagtgcagtgttcaccgcgtgtgcgtgtgcgttactactgtagtttatttactaattactactattagggagaaagaaacctccatgggtggaaggatggtctcttggtcttaccagaaagccgagttgcaggaaggaagaaggtggctatggtgggtgagaagatggagaagaagaagaagaggcgtgcttcctgctctcttgtactccgtctcccggcgatggcttctttatataataaagccaggaaatgagataaggatcgaggagtggttggagcagcaagggctatggagaggcatggcctcatgaaggccgccacaatgcggtccaatcctcccgccgaaaaatatcatcttcttcctcctctcgacagtgcggcggaattgttggcttccgccacggcgaaaacaacggcatgagacagaaagcgagagaaagagcaaaaaaagctgcgcgtgagttaccgaactcacgtgaaccctccctctacaagagtttactacagtttactcgaggaagacgacgacggcgaccagagcaaatgtgaaactgtgaaaaccgtgccatgccgtcaatcaagcaagcacacaaatgacgcaaaaaaactcactctctgctgcagcttcttgatctccatgggaggaggaggacgatgcagagacagagacagagcgtgagggaacggacgaacacgaggccggcaatggcggcagagaggagacctagctacatctaccaccaaagaaagagagggagaagagtataaaaaccacccgtcgagcgcggtggtgacggtgccttgccgatgaggcgattacttaccggagtttagaagcgacggcgcggttgcgtggcgaggactgacggcgacgggcgcggccgcgagactccacacgtacgaacctcgccggaaagcgacgcctcactcacccaccaccacgaaagcacaaacccacccactgttcctctgcaaatcttatatccacaataccaggataattcttgcccaatccccaatctcctcctccgatccactgcccagaaaatggcagccaagaactcgcaatatgccaagaaatggcaggaggaagaagaagaggaggatgaaacgggccaaacggctaggtatggggtgatgatgagatgggtgaaccgcccaatcgacgcagtgatttttatagcgcggcagaagcacgaacacgaactgatcatgagacgaagaaacggacacggatgatgagtggcagccgggcaggaaaagcgcgcaggcgcagaccaccctggcattagattagcaataaatcccaacgttcgagtcgatccgacggccgagaacgctctggaggtggcgccggggttgggggggttaggtacttggaacgtgagattgcctggtttttttcctttttcttttctgtttcaacgacgctttttcccacgagaaagccaacggctagctcaactcaatcccatcgagacgtttattactcctggtgatgcagatctctatgcttgttggtcattgcatctggatttctttttgctcgcttcacgagatgcagttgattccatacttttgttctgttctggagtaggaagagtagttttcaatctcttccgtgacaaaacctgttttcaggctgcgaaaccgggacgcaatcaatgtattcccaaacttcatttagacctggtttagttgccaacttttttatcacatcgaaacttttctacacacataaacttttaattttttcgtcacatcattctaatttaaatcaaacttctaattttggcattaactaaacacaccctcacttcaaaagcttggaacaaagagatgctaaaatctaagaaaataagctttatctaaaaaaaataaaatctaagaacaaagagatgctacaaatcaaaagcaatgaagctagagagtaaattggcatgcatcctttttaacgtaaacgagtgcttttcacgcaaatgcatgcccagaggaaactagcaacaggatgcaggtgcaaactgtgagtagttcataattactccctccgtcaaaaaaaaaaagagaaactctgggtttccgtgtccaactttaactgtccgtcttatataaaattttttataattcgtattttcattattgttagatgataaaacatgattaatattttatgcgtgacttgtctttttaattttttttcataattttttcaaataagacgaacggtcaaatgttggacacagaaaccagagtttgtcttttttttttaggacgaagggagtaagtcgtgagcaattgttgatgtagactctctcaacaatctgtaaaccgcgtggattaagattaattgtgttcttttcttatgtttttcaacttaatttatacaagatgatgtccttgatatttcctaaaacaaaaacaaaaaagaaatgatgtccttggagtaacatcttctccctcctcttatagtatgattatatcgttgaaaatgatccatctgttaaaaggatcattcgaagacttggcaactatcattttagtagaaaagaagacgtgggcagtgatactgatacagaccatacatatacgtatacaatgtacttatgtacgtaagggttccggtgaagaaaaaataatctgaaatcttttcttaagagcataaatctgacacacacatgacagtagtagttattagtagtagaagtattggagttaatgtacgcttggctaatggaacaaagtttggatcacgtacaaggaacaaattaagttagtgacgggtgattgatgtagccatgtccttttattatgcattttattgaaggtttgtctttgctttgaaatttccctgtaaactcgactttggttgcgtatctctttgatatgcgggaactaattaacgagttaatccttatactatcttaagaaaaaaaaatctatgggcatgcaagcaacaatgacaaaagcagatcaaaaggaggatctcgtgaaggaacatgattgaaggataccaggaccaagataatgcattgatgtataccatatttattgaatttagtggtcactttattcaggacatgctatgttgctattgcgtgtgctctcacgtttgtccacaatgaaatgtttatcttagaaaagaaaatactccctccgtactcataaaggaagtcgtttaggacaatgtttaagtcaaaccttgggaatataaatcatgaataattcttaatttgttgagttttaagatggaaaaattatatgaatagatttgtcttgaaaaatactttcataaaaatatacatatatcacttttcaataaatatttttatagaaacaaatagtcaaaattgtgttttgtagaccgtgtagctgtcctaaacgactttctttacgagtacggagggaatattaaaaatccccttatgttttgtagtaccaaatgtttctcctatctcgtgctccacgagcaggtttcatcagcggcagcagatgtattgctttatttaggtgttgtttagcacaactctatattctagatccaacgtgatataccaaatgtttgatgcggatctaggatataggctatatctccctttgtttctaaatatataataatgctatttacttttagatatggcatttaaaaattcgtctagtgcaaatataagaaataaaatcacaattaaaataaaacaagtcagaataaaataaataaaactaatatagtttttcttactaggacaaaatgaccaaacatcatgtcacgtttacaaggcagttagtagcatcatatttttaaaatcggaagcagtatatatctcctattacatgtaatccttatagcaggtacaatactagcagattattagccggctacaaatatattttaatgagataaaagttaagagagaagaacagcgggctacaaatctatagctagttgcagcacggactctaagacgcaatgtgtgtatgacaggtgggaccgtatattaatagtatagtaagcaactattgtatgaattggctattagattggttatagatgaattgaagttagtagtgggctatactattaaacttgctcttagtaatttaacttcaggcttcatgctttaccgaacttcgaaacatttttgcttccgtattttagcaagagatttgcatgaacttcccaatccgtacgtttttttgacgatccgaagatcgtcttgtgtcgccggtcaatccgagggcccagagcaagtacatgctcagctcagctcaactcttgccattcaaacttgcacatgctgtactgaacagaaccacattgtggttgcccaatgtgtactccaggatctgtcgatattctcgtcatcaaatacccaagcctttgccaccttgaggtacacaatggaaaactagtataagagcatctacaatgtgccataagaatgagccataagagcttatgactagtcatatacattatatgcactagccataagacattaaatgctaaaaatagccataagcttatggctcaaccttaaaaaataaaataaaaagataaagcacagatgcatgctaaagaggatgagaatagattattgtatggtgagacctactttaaagtagaatttgtttacatagatgtgggatccatcttaacacctattcttgccttcaacattgtggccatagacatagagtatagtgggatctaccttatttctatcaagaccttaagcattgatgttgccctaagttctcaaaaaaacctataagttaagctcttttctttttagattgtctatcggattattttctctcttcaacaatgacggagcgtggggctcctccccgggagaccgcgcaggccccccctttgccggttcggccgggggcgctaagtgaggttcttcaccctcgatctgtggaatgttcgcgagagagcaaatgcacaagacacgggcgatgtagacaggttcgggccgctgagaagcgtaatactctactcctgtgttctggtggatctgtgtgtgaaggagttacagagagctggagagcaagagagttcaggctctagaacccttcttcctctttctttcctctacgagctcaggtattcccagagtcgtcccccccttttttttctttttttccctttctttggtgggcaagatccaccttttatatctcaaggggataccacatgcaccacgtctacctactcttcttttgggtggggacccaccctatcttgaccaaaacttggctcgcgccttcgcctggcacaggggatatccctgtcattccttcattaatgggttgagatttgcaatggccgctatccgaatgaccctccgatgggatgggtcatacctacctccactccgccggaagcagatgcaacgtgggagcacggttgtctgccgatgacatgaccggcgtcagaccagtcacaaaccggtcattcttgtccaccacgtgtcagtttagcatgctgcacgtctgcccttcttcatacaatgacttccttgccatggttgcgatgaagcctggtatgaatctggccgggactgacgtgctaattccaggagttagcacgtcggctccggctagggacgagtgcctggaggctctcatcattccgacgggacggggcgaggcgtgtgacaggccgcctgttgccacctaacccgcgatctgaccggtctatgaccggtcacacactgcgaccggtcacggaccggacgagcgcacgctgcgccgtattaaatgcggcgtggcgcgctcgtccaacccgcaataaatgcggttaggtgagcgccactgtgctcacctaacccacacacgtggcgccaataccacaggggtcggggcgccccagccctcgaggccgaaacgggagcggcccgacccctcggggagacagagggaggggtggccacgtcaccctcgggcccgacccccccgagggggtccggccacgtgggtgaccgcggctgcccaagcctctagtcacgatacccccggtcccatgtcaccgacaaacaattttttaaaatatattataagctatttattcagtttattataatatacaatactcttatatcacagaatgtaactggtcagatttgttcagatttgtagtaatatcaggatagatggatatttattcatccttaacattaagaacatcagtttggcccatcaattatatgaaaagaacactgcatgcattagcttcggtgggacatgactatctaaggtgcgtatcagagcaatcaagcagagaggtggcatatcagctaccgcacggtacttaatgaaagttgttggtgctatagctattaatacaacgacgatagtacggagtattagctacgatggtaactttagatggtgctagctacgatggtaactttttttcttaatcaagtttaatcaaatttataaaaaaatttatcaacatctaaaataacaaactaattttataaaatctaacattgaatatcaaaataataatatatttgttttatgttaaaactagtaatatatttctttataaacttagttaaacttaactaaaaaaatatcaaacgacttataataagaaaggatctaaagtttggattcaaacttcagttattttttatcacatcaacttgtcatatacacataacttttcagtcacatcatcttcaattttaaccaaaatctaaattttgcgctgaaatgaacgcaaccaaataaatggagtactccactggctaatgtactgtgtgcagtactagtggggaacaaatgatgctgcagagaagtgatgacaataatttaaccgggagcatgcttctcctcacatgatgcgatgcatcgcacgcacactcacactcgcagtaccacaccatgattaagctttggcgacaacgacggcggctgtctaaacagatacaagaccagatgaaacggccgccaaccacggactgagatgactccacagcccacggtgtgtatgtgcgtacgctctccatcgcttcgcgtgcacgcgacgcgacgctccatacgtgcaaaccccgtcgcggacgtgattgctatacacaccgttgctgcgagacccggcaggttcacgcgtggaaaacatcgttcaatcaacggctgccccgacgtgtacgctagctcgcctctcgtatcacatggcacgcagttaaaataaaaaaaaaggaaaaattgctaaatcgcattggacgggaaattatgagcaaaatcttacaaattttgatcttaggatctgctcggcaattcatacccgtcctcctcctctagctacagcaagatccaacgatcttaggcagtcaacggtgatcagtggtggagccagaattacattatagtgggggctgaactaaaattggccgacaaaaatcgagacatgtcttatgtaaattgactatatatctaatacaaagtgtaaatatatagaattaacgagaaataagtattatccataccaaaacaatcttgaaatatccaatagatgatgacacgatgtgcgacactagcacaccctatcgccaattattcttcatcaggggtaatctatacaaaagaaatgtcaaattaatgaataatgacaattaacaaacaatagcttcaaataatttaaagtagggaatggaggcatggagtagtaacatccgacttgctttcatatcttcaaacctttggataattttttcattactaatacttttaaaaatttgcttctcactatctcagtatagcatatcatcgagtcatttagccatcttcacaatctagcaatataacaaagtagcaaactaggaatcacaatctatgattttttgaagacttgaactatcaataacaactagacatgacaattgaaattgattttaaatgacaaatcagaaattttatatacctcacttgctcaaatcctcaattgttgagttgttgccttgcctcttggcgctgttgcttgccttgctgccttggtggttgcctggttggtcctgtccgcctttccgcctgccttgttgctgccgggtgttgctactagctagccttgtaacctcttaggctttagaagtgtggtgtgcaaccgcgtccccccgcaagcccgcccgcgcgccgcgccctgcctggctgccttgctgccgaccggcgcccccatgccccagaggccagtggccggtgagccgcgtgccctggctgatgcagtgccggcgcgccgtcgccgcgcgtcaagtcccatcggcggcctctgtccgcctcaccggcgcttggagctggaagccatcgcgcgccgagtgcactcgtgtgccgccgccgccactagtctccgcctctcttcggctggggaaaaaaaattagggttggccggttgggtagggttgtgggatattttgggccttcccagcctgttgggccttctaaaatctcagaacaaagtttattttagaccccctttgggattaaaattgtagggggtattatgtgggctctaatggttcgttagggggtagtgggggcttgagaccccctgcccccacgctgtctccgccactggcggtgatctaacgagtttgggtttagacatcggcatgaagataggctgagggcagggagtgggaggatgttcactatgcttaaatgcccttgggagatgacggaacggctactactttgtcgaggctatgagatcggatgcgaatgatgggccggtgtagcaaacagggtgtgggattctaacccgttaggagtctgtgttagtgttggtgtcccgccaaagacaagctagatggtggaatggaacaccttatcactacccagcttgggaaggagaaggaccgaagggagtatggtaaggggaggatcagtttggtctaatgagtctcactagcacctttagggcccctttaaatcatagggtagaaaaaacagaggaataggaaaaatataggattctgacaggaattgaagtgtaaaacaaaggattgcaaaccacatgaaaaacacaggaatggtcatttgattggagcgcagaaaaaacgcaggaatcggatgagagagatagactcaaaggaaattttccaagaggttggagctcttgctaaatttcctccaaaatccacatgcaatgtgccattccataggaatttcataggatttggaaagcttcaatcctttgaatcaaagggccaaataggaaaatttcctataggatttgaatactatgaaattcctacataaatcctttcattcaaaggggcccttagactgcgttcatttccaggggttcccaactcccccctcttgttttccgcgcgcacgattttcaaactgctaaacggtgtgtttttttgcaaaaaaagtttctataagaaagttgcttaaaaaattatattgatacttttttaaaaaaaatggctaatacttaattaatcacgtgctaattgactattccgttttctgtgcaggatggattagttcccatcctcctaaaacgaacacaaccttagtgtcttttggcatctgcgaggctaggaggggggaagtgtggcatacgggggcgggcaagaacttggagttagcaatggcatactccctccgtccgaaaaaaacgaatctatgactagatgtgatatattctaggacaatgaatctggacagatgtatgtctagattcgtagtattaaaatgtgtcacgtatagttatgttagttttttatgggacggagagagtaggctagagcaagtgagcgatggaaatggagagaagggaataatgatgatacttttatgaatctcaaagtgaacaaatggtccaaaaattgcaagggggaggtagtctatcaactgattgttaggcagtaaaagaaaatttactaactaacattggacaagaaattaggaaaaaaaagatcttatgtatacacacacggaaggatttaaggggttggcaactgcacgaggtcagccgaccatcagcactgcccgattggatgagctgtgagtctacattggccggtctttaattcgttcgttagtccaacaattgagaattcgtaagatttaggtaccgattttcttgcgcaagttactttagatggtccaaaaaaaaaaaggaaaacacggccgtttctcgttgcgccgtgtcacgtgaacttagctagccaccgagcgaggcccatggaatcatccatctcgtgccgcgtcatctgcgttcatgcacgaagagcaacatcaatgtatttggcaaactagttcatagatgtgggacccacacctaggagtccatagttttagaaatcaccacaatgtgtgtaattaaggtgggtcacactaaaggcaaaaaaaaattagccggaacagaagttgcaggctgcagcacgcatgcacctggcataactataattttttattgtctatggactacccataatgctatggacaactttcattatttctttgctatagactagttgtacaatgtgttaaggtagctgaatggaattttttattttctatgtactggttttcatgtacattgtggatgctctaacgctggagagggaacacggaagacagcgacccggctcggacagatccggaccctatactatacatatcccggcaaaacaacgtgatctcgccggcgtcctatataaccatggaccatcgatggtatgatggctggtactcctatatgatgcctttcttcgccggatatcttccgtgaggtaggacgtctgcatgtgtgccgcccgggtccactgccgcctcgcttccgtactgtacagtgaggcggcagatatatgtatactccagtagtaataacatgtcacagtacatgtacgctagctgtacatatgtaccaagggttgtgctccaattctccaaagctacaagactgtagtactagtagagaacggcctaacccctgaagggatatgcatggagtgggtaccgtccaaattcaggacgcacacgatctagataaccaacggtctcgtgggatgctgacgttttttggcactaattttcagcaggtgagcacctaccgttgcgttttcttgtagtcactttcgtgtaaaaaggcggataatgagccaaggataaacttattatactgggacatatcaaatcacgattgcatcacataaagctgagtcaccagatctacccaacgtaatccttttgtggtattgcaagctacgaaccggaagtcagaaacggaaacctgggtgacttgtataggttgctgggaaaagcagcggcaccacacgcacacgttcactcgttcagccgatgcggtaaacgtccccggccggcacgtcgcgatcgcgcgtgcgccccgcctcaaacgccaagcccaatagccgaacaatcgcgttccggcccatgaacaacagcacaagtagcaaaacggggcccaaacgtagcgacactcgcgttccggtcggcacgcacgtacgctggaataagtccactttaagtcccttaaccagtgaccgaatttgattcatatccttaaaccgcaataccagtgttgacgtaaaacacgaggcctatatctgcttaactccagtgcaggtccaaagctcgccttcgagtgtgttagcgtgccagttgatttgatcctgcaatcaacaagaaatagagacaaagagatcgtggttaaatctataaatcataaccgatcggctaggtgccgatgacatatcatttatctttgagccgatgtcatataagaatcgatcggcggttataaataaacaataaggaactaaatctattcgatcggctgtacatattaacgatatatagttcttatatcgatatataattaaatcaagtgattgggatagatcggtcgccatgccgagacagtataaatcacttagatcgaaatatatattaataacaggattatatgtgtttatagcatagccgataagatagatctagcatgtatcggctaatactccgatactactctatgtcaagatatctgacggagcgtggggctcctcaccgggagaccgcgcaggcccccctttgccggttcggccggggactcagggagagattctaagctctctgtatgtggaaggctcgcgagacaggaaacacacatgacacgggcgatgtatacaggttcgggccgctgagaagcgtaataccctactcctgtgttttgtgggagatctgtgtatgaaggagctacaaagtatgagccagcctctcccttgttctgggtttctaatctcgaaaagtccagtccccttctcagtgggcaaggtcctccttttatatcttaaggggataccacatgcaccatttctctctttttttgtggggacttaccccaccttttcataaacagacggagacttgtatggttgccgtccgaatgaccttctgatgggacggcccatacctacctccacttccgccggaagcaggcgcgacgtggaatcgtggctgtctgctgacgacatgaccggtatcagaccagtcacgtcggtcattcttgtccaccacgcgtcagcttagcaatctacatgctcgtccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctnnnnnnnnnnnnnnnnnnnnnnnnnnnnnnnnnnnnnnnnnnnnnnnnnnnnnnnnnnnnnnnnnnnn

SEQ ID NO: 27601 - DNA, 10901 bp, Oryza sativa
accccctcggggggactaagaggagggcgaacacatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaactgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgataaacgagggggcgaaatagtgggcgcgagaagcgaggagccgggcacagcactggcaagagtataaaggcactgaggaagggatctgtttccttcctttcgccattattcctcttgtcttcgccgcttgcgccctaactccttctttcctgtgccctaccttcgccacacgcgctcgctcttaatcttctcttcctccggcgccatggcacggggttccgctctgctcgatggtagcgtgctgccgcctttccggatcgtgagcgagaggcaggctgggctgtcgcgccgcttcatgccggaatctgccaccggccgggagacagtcacgctgggcgagggacgcccggcgccagactacccggggcggtccgtcttctttcttccctttgcaatggcagggctgattccgccattttcttctttcttcatggatgttctggagttctacgacctccagatggcgcacctcacccccaacgcggtgatgacattggccatcttcgcgcatctgtgcgagatgttcattggggtgcgcccatctcttcggctattccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctctagctggcgggcgtcggtagatctgggggatggctatgacgccgtcctcgaccgcctggcgggcctgcgatcccaggggctcacaggggccatggtgtacggcgactatctccgtcgtcagattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggtcacgacggcgcaggcgggagccgcaggggggaacaatctaccctgagagggggtcgtgcttctgggtcccgcgacaggggtccggggagcagccgccctgccgacgcccgggggaagaggaagcagggaggaacacctcccccatctcctccccgagggggcggggcggcgcgtgccagcagcaggcgcccggagggggccgcgccaacatcgcagcccgagggggagcgcaagaagaagcggccccgcaagatgggggagacagaaccatctcggggaaacctcatttcccctccaaagtggtcgtttaaccgacccccccgcaggttcgtctctcacccatcgtgactgtattctcttaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgagaatctgaccggcgagaggccgcggatcgcctacgggaagccgaggaggccgcccaggaggccgcccgggctcgccaggccgaggaaaccgctcgggaggaggccgcccgagcccgccaggccggggaagccactcgggaggaagtcggatttcgccaggacgaggcgatggcgacttccgaggcagctcgcgacgaggccgcgggcgcgtcgcttgggcccactccctcgggcgacgctcaggcgacaacttctggggcagctggcaacgaggctgcgggcgcgtcgcttgggcccactccctcgggcgacgctcaggaccaaccgggtccgggggacatccccgagtccggcacttccatcagcggcccgagccgcgtggcatcctctccaaggcggctcttccccacgccttctatcgccccactgaacgcagagccccttctgcaggccttggccgccgcaaacaccacggtgttggatgggttaagtgcccaggtggaggtcctgcaggcagagcgggcggagctcgacgccgcgtgggcgcatgtcgaagaggggcgacgctcggtggaggccatggtggaggtgggccgtaaggctcaccgccggcacgtctcggagcttgagacctgtaagaaggtgctggcggagatcgccaaggaagtggaggaggagcggggggctgccctcattgccaccaccgtgatgaacgaggcgcaggacaccctccgccttcaatacgggagctgggaggcggagctaaggaagaagctcgacgccgcccagggggtgcttgacgctgccgctgcccgagaacagcgggcggcggagaccgaagcggcgtcccggcagcgtgaagaggcccttgaggcgcgcgccatggcgctggaagagcgcacctgcgtcgtggagagggatctggcggaccgcgaggccgccgtcaccatccgggaagcaacgctggcggtgcacgaggctgcttgcgccgaagaagaattcacgctccgcctccgcgaggacgcgctcatcgagcgggagcgagctctcgagggggccgaggccgcggcgcaacagctggcggttagcctgtccctccgcgaggcagcgcaggaggagcaggcacgccgcaatctggaaggtgcccgcgccgagagggccgtactgaaccaacgggccgctgagctcgaggcgcgggcgaaggagctgaacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcccaagtcccggatgccgacgaccatatcgccgacagctatgagggctcggcccctcgggttgcgttcgcccccaactcccacgaggagggcaatgccggtggtgcagacgacagtgacgtctaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccaaaacctgacacccgacccccccctcaggggtagaagcgacgaaggtgttcgatgttccacgggttaggcagctcagtgccgtcgcccgtggccagccgtatggagcccggccgggggacgccgaccactcgatatggaccctcccacattggtgaaagcttgctcaatccagcacgcgtttggacgcggcgtaggacgaggtcgtcgacgcagagtgatcgggcccggacatggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcaccgtgcttcttgagtatgttgaaggtcttggttttaaggcctttgaggatttccgcattggcgcgctccacttggcctttgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcctggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcaatggacgcgttcactcccttcgcggtcctcgggtagagtcttatctgtgaggtatgcttggatctcggcgatccaagcaatcaatctaagggagttgggagcactcccctcgggtcccgaggcctggactccgacgggcctcgggggtcggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtatttggcgcacgtaggcgtccatctgcgggtcagagcaccggtactccttacagacttggttaacgaccagctgggagttgcctaacaccaggaggcggcggatccccagtccagctgccactcttagtccggcaaggagtccctcgtattctgccatgttattggtcgctcgaaagtcgaggcggaccaagtatctgaggacgtctccgcttggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggtgcactcttcgtcccagcagcctcacggggcgcacttatcttctgtgctgatgacctcggggtcggaggataacaggggcggccttcccacggtggcttcggggccgtcctgggggtcgggggctcctggcgtcgtcggacaagcgggcaaagggccaactccggtcgtcaggggccttaggcctccgtttggctcgggggcctcttctccctgctctttcccaggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacaccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcagggttggcctcaatgcctcgggcagagaccaagaaccctagaagcttgcccgcaggtacaccgaacacacacttatcggggtttagttttatgcgggctgagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatcaagaaaacacaaaaggtcgcaccccgcagtggagtcgacaatctgatctatgcgaggcagggggtaaggatccttaggacatgccttgttaaggtcggtatagtcgatgcacatccgaagcttgccgttcgccttgggaacgaccaccgggttcgccagccactccggatggatgacctcacggatgaatccggcctccagaagtcgcgccacttcctcacggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccacaggaaggagacgagcgcgtcttcctatttgccgtccagaagaccaccgatccgtgtggtcttggacgggccgtcgcccagggtaacctccttgaccgggacctcgtcgcctgtgatcatccgttgcctcggggtggcgggggcggaagcgccaagcctctcgtcgccaccctcgggcttggatacagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggccttgatggcgtcaaaggccgcaggggaaaggatgttgagggccgctcccccatcaatgaggacacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcattgccgtcatcgatgtcctcggcgggggccttctgcttggcctcacttcgccgattaccggaaggaaccgccggggatttgccctctcggcgctcctgcctcctctcctcctcccacttcctcgtccgctcagccaaacttttgactgcacggcagtccgcgaggtcgtgaagggaagtattgtggacggtgcaccacttgccggttaggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctccttacgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacaagcgaagtgactcatcatcccttcgctgtactgcgtgcaagtccgcttcctcacctgggcgcggatatgtgccttggaagttcatggtgaactgttggcacaaatcctcccaagagtaaacagacgcgggtggcaagttcattagccaaccccgcgcttgtcctttcagggccatgggaaagaaattcgccataaccctgtcgtcacccccggcggcctcgatcccggtcgtgtagacctggagaaactcggcggggttgacgctcccgtcatatttttcggagatggtgggccggaaccttgggggccaacggacattccgaaggctcgccacaaaggccctacaaccgacaccaccaaccaggggcacggagggctgatccccgcgtccgtggtgaggtgacactccggacgaggaggcgccctccgttgcgtggggagcacgtcggccattacgccggcgctcgatactggtgcgagcatccggttccccacgcagatcttcccgggtcggaggcgttgacgaaggagtggcggccgaatggcgaacagcggctgccgctcgccgcgccctccgtcttgatgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcacgccctggggcgtgctgccgtcgccgtagacgaggaggcgacgctccccatctcgccgcccttctccacctcctgtggatgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccg

SEQ ID NO: 27602 - DNA, 5290 bp, Oryza sativa
  unsure (1)..(5290): unsure at all n locations
accccctcggggggactaagaggagggcgaacacatcaccctcgggcccgacgtccctcgggggtaccaggccatgtgtgcgattgtgtctgcctcaaacctctagtcatgatactcctgatcccatgtcaccgacaatatcaaaacaagtataatatatcaaataaaagcctaatatacttaaatgcaataagatcttaacataaagggcggatttaacatgtcactgaagcatatagagcgaatatggttaaatcagataagatcggctgaaactccgatactaccctaatcggcaaccagaaggcaggctagagattgatattctaagcacgatttaatggatcaaactcaactgatgcagcattaagtatgaaaagaagaacaatatctagacaatcaagccgctggaagtttcatagagtggtagatatcttacataatctaaatcaacatcggaatctaacctaatcggctgccctccactgacagatgttagccgatcgtaagttagatggcgatattgctagagattatgtaagatatatgataactcgacgaattatataaacaggattagagtatcataaagatggaagcactaatcccgagaacacaagccgtcataacaagttttacctcttgttaaagatcgaaaccgatgcagctcaacccgaaagtaagaactcgtcgaaataaaactaaagcaaaaggtgatgatgcgccgaaattgtattgaacgtgtgtgttaaaaataacatagggctcgaggtctatttatacccgagaattacaagatatgtccataccggacacgaccattatctctaacaaattctaagataccataagtctttgcggcagacttttgcccaaacatatctctaagaaaattacataaaacatcctaattaatagatacaattgcattctcaggactctatccatgtgtggcaatgatcttgaagcacctcaattcaacccgatggcatacaccaagttatactgtcggaatcggctgcatcggcttacctagtccgactcagacccagccaatcctaattgtagccgatctggactccagccgattcttgctctgttcttgaatcgatctctgcctccgactccacttcgatctaatctccttttctgatgctgatattaccaaatttggtcgataacaaccagatatctcaaactatcaactattaaaaccggtacaattttactcccttgacgattttgctgacatggcagtgttgttctgatttgtggcggtgatatgacgcttaggtgacttttcttttaacgaatcgtcgagccgccaatttcattgaatagagaaaggagtaaactacacaagatggcagaaagaaagaaatgtacaagctcagggcctttggaccgtgctaactatatagaagacagttgccaaaaaaattttgtgtccgctagaacccatgtctttgcttcctccttaatcttggctagcaagctggttgctaggagcttcttttgttagaaggtcctacgatttctttcattctatatctcccagacttaggcgacattagaatttaaaacatatatatgggacctattcgtcattcaaaaaaaaaattgtggggccactgacataagggactcaaagtggccacagtcgatttccggcccgtgtatgacaggtcgcacgtagaccgcaatgccgtttcggcccaaatataattgggccgcactcacgccgcaattccattcccctccccgtcctcccggccactgaggcggcgggagcctgatcgtgtgcggcgctcaacggagaacggcgaggatgtcgccgggagaagagggctccgccacgcatcgattcaatgcaggaaaaatctgggactacacttgtcccaactcccaaggaaccatcgcctccgcgacgatctgagtgcattgcagaatctctcgatgagcagcgggggcgcgatttgcttgtcgcgatggcaccgggttggctcggatgacagcgctgatagtgatagccaagaaggattcttcaggtgatagcttttgtgccatttcgctttcttctcaaagtggggagctactcggtagtagattttatttatttaaccttattttcgactaatagtactaagttttcatgaactacctttcatcataaaagaatgacgcaacacaagctgagtgccgagagaaagaaggcaaaagcgcatctgattttttattattccacaacccaacactatgacactaacaacagccacagcctcaagaattgagcacatcactcactctcatcgttattgcattcccccaccacaaacaaatccaccccaacaacatgtgtatgtagtactacatgatcgccatctctctcgtcacgacggcgtcacgtcccaaccaacgtcactctccaccgacatcgccgccgcatcagctgctgtgcgcctgcgtggtgaggccgtagccgaaggggaagagcgggtcgtagtgcgcgtcgccgacgttcatcggcagctggtccacggacttgaaccacgtccgcgacagcttcccggtgaacccgtagtcgccgaacagcacgtcggccacgccctgcccctccgtccccggcagccacgccgccacgaacgcgtcgatgccgccgatgtacggctccaccaccagcggccgcccggagatgagcaccacgacgcacttgatgctcttgcacaccgtctggatcaccgtcggcccgggctccgggatcgtcaggttcaggttgtcgccgaacccctccgcgtacggcggctcgccgaccaccacgatcgcgtagtcgtacttgtcgccggtgaccacgctgctgtccgggttctccgagtacaccaccgtcgtgctgggatcaacggtggccttgatcgccgacaggatcgtcgtgcctgcacattgtccgtggattttaattcttgccacccaccaaaactcagatgaagttacaagcattgaaacattttgatcatgaatagtttaccagcagtgatgttgttgccgggctgtccttgccaggtgatggtccatcctccacactgtctgcccaaatcatcagcatggcttcccgcgacgagaattttaccggctttcttcgggaggggaagcaccggagagtaggaggattttccgttcttcagcagcaccaaggacttcctgaccgcttcgcgcgcgagctcacggtgctcctatggtggttcagatggaattggtcagtaaaaattcttgatatatgaagtgtgagtaataggaggattgaggtgttcagcactgacttgctttccaagttcatcggcgaggctagagtcagcaaaagggctctcaaatagacccatggtgaacttgactcggagaatcctgtagacagcatcgtcaattctgctcatggggataattttgttgttaacttgctctgtcaggtcatcaatgaattctgtgtaggtataaggaaccatgatctgcaaacagcacatatacattaggcatgataaattgataagaaagggaataaagcatcgcatctgtattagtatagtagaaaaaaggctcatcaatgatgtgtcataaactcgtaataacaagacaagaccactcttctaacatgatgtatgttttaattgttgaatccaccttttatcccacaaactaaagttggacagactaacaaatcaaatgctttattggattttcaaaagagaaattaactatgactttatgcgtccttgacatagaggctagggatataattcaatcttcctaaaaaaaagggaagaagttaatgcacatggtctgcatatctcaccatgtcaatgccggcaccaattccagcctcgattgagtaagaatagttcttatgcggaggagaagtgatccggtcaatgccttgccagtcagaaatcacaaaaccctgtttgcacaagatccaaagcaattaaatacgcctgcaatatctccaaatatacattgaagaaaataaatcaagataactattttgtttttttagaaaaactaaccctgaagcggagcttgttcttgagaaaatcagtgattaggtgatggttcgcgtgcatttttactccattccagctagagtatgaaaccatgacagtggagactcctctaatgatagaattataataaggaggcatgtgaatggtcaacagcccgtgagtatcgatgattgtattgttctcgttgattcccttgaccgttccaccatcaccaacatagtgctttgcgcatgcagcaactttcttactgcacagtaagcaagtagtaccaaagttagtcatatagtagtatattgcagtgatacgccaatttcacctgtcaattataggcagaaaggtacaagccacaaagatgattttaaagctatacagtatcagaggtataccttccaccaacatatggtcttcctacatcatttgatggaacatcgccttgcaagccagagatgagtgtggtcaatgactggacaacctttgggtcttcgctatagctttcgtagcagcgtccccatcttgggtctctgcaaacctgagaggtatcatgtaaacacaacagtgagttcatagtgctgatgaaaagggaacacgcaccctaaccagattgagatcacccactatagaagaggtatcatctagtattaattaccgcaacgcaaggagcaaagacgtagggaattccagtagctctaacttcaagagcagttgcttctcctatcctctttactaggtcggggtccctgcaacacggcaaatcaagaatcaagatttttttaaatacagaccaccaaatgcgtcataagcaccctgttttttagaacaagcactgtgtgcatcacaactgtgttatcaccttaagatgttgcagtcttgtagtcaaacataaaaaagtatccacgtattgttgtgtaagaggtaattatcatatcaaaagtaaaatcacttcatacctggtagcgccgagcccgacattatgggggaagattgtagccttgtagacgttattgtgcccatgcacggcatcaataccgtagatcatcggaatacctagtcgggtcgaaagggcacccttttgcatttcattcaccattgaagcccaagcctgagctgatgcctgaggagcaggcacactgcctccaccactcagtacactacctgcatcacagcacaccaatgtcaannnnnnnnnnnnnnnnnnnnnnnnnnnnnnnnnnnnnnnnnnnnnnnnnnnnnnnnnnnnnnnn

SEQ ID NO: 27603 - DNA, 50925 bp, Oryza sativa
  unsure (1)..(50925): unsure at all n locations
nnnnnnnnnnnnnnnnnnnnnnnnnnnnnnnnnnnnnnnnnnnnnnnnnnnnnnnnnnnnnnnnntgttatcaccttaagatgttgcagtcttgtagtcaaacataaaaaagtatccacgtattgttgtgtaagaggtaattatcatatcaaaagtaaaatcacttcatacctggtagcgccgagcccgacattatgggggaagattgtagccttgtagacgttattgtgcccatgcacggcatcaataccgtagatcatcggaatacctagtcgggtcgaaagggcacccttttgcatttcattcaccattgaagcccaagcctgagctgatgcctgaggagcaggcacactgcctccaccactcagtacactacctgcatcacagcacaccaatgtcaaaacacaaaacatatagtatccagcatttcatcgttcacattacttgagcatgagtagtaaaccatgacacacctatgaagtacttggcaatctgctccgccgtggcattctccctctcgatttgggtcatctggccaatcttctcagcgagagtcatccggccgagcagatccttgacacgaacagagacgggctgcttcggatccttatacttgacatactgagcgctccccaacgtagcaaaacataacatgaggagaataacactgaacttgtgcaaactccccatcttggctcagtgtgagtgtctatctccaaccagagctgccaatatatagacctgtgagagaagcatatctatgagtgtaagcttttcaggctagtatgagggtaactacataggagcatagtagtgcacgtctcttgcttgaacaacaacatcttcaaacattagaatagtcaagactcaagagtctcttaggttgcaatcaaaacagaaacaagggaacagcatactcaaaacatggtcggtttttcaaacttgtttatccaatcgcatcaagttgctgaaaaccaacatgacttacaggggaaacaatcatgtacctaacctgattaattgaatcagccagccagcacataacaagagtttgaataagagcagataacgcagcatgcataaaacaaacgacaaaatcatgcacacacatacatacagcacagcaagactgcacatgtgtttacctgatatactcaacaatctccactaaaaagggataagcaaagcttaatccaaatgcacacgaatgcagaaacagtgatgtctcttcctgcaaaagatgagagttttttttttctgcaagctagcagcagcagcactgcagagaggttctttccctctcctctgccttgcttacgcttgctgcctgagaaaggtgaccatgtcctgaaagcaaagcaaaagacctattctctcttatagactaatgagagcactagtaggctaagcggctaacgaagctacgaactttgatctcccccgcgatacccgcgccgacatgaggatcgcattgcaacgaaaaaagaaagcgaaagaaatcagcaactttgattagtgccccagtggtcagtggacctgacgctaagccccggccactatcaacgcctagctaataccagcagtattctactagtacaaaccaaatcaatatcgaacagggaagccaaagccagccaagccaatcaagaacggcgacctccacatcgcccgcaagagggatgatatgcatccatccatccaatctggtgcaatgtcgctgtggataagatcagccaagagactaatctttgattattgctgttgaaattctcttctcacacgccggccacaaaactccacaaactgcttctacaggccgcgtgagagctgcagtcactgcacgctccacgcggccgcttgtgtgaggtcgctcgcggctcgaccgcgagagattcgttcccccattttatttttgcatcgtctcatcaccggcgagctgtgccgcggcggcgagtctttttgtcaagctcctccgggtgaaagggacatgagagctataaacgaatcgtttgtctaatcatgcgacggcggcttcgacacgggagggagcttgtgtgcactctgctttgccgggtcagaggctgcagattgagacagcttaacctcctccatataggagattagctcaattaaattaggagaaaattttggactcgcacgagcaggctcactaacacaggtcactaaccacctctagtaatacaaaatacagtatagtgcaagcatctccacattatgtatatcacatatataatatattctttttaatattagagcctgaaataattttgctccgttgtctgaaaaaagaaacagcacaagcatcttaacccataaaaaaaaaatcttctcttctttttctctctatctcaaagagagccaaggcagattagtgagtgagtccaaccagaattgcttaattagtgtgtcacaaatggggagggaaaagaaaatcatgcgaggttggcgtgcgggcaatcgatcgaaccagcggagcaacgagccaaaagaggaggaggtggtggtgagctggtggtcactctccactactccacaaacgcccaagccccatgtatttgttatgtattgtggcgtatctatccatctagcaagctagcttgctagcgatcgccatggatgggaactaatcaccaatccaccgtcgtcgtcggccactataccagtacgacgacgcgattgggcgatggctagagcgcacgaggcgctcgccaccacgcggagacaacgcgagggtagctcgcagatcaccgtcttctcaggcgagattttttttttgtttttttttggacgcgatagattcgcggtggcgtggcgcgcgtgttccggcgcaccgccgacacagaagttgccggagaggaagaggtcaaggagacacggtggaggcgagggggcgggtaccttgtgctcaccggaataccggccggagatccggcgatggcgacgtgcggcggcggcggacggggttggcgcggcggggcaggggaggcagacgacaataacgcgaggctttattgacaaccaactgcttgctctcagatttttttttcacttgcaactttttttcctgcgctttttctctctctctctctctctctttttatctccgagaatctacgcgacggcgacggtaattttgaccgtgcggatgtcgggccatgccacggtgtcaaaaaggccaactctcactgtccagtggggcccacatgcagctgtttcggttcctgcccacatgtcagttgcattcgtcatcgtctttttgtttaattttttttagttcctagtggacgtgggatctctgctcgggagttgtgacaggcaacctttttgttgctttccccggcataagtctcgccagtggactatactgtatttttaaccgtattcaactatttatcctctaactaaagaacagtgtttgtaccctgatcaagtggcaggtccgtgtaacgcgacactgtttacgcttttaattaatggtttgcacctaacgtagagacgttgggggcagtacactccgtagaagtagaaaaaagttcaatttgagccgtttcctttcaaatcaaatgtcccattttttgaacttatccaggaccgaccgttccaacggaaaaaaaaatggaaagaagacagacaaggtagtagatcaatgaggtgttactccaaggttttaatgtcgtcattaacttcggcgtcaacacacgttcgttgctacttctggcatcgcttgcctttttcgactgctctagtactagaaagaattcatgtgctggggtgttattacagctgctttgatccagtattcattctatcaagaaaagtactcacttatacgaatgaatatggataagtaaggatgtaatatctagataagcaccagcctatattcattcttaaaaagttgatttttattttaggatgaataaagctttcatagccaaatgatgatgcaagggaaaagaaatcaaaatcttgcagccttctcttagaaaaacgaaaacagatggaaagttcaaagtgagacagtagacagagcgatgcatgcatgtgatgttctctcatcttttccccacaaggggagtgatcttaggtttgttcaggaaagcttaaaattctgtgagagatagttgattagtagacagtttttgataaactggagaagccgagttttacagcttcttacctatagtttatttgttgaattctacaactacaacttctcataattcgaatgaaaagttaaattgctgaggaagcttctgaatccaaaagaagctacaggtgtcagaaacttctctatgtatgacttttattcttctgcttcttctatatcatccatggagtcatggaccatcatcacctttccttatccttccagccaggcatgctaagaaaaaggacttctctactattcgcatctcccctattaaatcccaatcacacaaatgcaaatacagaaatcgtcaaagcatcgtgcagtttcttttcactcttattttagtgtgcctgcagatcagatacagccggcgacgcatgggagtagatagtgttccttccaagaaaaaaaatcaatttataaaaataaatttgtacatatgtttgatcagattcaaaattagttttgtggatagtagatacactctccgtttaaaaataaatttaattatatatataaatatgacctcagtctatatttatattcatatataagttacttttatatataaatatgatcttagtctatatttatattcatatataaaagtaaatttattttgaaatggagactatagatatactctctccatttagaaaaataaagcaaacttctaactataactataaatctagatactccgtgttccggtttgtaagagcaagtttaatagtatagcccactattatcttcaattcatctatagtcaatctaacagccaattcatataatagttgcttactatactattaatatatggtcccacatgtcatacgcacattgcgtcttggagtccgtgctgcagctggctacagatatgtagcccgctactcttctctctcattgtttatctcattaaaatatgattgtagctggctaatagcctgctattgtacctgctctaatgagaaagaataatactacctccatcccaaaataagtgcagccgtggatatccgtgctcaacgtttaaacgtccatcttatttaaaaattttgtaaaaaaataaaaatatttagtcacacataaattattattcatgttttattatctaatagcaataaaaatattaataaaaaaaataaataaaataaacagtcaaacattgaacgtaaatagtacaaaactgtaattattttggaacggagggggttggcgccacacaggcacagcacgtatacgctgtcccggcactgctctgctcgtccgtccgcgccctttgtcgtcaggctcgttctcgtggctgcgtcgttgacaaaatttccttcagatcgcgtcagggtttgggctaccactaattgaaagatccagatcgcgtcttagattaacaaatgttccacggatcacgggatcgatccaagcagagtaggagtaagttaaaccagagagcagagtaaattaaaccagagtggctcagctcgtcagagaataatggcaggacaacgaggcgtctactacatgctcgtcagagaagttaggataaagcatgatgggatcacgcgttgttcacgctcatgcagcaacagtagtagtactacgatccaaccaaccagacgctgtctaaaaagaaatctgtcacacacgataggaatatcagcgaggacgtggatcagtacatactccctccgtagcgggacatttaacgtactcctacttgaaattttcaagatatagcaactaataatttgtcattcgctgcctatgacatactccctctgtcccagaatatatgaagttttagggttgaacacggttattaagaaagtaggtagaagtgagtgatggagggttgtaattggatgaatagtggaggtaggtggaaaaaataaatggtggagggttgtgattggttgggaagagaatgttggtggagaaattgttactcccttcgtttcagtttataagattttttagcattgtccacattcatattaatgttaatgaatttaaacactatatatatctagattcattaacatctatatgaatgtgggcaatgctagaaaatcttataatctaaaacagaggaagtatattttaagacaaatcctgagggcttaatattattatattttgggatggagaaactatgtattaagtgttaaattctctagaacaactcgtaagggtgacaaatagtagttaattattttcatagtagcgcattactccaccattagcatttactagagtgtcacattactgtcagtacatttggtaggtgaattaagcggagtactaaagtgtaacagctgcacatgcagtgaaggcccccggacagctatggcaggtgaggaaaatgcagggcgccacggaacagcgcacagcaaaggttgggcagttttaatggccaacctttcctcgcacttcgctgtagcagcactagtactcctacgtactagacccgttatcgctggcccattggtgagttgctaaatcacaagagagccttttcctcctttttttttttcagttggaaagatctgcaaaaaacaggaggctcacagcgaatccaaatccaattccacgatcacaattcacaacgtctccgttgcggctgcggctgctgctgctgtcgtggattaatgcccgtcattagggcggggacatgcagtgcctttgcgtgtcggtgccattagagcaggtttacgaagggtttaagctaaccgaacagcgtgggttctaccaattgtttccacgaattagtgccgtgttactactaaccatccttgtgcttaaactgcatctatgctgcagcaatataaagggagacaatgcacgcacgacgctgcattatgggttaggactcaagtcggcagcagcagcagcactggtgcactatactagtagtgcaggattgttaattagctacatggaattgactcgggtagatcggccgaccaatcaccggatccgtgaaagccgcgcattaagctttgtcacgcactggagtgaccattgcagccttcccatgcatctgaatgctgcctgaaactactacggtcactgatgactgaaagattgcagtctgtcttcactgtgtgctgctgctatacgtaggagtagagtacacctttccactttccagcatgaatgggcatattggcatcgtcgatttgtgccgccacagctggggggtgtgggccactgggccggggcgatggtagccgccgcggaatgggatggtgaggatgagaaggttccaggttgcaaaggccctaaactttagcgtgcacgcgttggtccatctccggctggtgccacacatgtaaaggggacgggccaaccagacgcgtcgcagccgagggcaccagcacacgcccgcgtgccgccgaaatcacacgtaataatgcggcgacgtgacaccaaaaacggcctgggtcgtgcgccattgttgcgcgtgggcgtgcgtgctgccgctcacggcgagtccgtgaatcgttttttcacgtgaaacgagcgaattcaagaagggctcgttcttttcacaggattttcaaaacgtaggaatactacagaaatatatgtgcaaacctatagattaaaaaacacatgaattttttctatgttgttgagcaagccaaccaaaaaaatacaaatattaggttggagtgaattattttttcctatgcttttcctttaaaaatggaggaatggaaaactttcctatagttttcctatggtacattcctatgaaacgaatggtagtttaaaacccattcctatttctatgctttttctttacaattcctttaaaatgaataagcccgaagttgttgtccctgaaatagctgaagccttggcgattagacgtgcgctgatcctggcacggggaggagggataccagcaggttatcatggcctcggactgcctctcattcatccaacgcttccagtctccaacgagatcgttctgctgctggttgcgtggtgagcgacatcaagaaagtcaagagttcattccttgcatgttccttcatacatgtgaaccgtttatccaatgtaggacacacactttggctcgtcgttctgagcacttactatgtactttttatcatatgtttgaccgttcgtcttattcaaaaaatttaaataattattaattcttttcctatcatttgattcattggtaaatacatttttatgtgggcatataattttacatatctcacacaagtttttaataagacgaacggttaaatatgtgctaaaaagttaacggtgtcaaacatttcgaaacggagggagtaatatctttcgctctgtgaccccggagtatatccgggagatgctctgtcattatgcaacttaatgaatagagtgtcgccattctctctctctctctaaaaaaaacgaaggccagcgagtgagcgagttcgggaggaccatctggggaatggaggagaagagacggtgatggccgtcccaaagcaggttcttcctgcacgaaaggccacgtcgttttgcttattaggggaataagccaaacaacaaatttataaaccaaaaaaataatttataaatatattttttatatacgtgttcttagtgatataaaagcaaatgctgaaaaacaaacttcaatgaaaaaaaacctcaaaatcaactctagatttaaagttaaaaatttaaattttggttgataagatgaggcggaatactactactacacggcaaaaaactaagaagtagacgaagcaagccttcgcgtcgccctctccccgggtgacacgggtggtgactaggccgtcgttgcccgcctctccctccctccgcttcgctctcaccacgcaggggcaaggggggcgctgctcggcatttgggacggcgcccagattgttataaaaccagccccgaaattgacatcggtagctaaacgcggaagaaaacgctataggagatctaaaacgatgacggcaccaagacacgatatttggtaacagagttcagccgtagcctacatcttcggggcactgattacgggcactcctccccgatccagcatatacaacgtattagagttacaacgactcacggctggtcgacgccggcagccgctccctctcgctatgctaagtcgctatgcggttacaacagacatgcccctatttatgagagatcctaggatagagtccgactcatactctagtcctaatacctattacaactccaagtcttaaactgtaaccgactatgtacacatattcgacacaaactctaacacagatccgtgtcatttggccggatctggtgggggagatgacggcggcggggttgtgtggaggggcggtggcgtttggtgggggtggcggcggcgcgtggaggtgatggcagcggtgaagtgactgccagatccgatcctggatctgggatctggcggggaagtggcaagggactacttctcgcgacggtcggcggcgcctggtgcggcggcgggcgaggtccgaccccgcgacggccggacgatgacaggcagcggacggcgccgttacggatggacacaccaatcttaaccgttgctgatggctcctcaccttaacttgaatgagctagtcgataaagttactactactcgtatactctctccctttgttccccatgttataagtcattttgagtatattctgagtttttttttcaaattaactaagtttgtaaaaactgtagcgacaattttaacaccaaaacaaatatattccgtggtaatttaaaattatagatgttgctatttctttctataaatttgatcaaataaaaaatgatttaagacaaaccaaaaacatgtagtactaaaacggaggggggaagaagagaaaaggactaggaaagacaagagtcactgcgaaggtgcaacatacaatgcatcgactcaagcaaataggaggaaaagggaaaataaaagccatatatcacatttgctatatccttttatacgaattgggaggttactattaactttttatatctttggtttgctgtaattattttgctttatgagcataggaattatcatgctgatcagagcaccttgcacaaaagattgatcgagctatgccgtaactcaatattatatcaccacttccaatgttttcatttcgtaaaaaagtgtgaaagtagctactatatgagaaaataaaactttataacaatgtgctattatatcgagctagctagtttaatcccatacaaagcaataatcggaggccaccaaaacgtaactgttgtatcgcatatttgtacaatttattaataatttataaagatttgaggattttcgaaccagactatactattggaggggcgcagtgataataaaacatagtagtacatctaatactctcatagtgtataagctacaacttcaattttagggctggacagaaacatatattatacataaagaaagaaagaattgagtagcaaggtgcgtaccggccggtcttggcatataataataaaaagtaaatcagcgataattggcggtgaatcgtcgacgaaaccaaggagctcgcgccggacgaaattcagcacacggcggtgggcgaacgccacgctgtcgtgtagaggcggcgggccgtaaatatttatgccgtgaccggatccacatagccaccatgttgatctcattaccagccggtaacggatcctttctgttttttttaactaagtcatcgggaggagagttttctcaactaaatatattacgtcaaatgatattacacaggatatgctatctgtaacggatcctatctttaattagtaatcgaatggaatacttgcccaacatgtaagttataagatattttaataagatgtataataattatgcatcgtcggacgctgatgtcttcgatgcactcagactctacgttctttttttctcactagctcgtgaaggctctaaagagtccaatttagaataaatctagtaagaaaaaaagctccctccgttcttttttctttagaataaatctattttgtttcttatctcttgctcccgattgtatcagaacatcccttaaccttaaaaccggatataacgtctcctcaaactttaaaaccgatgtaaaccgagtttaaaacgctctgcagacctcaatcttccatctattatatcatctatctattatcttattaaagtaataaaaaagaaagcctccacgttttctctcacggcctagaaattttcatattaatcagagaaaaagaaaagtagagtccatataggaatacaatttaaaaatagctgaaatttggaatttaaaataagaaatattgaaagaggagactagagtccatacaagtatacaatttagaattaactgaaattcggaattaaaaaaataggaaaactataagtagaagttagagtccatataaaaatgtaatttagaaataactaaaattcaaaatgaaaaaaaaacaagattgggagaaaagtttagagtccatatataaatatgatttataaataactaaaagtagagtccatatagaaatacaatttaaaaacagctaaattcagaattaaaaataaggaatattgaaagaggagactagagtccactcaagtatacaatttagaattaattaaaattcggaattaaaaaataggaaaactaaaagtagaagttagagtccatatagaaatataatttagaaataactaaaattgaaaatgaaaaaaaaccaagattgggagagaagtctagagtccatatataaatacaatttatcaataactaaaattcggaatttaaaataagaaatattagaaaaaaaagtctagagtccatatagtaatacaatttataaataacttaaattcgaaattaaaaaaaaacaaaatattgaaaaatgaattcagagtccatatagaaatacaattagaaataacagattgggaattagaaaagtagaaatattgggaaaaaaagtctacggtccagacaggaatttagaactagctgaatgtcgaatctaaaaaaaagaaaactaaaagtagagtttagactccatatagaagttgaatttataattacaaaaattaaaaattgaaaaaataagaaagatttgggagaagagtctagcgtccatatagtggagccatcgtttcgcttattcgcggaataagcgaaacgacacatttacaaatgaaaagtaatttgtgaataaaacttttatatacctgttcttagcgatctaaaagtaaaggctgaaaataaacttcaatgaaaaaaacctcaaaataggttaaaattcaaattttggctaataagcataagcgaaaagatgagaccctagaaatacaatttataaataactgaaattcgaaattaacaaataaggaatattgggaaaaaagagtccatataggaatacaatttataaattactgaaattaaaaaaaaagaaatattggaaaaaatgtctacagtcaatataggaatacaatttaccaataattgaaattcaaaatttttttaaaaaaaatattgaaagaagagtttagagtccatatataaatactatttataaataactaaaattcaaagctaagaaaaatgaatattggaagagtagtctagaatccatataggaatagaacttatgaataaaggaaattcgaaatttagaaaataaggaatattgaaatatgagtcttgagtccatatacaaatacaatttataaataattatcacgtatatacaatacattaaaaatatcacacgtttgttagttcaaccaagaatttaaaattatgttaccattttaatatattttaataataaaatgtgaaaatatttaagctattatatgagaaaaaatataaagatgctagccgcgcaatctgcgcgggccaccatgctagttattattattaagacagctttgaaaggagtcaccacgttcgctgtgggagctagaaattcccacgttaatcggagaaaaagaaaataagagtctaactagagatacaatttaaaaataactaaaattcggaattaaaaataagcactattgaaagaagagtccatataagaacccaatacgagattaattaatatttgaaataaaaaaataaaataaaatctgaaattagcaaaaaggaaaaaaagaaaataagagttcgagtataaatacaatttattttgctagtttttgattggcccacttggcacctcattctttaaagaaaaatcataaatttatactagagaaaaaacacctaacaatcatatgtgaggaaaaatctagagaaaaatatcacatatagattctagaggcttccaaaactatcttccctttccagccacatgaacttctactcctttgctttctataaatataccacgcctacacgacactactcctataactctaaaatatatagaaacccaaaattattaagcaaaaaataaatctataacaacaaatttacattcatttcccttctttaaatatcctacgcctactcgatactactcatataactatagaatatatagtaaacccaaaattattaagcaaaaatttggaataaatcttgagaaaaaaaagcttactccgttcttttttttagaataaatctattttgtttcttatgtaagctcctggttgtatcacaacatcccttaaccttaaccttagaaccgatataagtctcctcaatatttaaaaccgatgtaaaccgagtttaaaaagctctgcagacctcaatcttctatctattatatcagctttgaaaggaggtaccacgttcactgtaggagctagaaattaccacattaattggagaaaaataaaatgagagtccaactagagatacaatttaaaaataactgaaattcgaaattaaaaataagcaatattgaaagaagagtccctataagaacccaatacgagattaactaataatcaaaataaaaaataaaataaaatccaaaattagaaaataaaataaaataaaaattcgagtataaatacaatttagaaaaagtagtactgctcatgtgccacgctactttactaaccgtgaatttttctcaacttttattttttcactggatgaccatcgaaacttctagttaaccacgaccctcttttgtctgaaaaaacagaagaaacatattagtatcaagatctatccaataaaggtccacgcaaaaaaataaaaggaaagaatgatatgccaagtgggggttgtcgcaaatgcttgactctcactgcctgagcacctttatagccgtcgccggcgtcgctactcacaggaggactagtgggaccgctgccagcgcctcctcccgccggaccgccgtctccgctgcccgtgcctcctcccgcaatcagcagccaccgccaccgctcacatgaggacaagtgggaccgccggaccgctgcccgtgcctcctctgctgccgatgtaaccagcgtatcctccaaaattcatccagggtaagggtcggcgacaacgaaagtcttgtcggtggtgtcgttgacgtgttctccaaaattcatccagcgggtcagaatatctcataagtgagtgatttttgcaaggtgtggatgacggggtgggggttagcgacgacggaagtcttgtcggtggtgtcgttgacgtgttttccgaaattcatccagtgggtcagaatgtctcataagtaagtggtttttccaattacatctttgccctttacattgcgtatctttttcttttagagcttggttagtttttgaaatgatatgtcaaacaatagacaaaatccaagaaaatattagatactaactgattgaaacatagaattgaaacaacgtttgcatccagcgggccctttacattgtgtatcttttgctttaagagctcgattagtttttcaaatgatctgtcaaaaaatatacaaaatccaagaaaatattagatgaactgattgaaacatagaacaaaaatggaattgaaacagtgtttgcatccagcgggtcataatgtctcatgtgttagtgatttttccaatcatatcttcgtcttttatattgcgtatctttttttttaagagctcggttagttttttaaatgatttgtcaaacaactgacaaaatccaaaaaaatattagatgaaacatgattggaattgaaacatattttgtagcaagcacacaaacacgacgcacaccaactaaatcggaacagcgtctgcaacggttgcaacaagcacacaaacactacccgcacacgcacaccaactaaatccaactagagtgaaaagcgtttgcaacaagcacacgaacacgatgcacaccaactaaatcggaacagcgtctgcaatggttgcaacaagcacacaaacacttcccgcacacgcaagggagatggattctaatagctcgattgaacatccatccgtttattgcatgtcaagtagatggttacgaaaaattttcaaaaaaattgacaagatagattaatatgtaatatatcactccacaaacaaacaagttcaaattcaacttctacaagttgtaacaaaaataacaaatttaattgtaaaaatacatatagtaatttgagttttgtttgttatttttgttacaagttgtagaagttgaattttaacttccatgtttgtggttgtaatatatctatcttagttcatattttttcaatttttttataactatttagatgacatgcaataaatgggtggacgtccactcgagcaagagaagcgatgagcagcagaacgttgaggagaaacacacgcacacatcatcatgagactacgatgagcagcacaaacacacgcaccgacgcacgtatgaacgcaaacaacgcacgcacgaacgcacacaacgcgcgaacacaagcacgctacgataagttgagaagaaacacacgcacgctacgataaggagaaacacacgcacacatcatcatgagactacgatgagcaacacaaacacacgcaccgacgcacgtatgaacgcaaacaacgcacgcacgaacgcacacaacacgcgcgaacgcaagcaagaagaagatgaacacaacgcagatgaatgaacacaatgcagatgaacaacacaacgcacaaaaagaacacaacacatataaacgcacactagcagatgagtaagggaagcgagaagcagagcgagcgcacacgacttaccctctcgattttgcgagaacattctccacaaccgacgccgtggcccgtgccgacacgaccactgtggcccgcgccgccgccattggaggagagggaaggaaagggagggggggtttatagttggaggaggaaatatttaagatgcgtagcgaataatgtagaaaaaaaatggtacgagaatcactcaccaataaaatcctactaatatttatttttaaaataccataccctcacactcattttacttttaaccgaacaatataatagtccatcagatgcaatgtttaacccctaactccggctctggctacacattgagataaaatgttttgacctctaactttggctatggcttggcttggtggttagtccgaacccaaatgggaacagcgggttgtaatgcttgtcgccgaaattcatcggcagctggtccaccgatttgaaccaagtacgtggcagcttgccggtgaagccgtgatccccgaacagcacgtcggcgacgccgtggccctccgtgccggggagccaggcggcgacgaacgcgtccatggcgccgatgtacggctccaccacgagcggacgcccggagacgagcaccaccacgcacttgacgagcccgcacacgtccttgatcaccttcggccccggcgacgggatggtcaggttcaggttgtccccctccgtctccgcgtacgggtccttccccaccaccaccaccgcgtagtcgtactccttggcgctctcggcgatcgagctcttgtccgggtgctccgtgtagtcgatcaccgtgctctcgtccaccgccgccttgatcgcctccaggatcgtcgtccctgcatcacgattcacattagtggcaaacgcgacggcgagtgtcgatcgagatcggaatcgtgcttgatttaccggcggtgacgttgttgccgccctggccttgccaggacacggtccagccgccgcactggaagccgaggttgtgggcgtggctgccggcgacgaggatcttgtcggccttcttggacagcggcagcacgggcttctccccgtgcttgccgttcttgagcaggacgagcgacctgcgcacggcctcgcgcgcgatctgccggtgctccttgtcgccgagctcgccggcgaggcgcgggtccgggagcgggttctcgaagaggcccatggcgaacttgacgcggaggatgcggctcacggcgtcgttgatcctgtccagcttgatcgacccgttcgacacctgcgtcgtcaggtcggcgacgaactccgggtagtcgtacgggatcatcaccatgtcaatgcccgcgtggatcgtctcctggatcgagtggtagtagtgcttgtgcggcggcgtcgtgatcctgtccaccgcttgccagtccgtgatcacaaatccctgcacattttttaaaagttcagttgaattttgaggagaatttgagaggttttagcattggttaccctgaatttcaacttgttcttgaggatgtcggtgatgaggaagcggttctcatgcatcttgacgccgttccagctggagtaggagatcatgacggaggcgacgcccttgatgacggcgtcgtcgtagggcggcatgtggatgcgcatcaggtcgtggaagctgagcaccgtgttgttctcgttgatgccgtcccgcgtcccgccgtcgccgacgaagtgcttggcgcagccggccacgttcatcccccccgccacgaacggcgtccccttggggtacctcgccggcgcgtcgccctgcagcccgggcaccattgccgacgtcatcagctgcaccagcttcgtgtcctcgctgtagctctcgtagcaccgtccccatctcgggtcgcggcaaacctgcacacacacatgcgatcgatcggtcgaacaccttgaacattacgtaaattttcactggcaacgatgtgttcgtccggtttgggcggcttacggcgacgcatggggcgaaggtgtaggggatgccggtggcgcgggcctcgtgggcggtggactggccgatccgcttgacgagcttggggtcgcgggtggcgccgaggccgacgttgtgggggaagatggtggcgttgtggacgttgttgtggccgtgcacggcgtcgatgccgtagatgatcgggatgccgaggcgcgtcttgagcgccgccttctgcatcttggccaccatctgctgccactccttcgccgtcgccttctccgacggcacgctcccgccgccgctcagcacgctcccttgcaaacacaaaacaaaacacaatgtcagtgtacaacgatcgaacgcgcgcgacgtcggcggcggccggcggcgagaggggcttaccgacgaagtacttctcgataacggcggaggtcgcgttggcgcgctcgatctgcgacatctggccgatcttctccgcgagcgtcatccggctgaggaggtcgtcgacgcgctcgccgatcggcttctttgggtccttgtacttcacgtactcctcccccgccgtcgccgccgccaccgccgacaggagaacggcggcgacgaggagacacaccggcgccgccggcgaacgccacatcgtcgtcggtgcagcacgcattgccaagaaacgcaacgtacgtgttgataagcaaggagggaggtgatgctaattactttttcaccgtgagttcgaagtaaatttatagcgcattgcaggggcggataaatctcgcattccttggggttaggctgttattacggttgcatctacggtttgttagggtggttagatcgatcttatctctgttcgatcgtcgttggcgtaagagggagataaattaaacccgcacgcccgcggtgattttttctgtttttgagtttgaccgtggacgtcaggaacgcgatcgaacggctggtgattgttcggtgggtgaatgaacggctgttgattgagaaatcagggcgacgtgtaatgtgatccactgaactgcttgccatcctaagaaagaaccggatcggaacgcattaactctttgtaatgttacttcatatgtttatcattattacatctctcaaaaatcaccctttttcttttctctaatactataccggaacgctttatctataatgatgtgtttgaataatggattaggagagctgggattgagaaatagaaatgagtggaggaatatgatgaaatgagtgagtagaataaatggctagcttattcgttttagaggatttgtaaagggaaattacaggaatattcaatcctttggaatgagcactatactatcattcgttttaaaggaatgcatgaaaggaaaaattcctatccctccacttttagggggaaaacaaaggaaaaaaataatccactctaacccaatgtttttaatccttttggactgtttgcaacccaaccatataaaaatttcctatgttttctaatccataggtttgcacatgcattcctatattacacgttttctgtattcctacggtttgaaaatcctacaaaccgaataagcccaagattgaaacttaccttttgaggggttgaaaatcatatcccaaacccattatccaaatatggcctaagtgtttttttaactctttgaaatgttatcccaaaaaacttttaaatgatgttatactggctgtttatcattatatctcaaaactcatatcatttttcttttcaaatgtacgcagcatgtaagcgcgcacgctaaaaatgcacgcatgcacctgcttttatcccatctaaaaaagacgtgatactttcgttaattcctaagaggaaggatttaaaggagactgaggaaaaataattttacaccataaatatgggggaaataattccacaacagcccttcaaatcctccttatttctcttgcgggtgggattaatcgaacaagttttagtatgttaccaatccactattagagatttttttaaacgtatgtagttgataaaacatataattgcatatatatatatatatatatatatatatatatatatatatatatatatagtatgattgtttgggtagaccgctggaaaaacataaaattttaagaagagaaagaccaaggaaacttttcattaggtttaatccatgttaaatttgctctaacctgtatggattaagatattccaagaaaaaaaatttctcttttggaacaaatgatattttgaggaattttgaaggattgtgatcatagggattgagccaccaaaaatcctttgaaactccttttgggttatctcatttcattgtaatttcgaggatttttaacatgaagtctaatctcatggagatcacacttgtgtgttagctctctccaaattcctttgatatttccctttgaagcaaccagacaacatgttctcgaggattcattggaccatgacattccaatcgctcgtttttcatattttcgtgttctagaattctgcgatccaaagagcctttataggattcaataatgtcaaatcctttgttccaaacggcatttaggagaaaaaaaactatagcattgaaatcctagtaaatattcatatgattttccatcaaatcaaaggaggccatatgggtcaaatctacggaactttatgaaaatttccaggttcattcttatgaaactcatgttgtaaacctattgtgtagtacagtagtatgtgccaaatctgtggagttttatgaaaaaaaaatgggctcctctggaacacaaaaaatttataaaatggtcatagaatttaggatgtattcctatttcaaactaaaatattttgaaggcatgtattcctagctttagaaatccatatatacggattattcatattgttcttatttagaaaaataatatatataataatattttaaaccaatgctatgcaacttgcaaattctagattagcatgatataagatgtggagttatgccaaattctacataaatccttcaaattctttcattccaaagaggcttagcacgttgttttcctacatattataaattattgtgggcacgctttccaagctccgtaactttttggaaagaaaattctattcataagttgcgtaggatatttgtttatacccttaaatattgtcataaaataaataatatatccaccatttatccattcagcccgtttaattacttgagcagtcgaaaactttctccagctaatcggagcactaactaatcaatctccagcaattaatcttgcacaagtccaagcaaagctagtacaaaattaaagaacatgttaagcgtgcttatcttagttcataggagtaattaggagtactgcactcccacacgatgatccatgtttacttgcgcgcattataattcattggcagttagcaaatagggaattctacgtaactgtagaattaaatttgaaaatatacctttttttcactattttatgtttatatacatgcatgaaaaatattttcacaaatataccttctccgcatattaggaatgcgggactgagacggtgccgctctgtgccgctcttccattctacgggaccggcggtccctcgctagagggcggtcccgcatcacggcgctgcgtgaccggcacggtccagcgtgaccggctcggtcccgcgcatcagtgccgcgcaaccgccctgcctccgcgcatcggcgccgcgcaaccgccctcgacacgctagacagtgcagctaggttgtgtcttgattaattctagacataattgagaccaaaattaacaatatgactaaccagctagcttgtactttctcttagaggaattaggttggaaatgatcgatggatggagctgaggagatcaggatggaataattagtaagctaagctagtgcctggagtatgtattgtggggtttgactggatcaactgcgtgtgtgcgtgcttgacaggtgatgcttgcatggagcgcatgcacgggacggttcgggaagcacggtcccgcgccatggcgccgcgcgaccggctcggtcctgcgcatcagagccccgcatgcgcccgccctccaccacactgccgctctcctgtgttgcgggagcgagcggtgccgcacagccatcctgcgtgaccgtcggtcccgcggaatggaagcgcggcaccgttttggtgccgcgtccagtcgtgcggagagatatatttgtgcaaatattttctatgcagatatataaacgcaaaatattgaaaaaatatatgttttcaaatttaattcccgtaactgtatgcccttactatagcatttcccttagcaaatactccctccgttttaggttatagcacgttttgactttagacaaaattaaactactttaaatttaactaagtttaatatattatctaaacatgaccaaagtcaaaacaccttatatccatatcatctcgtcggctttggacgccacgggattggccgtcatggggaagccgccgtggttgctgccgccgccgtgcacggagtactgctcgtacgtctcgccgtcgccccacaccgcgtacgcgtcctcgccgtgtatggcgtcgccgccgccggcgagctgcggcacggccaccctgacggccaggcacacggcgctcgtcacggcgacgttgagcgccaccacgaacgcgatcccggccagctgcacgccgacctgccggagccccgagccggcgcggccgtccctgacagcgtacgcgaggccgacgtagcgcgggtcgtcgccgaagaagagcctggcgaagcgcggctcggcgaggagcaggagccccgtcaggacgccgctgaggctgccggcgacgccgtgggtgtggagcacggcgagcgtgtcgtcgacgcgcgccaggaggcggctccgcttgtgcagcaccttcatggtgaaccacggccggagagccgcccatcaccatcgcccggcaccagcctggccgccggggtgacgcagacgaggccggtgatcatgccctgcacggcgctgatgacggagaggcggccgaagacgaagctgtcgaggaggagccacaccaggaggctcgtcgccgtgcagaggtgcgtgttcacgacggtgaccgacgcgtcgacgttggcggcgtacggcgcgccgccgttgaaccccgtccaccccatccacagcagcagccccgctccggcgagcgtgagcagaacgttgttcggcgggaacgcctccctgtccttctccgtcctcggaccgacctgtccatgatgcatggctccatcaccatcacactcaagccaagcatggcggcgatcgaacagttagtcgtggtacgcgccggcgaagccccggcgagagaggaagcccgcctggtcgaggccggagaggtcagggcggccgacgaacgggtgcgagctcgtcgccgaacgacatgcggaaggcccaggcgcaccagcagacgatcgagcaccgcggcgaaggcgtacgaggctgtttggtttgttcacaaagtttgccaaaggttgccacctctcatgttagacaagtttaaccaaattagtctattgtttggttcatagccacacttgtggcaagattccttcttatctattaggtctcacatgtcatcaactcaataaagtgtggtacaatccaattttgctagctaaggtgtggctcatttttttaagccacaacttaagacaagtgtggcacaaaaatatggtgaatggtggcaaacttagtatagcatctaaacagcctagagcgccatgaacgccgagttgacggcccacttcttcaccgcgccgcagtcgccgtacaggatcaccagcctcggcacgctctgcagccccaccagcgtcgccgccgctagcggccacgcgttgtcccccttctccacccactccggcgccgcctccgccgccattcgcggccacgaccgaggtgaggcgagggaaatggatttggaaatggcgcgaagtagaggcggagagcgagttatatatatatatatatatatatatatatatatatatatatatatatatatatatatatatatatatatatatagagagagagagagagagagagagagagagagagagagagagagaaggtctgaggtgggggaatcccggaagccgggcagattcctgagaggctgagaatagatgctttggaccacctccagtccagattctgttctacggattgcgaaattgcggcaggatatacgcatatgcgtcatgtttgatttctgaatcgaagtaaatttacataatttttgcaggatttagttcagttcctaaaagaatcatatgaatttcctcctttcttttctttttgcattgatagatcggatgcccaaataagtcaaagaaaaaactaaaatttaatttttcaaacttaatattgagattaattttaagatattacaatgtagttcctttttcagcattgattttgtaagtgacaagaacacgtaaaaaaattccctaataagacgggaataggagcatacgatgggactttcaaacaggcaaagtggcaaacggctcatttttcaagtcccagtgcaagatttaagtaagcaacatttagatgcgtgccaaatgtagtcataaatatttaagggcccctgaaatgaaaaaacataggatttttgataggaatgtaagttaggaatgtaagtgtaaaacagaggaattaccgtttgattggaaattggaccgtaggattttgataggaatgtaagtgtaaaacagaggattgcaaaacacaggaaaaacaaaggaatgaccgtttgattggaccgcagacaaaacacaggaattagaggagagataaagactcaaaggaaagtttctacctcatgttagaattcctccaaaatttgcatggcattaggcattccataggaattttataggattccataaaattcattcctttaatttaaagggctatatagaaaaaattcctatagaaataaaatcctctaaaattcctatgaatttcctttaaatcaaggggcgcctaagtatccactacagaagtaaccagtcgctgttgtgagtaaagaattcaagcaatgccaacacataccaacgaacaacactcactaccaatggatgagcattccaattaccgacagttaaattgctaagaacaaacatggcacaagcatagacattcaataaccaataatccataccgagtcaacaacatatggcccagaatatcactatcacctataatcaatttaacatcgacactacaaagaaaagaatggcgactctaaagttccaaaaacatgagatcctctatgtaccaaatctgacatggctcactggaaaaacctccccgaagaaaaaatgggaacagtgaaatacacagttacaagccacactgtcgatacactctgagtgaaggtgattgcacgatgctttatgatcgacttttctcccaggaagaagagcttccaaaaccaggaccacagcagctcaagcaacaacagcaggaccctgttgcagcataatggagaaataatggaattttaagtatgagaactcagaagcaaagtacacacacataacattgtagcccagcaagctacataaatagcccttccaatttgaattactatttcctctggtgagaaaaggctatgcatatcaattggcttggagcgaactttgcaagaagctattttgttcctggtgggattatgtgcctttgttctgccttcagcgatgctacttaggtttggccaaaaagttaacaaaatcatcacctagcagcacactatatgtcaacagtaagttcttagttaagattccatgctaacagtcaacctgttccagcattacccacccttgtttgcccctatttattcttctttgttctctccttctctgggttgagatattataacagatgattcttctattaagatcgtgaacttgtgatacatatcaagtctgagtaaaatatatccaggaaaatatgatgttaagttaatcgttcaggataatataataacacagcccctaacagaaagaaatggtgtcatgtgagagtttattaatgtgattgtgtagatgcaaagagatcctttgcacacactgaagcagcacggtaacagtcaaacctaaattatcaggcatgcctgatgcctataaatgacaatgcaaccgaaggtctgtttcatggtaatttattaattttgactaaatgaaagaggaaaatggaactgtagctcgagagttgctaaaagtatttatcagctgtagcctacatagagagtcttgattcatttactcagtagcaaccgatagttaagtttattattgacttactttcgctgttagattggacacagctatttggaacttctctcttgttcttgagccagcaacatgaccagccttagcaaccttgctgaaggcaccatttagccagcttgttccagcagacacatacctacaagtaggggaagatggaaaaaaatcagtaaagtgtttggagattcatgtatataaaagatcttatatattcctcctaaaagaatttaggcattataaaggtaatagatttcatcaaaattaaaagctactcaaccattacaaaaaaaaaatgttcattggttattggtacaacgtcaaacaaatttgttggctgaacataagcaaaagcatggataagaagagacctgttggttttcacagcagagccagtgtcatttagcttgcgctctgcagccagcaaagcagccattgttttgtcagaaacatgtagcctttggtctacagatttcactttctcatttacaactgttatcccgctgtttatcttctctgaaattccaacacgcttatcaaaggaattgatcttggccgatgcatttgccctcaattgatgtttctcatcgaatgctttagctttgttcacagcatcttgtcgcattgctgaaccccttgcaatcacagttgtcatgacatcatgagccttgctgacataaacacggccagtagtggggctggcattggcctatgtggtacaatgagatacttttgatcagcaccgatcataatacactaaataaatgtataagaaaataagcgtaggttcccaattgtcatgccaggggaagatgtcacacatgctgttgcacttgattgattcatccctaccacccacctactacaagttatgggatgctcctttcgttaaactttatcagtgcgcacttcccctggttcatgggaacttcatagtatgctacaggtctataccggggaaaataaaatagagtacactggaaatgaaggacacctcggtaggttggtccaaatctgcattaggagccgtacttgtcacctcaccgaccacctcactgaccacaagttgctgcatgattttcaaaacagatgtctctatgaaaaagacgaatcaaaggatttagtactgacatttgggtaacataaattagttggatggtgcacctggtcagtaacagggatgtagatgtagtcttcagcaggggttatgttgacaacccgatccacaattgttgctccctgaaaaagggaacttagaagataataagccataatccatactgaaaggggaagcttatcaaacatctatttcttttcagtgctgcaagacctaggtagcgtaatgagatttaaactgaatataccctaattagaagattcactggattgttatctgtgcactgtgtttcattatgacaatctcagttgaaattgatgcacatttatcagatttgcacacatgctgcacataaagaaatataactgggagcagatttcttaaatggcaaaacagaataacaaagtcaaatgatcacagtagtaacaccatataatatgctgctcacttccatgccaatcaaagcaggcattaatataaatctattttgtttttgtttattatagtccatggtcaatggcttctaagattttaccgacaacggaagaaagcaccgcctttcaatcatttgcttgccagtgcatgaaaccataaagcacacggttatgtgtaatcataggaagaatataaagcattcaagattcaatgtttttttgcatcaaaaatgccttcgattcacataatgatcctcacttacttttaggtcatccatctaatatgaaagagctccacaaggaacacaactgaatatttagtacataaacatttatgtgctctctaatatgtacatgcatgccaacaagttctataggaagtgtgacatattataataacgacaaaataccgtttatataatacatattttcctttttatcgctacacgctacaatattgatagcaaccgacacaaaatttggcttcttcagcgcctaaacaagccataataggcttgtagctacacataccaactacactattcacaatggcagtatgctaaaatactaaatcattcattaggcacaccaattgtgtaaccaccacaaccaatagcgaaaagtcccatccacaaacatagccaatcaatgcacagagccataccgacagcagcagcgcgatctctagggccttgggatccttgaacgtgacgtaggccgtcctccccgtcgccaccccatcgctgcaagcccaaaatcacaatgcggatttcagagaacacgaaaaagaaatataccacttctgattgctaaagcaatgcagaggcgcaaccattagcaatccgaacaaagaaatcgaagggcaaagcggcgcctcaccatctgatgtcgacgtgctcgatttcgccggagaaggagaagaactcccgcacctcccgctcccctgccagatctgagatgttccgcacccgcaccgtcctcaccgccctcctctcgccctgcaagcagcgaaccccctcacacgatcactcctcttcctaccgccgccgccgccgccgcggcgcaagaaaagaaaaaaccaagaaccgctcacctccatggttgctgatggcgcgacaccgaccgcgaagagcagacgagccaagaatcccggcgcgagcagcagaagcagggtgggggggaaggcttggtgagtggctgcgctggcgatccgggtagggtttggtgctcgagaggcgatccgcgttggctggttgggttggttggttggctggccgccgcggctgcgaaaaacttttctacgttttctttttctttctcgagctgttcgcttcgctgatcgccgagaaagttatttacgcgacacgaaccaaactccacctcggaggccgtaatacccgttctgcccacggccatatcacccacatggatggtacgaggggtaaaatagtattttcgcagggtcggggtgttacttgtgagacatgctggctgctgagtttgcttcgcggcggcgccatctctcctgacctgtaaacaagaccagtcttgcttactagtataattaaattaattaatattttttcgggtgattactgtattaagtgacctaataatgacacggcagcggctgggcccacactccagtcaccgtcagtgtggggtagtgagtggtataaaaccggtgtttaattttggcgcggggccgtggggttaatctaatctgatgggcgaggtgggccccccagggcgatgtgatatggtctcgtgcaaatggaacggtcgttggttgggcccacggccagctcggtcgggggtcaagtggcacatccgtcgccgtctgcttcccaccacggaatgatgacaagagctctgtattctttgcatgtgagagcaagtttaatagtttagccaactattaactccaattcatctatagccaatttaatagctcattcatacaatagttatatactacatttttaatatctggttccacctattatacatacactgcgtcttgaagtccatgctacagctggctacaaatctgtagcccgctgcccttctctctcctcatttatctgcttaaaatatatttgcagttagcttatagcatgctattgtacctgctctgacgtgagccatcttgccatctctctcgctggcgagcaggccctactaaaattcatattttctccgtctcagccagcatactgcgacatgtttccttcgctctaaaataaattaacctttaatatcctatatgagtttggttttctagacagggagtatgataatatttaatcatcttagaacagtaaatctaaacctaacctattaagttgtagtattttaagacgaagttttctccttgaatttctttgaaaaaaatatattcctcctcgaattatggtttgtggatattcttcagtcttcacaggaaaacgcgtggctaattacgtgttgaaagataattcatgaaattttatcccgaaaacgggtgctctccatttgcttatagatccttgtcaactaaaaataagtaaggtcgtgttctgcctattcctgtgtaaaacggcgaattcattcttgtgaaatttctttgaacgtctgatgaaattgtttattacgataagtgtgtcattatgtcactcgtataagtagtttatcacgatgaagtggaaattgaaaaacaagaagcaacgagtttagcatagtgcaataaatgccatggttagtaccatctcactatagacacaggatccgtattgtaagcactttactgcaacgcttcaatacgagccatatggcagcatactgccgggatatttattccattatgcagcatacgggtttagtaattgattgtactgtagaaattaatgttgttactacaacataggatcctacctatatgatgtttttttttcctatctacaagtttgttttttttcctatctacaggtttggttcttagtgtctgtttaattcgtgaaaagaaaatttttgggtgtcacatcggacgtttgatcggatgtcggaagaggttttcggacacgaatgaaaaaattagtttcatacctcgcctggaaaccgcgagacgaatcttttgaggttaattaatctgtcattagcacatgctggttactgtagcacttatagctaatcatggattaattaggcttaaaaaattcgtctcgcaatttcttccttaactgtgtattattttttaatttatctatatttaatacttcatgcatttatctaaagattcgatgtgatgtttttggaaaaagtttttgggaattaaacagggtcttatgccggagggagctacagttagacccagtttaaaacgtagggaaaagaaaaagacctagcactacatttaacatggacatatacttctatagttttagtttttggagtatctaaagttagacctgatttaaacgtagaaatttcacatgaatattccaatgctcacagaaaagaattataaacttatcaaggaaaggagcaataatataatccctatattccgttttgtggtgtaagtcatttttggtttgttataattcaaactttggaaaaataaaacaacattcctaacgcaatacaaatatcttatagcaggatttaatataattaatttagtgttatagatattgttacatttttcttataaaaacaccaagtttaacttataataaatccaaaacttattaccactccattagtggagcgatcagtactatacttgggtatcagcccatcaagcacctcaggtccagtctcacagtaagccgagccttggagaaccgaaggcaacggcccaacaagtctgccacgtggcccacgacggaagaagcccacgtcgaacaaaaccatttcagcccaaatctgaccggaagcagaggagcgcccaccgccgccgccgccgccgcctcctcgcctctccccctctcccgacgccggcgtccactctccctcccctcccctccccacctcctaacacatgcccgcgccgcagcagcagcagcagtggtagagcccagcctgcctaccctaccaaccgacgggcagtagcatgcgcggcggcttgcgccgcgggctgggcatcctcctcctcccgctctccagctcgcccagccgggcgccgcggccgccggtcccgctcgctgctctgctcgtctaccaccgccgcctcgatgtcttcgcccgccggtccttctgcagctccggcgggggctacgccgtggagcagttctccgacgacgagtacgaccacgagtacgaggatcaccgggtaccacctccgcgcaggcgccgagctagctttttcttccctttttgttcttctccagtttcgccatgctgagctatcgagtggtgaactggtgacccgcagccgtcgtcgtcggtggcgaacatcgacgagtggaggtggaagctgagcatgctgcagcgcaacgcggaggagcaggagatcatctccagagaccggagggatcgccgggactacgaccagatcgccaacctcgccaagaggatgggcctctacaggtcttccaccgtaattttgctatctccggttcataattcccaaatgtagatgtcgaaacattgaaatttgtggtttggtgttttctctgtggaacggcagtgagatgtatgggaaggtcattgttgcgagcaaggtcccgctgccgaattacaggccggacctggacgacaagcggccacaaagagaggtgagcccatgcattccactggcaagatcaaacatctttcccttatgcaaattgacggtgtttaaatactgcgaatgcctttgttatgcatggaaatacgcaggtggtgattccattaagcttacagaggagggttgaaggacttgtgcaggagcaccttgatcgtgcactcttgccggataaatgtggaactggaaatggttctgagatggctgagaaagctgagaatgtgaacctggatgagcagcaggattcccttctcgatcgatcggtcatggagaagatccttcagaggaagagcatacggatgcgcaattttcagagaagttggcaggtatgtcactcttgatatgactacgtaactttgaattcaatctggatacaggtttggattatttgaaaatgtttagatggtttatagatctgtacctcaacaatgggtacagaatttagggagctctctatctggataatttacaaatgcctggatacacatagattagagattccttctacagcatttagtgtaaaatttgccttatatctcatttcaacaattccattgtggttgatcatccatctatctgtaacaataggaatcacctgaaggagttaagatgctagaattccggaaatcacttcctgcatacaaggaaaaggaaaggcttctagcagccattgcacgcaatcaggtatatatactgtataattcacaacatatgtttatgagccatagaatctgtgtatactgcatacatgtttggcaattcatttgtctctttcaatttttctgaacattcttatgcaattctaggttatagtgatatctggagagacagggtgtggcaaaacaacccagttgcctcaatttgtattagagtcagagatagaatctggccgtggggccttttgtaatataatctgcacacaacctcggagaatttctgcaatggcagttgcagagagagtatccactgagagaggagagaatcttggtgaatcggtaagataaagctttcttttttcgtctcatatggtaccatgtcccatctctaatatgattaaggacaaaatgtctttactagattcttctattgtatttttttgtatacaatgctagtttttttaataggttggctacaaagttcgattggagggaatcaaaggaaaagacacacatttgcttttctgcacaagtggtatattactacgacgattgctcagtgacagaaacctgaatggagtaactcatgtatttgttgatgaaatacatgaaagaggcatgaatgaaggttggaagattgcattgtttcctttgaatttgctgagatcgtctttattaaactcctgataaagttgcattactttgttggtttctcagatttcttattgattgtcctaaaagacctattatcacgacgccgtgatttgaggttgatcttgatgagtgctactctaaatgcggaactgttctcaagttattttggaggagcaccaactatccatattcctgtgagttaatatcttctcatataaaaaaatatattacatctgacatctgtcttattcttctcatgaatgctgcttctatcagggattcacatatccagtgagggcacattttctggaagatatattagagaggactggctataagttgacctcaagcaatcaacttgacgattatggacaagataaagtctggaaaactcagaggcaactattacctagaaaaaggaaaaatcaaatcacaacgcttgttgaggtacattttcaatatatatatatatatatatatatatatatagagcgcgcactttcccaacattcttctgatattattattgtactatacaggatgcccttaaaacttctagctttgagacctatggatcgaggacacgcgattctctgtcaaattggaatcctgattgcatagggtttaaccttatagaagctgttctttgccacatatgtcgtaaagagcggtctggtgcagttctagttttcatgaccggatgggatgatatcagttgcttgaaggatcaactaaaggcacaccctttgttgggcgaccctaacagagttttactgcttgcatgccatggttccatggctacagctgaacaggtagttgcttctgatttgcccctatcttattgagattgcttgtgtgatacgagttaaaccactggattggagatatgagtattacataaacatattttatatataatgtatgcatctggactgttagtctattgatacttatttctgttagcatcttttgtgcatcgtataattcatgctattgacatctatgaatgtattatgatattcgcagaggttaatctttgagaagccacctcctaatgttcggaagatagtgcttgccactaacatggcagaagcaagtattacaataaatgatattgtttttgtcgtggattgtggaaaggcaaaggaaacgacatacgatgcactaaataacactccctgcttgcttccctcatggatttcaaaggcttctgctcgtcaggtaaaatgcccaactttgattttttttttgcttctcgtctttcagcagcagcagcataaaatggcatgtgcctgtacctactttcattattatttgttttcttgaactctctcgattttaaccttctgtatggtctagggggtaaatgagccaaaaaatagtttagggggttaggtgatccattgaactagttcgggggagtagaatggacttttttcaatgtaatataattgaacgtttgtcctgtttgagtctatagtattatattagtacttttgactcttactttgcagcttagcagctttttttatcattttctcgtggagggcatgccttagatttgtggttgggaaatacctatatttctgaacaagcacgtccatgtgtctcttttgcttatgagcttggctagtcgacctatcttttattttttctgcttcaataggcagcagaaatgtactcaatattaaaaatcagaaactttgtaacaagtgatcaaacttgaagataactccttaattcagatacactatactattgttttcctctaccatatccttctttgccatatgtctgatagtctccccattatcttcgtgcagaggaggggcagagctggtcgtgtgcaacctggagaatgctatcacctctaccctagatgtgtgtatgatgcatttgcagattaccagcttcctgagctccttagaactccattgaattcactatgtttgcagataaaaagtttgcaagttggcagcattggggagtttctatcagctgccttacagcccccggcaccactagctgtatgtcttattgtcttgggtggctacgggctagcaaaagggttcttgttttcaatcatctccgcttttttttttggctgatcaattgataaatatacaggtccaaaatgcagtggaattcctgaaaatgattggagcattagatgaaaatgagaacctaactgatctaggtacatctatcctacactttggttctttgctaacactgcaaaacatattattactgaaacctatttaatattccctaatccaactttgtaggaagatacctttccatgcttcctgttgatccaaagttggggaagatgcttataatgggtgcagttttccgctgcattgatcctatacttaccgtggttgctggattgagtgcccgggatcctttcctgctgccacaggacaagagagatgtatgccttgattttccactaattactattattaattgggagacactattcttgctttcatagaaaatttataaaaaaagggaagaattgggcctcaggctttgtgtattcattatggcaagaaggatgtgtttgattttttgtcctctatttgttagttggcaggaaccgccaaatcaagattctcagcaaaagattatagtgatcatatggccctagtccgggcttatgaaggatggaaggatgcagagagagaagggtctgcttatgaatactgctggagaaatttcctttctgctcaaacacttcaagccattcactctcttcggaagcaattcagctatatattaaaggatgctggtttggtagactctgatgcaaatacaaataatagtttgagccataatcaatcattggtccgtggtatcatatgttctggacttttcccaggcataacatcagttgtggtaaagatctgtcagactactttgtaaagttccattctatttgaaaacacaaaacttgtcagttaatttttgagctttcctttcagcatagagaaaactctatgtcgttcaagaccatggatgatggccaagttcttctttatgctgtaagttcatactggaacgtcttgaagttttcatgtgcaacaccctgcttactagcttatcacttgacctttcatgggagatagcccatctagggtgccatgtatagtgccttacatttcacagataccaaaattgtgctgatttatttgcattttacgctattccagaattcagtgaatgctaagtaccagaccatcccttatccatggctggtctttggtgagaaggtgaaggtaaatgctgtcttcatccgtgactcaaccggagtatcagattccatcctgatcttatttggtggtgctgttacaaaaggaagcatggtatataaatattaaatcttgttcaagtgctttatgacatttttgcatttctattttccctacctatataccttctaacctgtccatcataggctgggcacctgaagatgctcgatggttacatcgatttgtttatggatcctagcctgtgtgaatgctacttgcaacttaaagaagagcttgataaacttgtacagaagaaggtaagccatgcaatattctattgatttcgttccactagatatttctgttgccgagtcagcgtttaataagtatttgacaggcattgccaatgctgttatgacttatgaggcatgtataactaacattgcatatgctgctatagtgcgccaaatgttatttctcttaaatctgtccaccttctgtggaagctaggaacaaaggagaaaattcacatgcaatggacagagagacaaccttttgttgtttattgccagtcacttgaaatgatatttgatattgaaacatggcctgtggtacatcatcggttagggcaaaaaagattgaaactaactgtgcagtgtttttttttcttgatttcagtcaaattcttccgcatctattatatatcagtcatgtgtaataactctacgatgttttcaatctgaactccagcttgaagaccccagcttcgacatccacaaggaaggaaagtacatcttatatgccgcacaagagctcgctgcaggcgacctatgcgaaggaaggtttgtgtttggccgcgagacgagcagagcaaggctcagcagcagcgacgacaccaaaggcaacattatcaaggacggaatgaaccccaagagcctgctccagaccctgctgatgagggccggccacacccctcccaagtacaagacaaagcacctcaagaccaacgagttcagggccatagtggagttcaaagggatgcagtttgccgggaaacccaagaggaacaagcagctcgccgagagggacaccaccattgaagcgctgggatggctgacacagacctcagggacaaagcttcaggatgatggcgatgattcccctcttgacctgacggataacatgctgaagttgctcagtagaccgaggcggcggtccagaaacaattccaggaaatgattttcctgtcaaggacatctagtacttaggttcataagaagcccatgatagttttgttatggtgccatttttttgttggcctattggttggatgcattcgagcttggtttcaccggattcatcgccccttttggaattttgctccgtgtcgagcgtttagatgctcaaattagtgtgaccattattggttgcatcccttgaacatggttatgtaatttgttagtttgtacagcttattatgtatacaacggcatgatgtatgatcgagaagtgaggaaaaatggaaggtactggattttgcctgtactaattccgcattcactggcaatgtcgtgcatccgtaatccgttcgtgtcaaaactgaagcggctgccgccggcgaccacttaggtttgtttgaattgtaatcaaattttatcctatcaatattttgcaagtgttaaaaccttggcaaattttgatactttctagattgatagcgtagaatgtgtattatcatagacataaattggtaacaaaacaaacattcaaactctactattgaaacttaaaaaaaactaggactcactccgtttcacaatgtaagtcattctagcatttttcatatttatattgatgttaatgaatctagacatatatatatatatatatatatatatatagaaaatactaaaatgacttaaattctgaaacggagaaagtaggacaaaaattggttttcgagggaagaacaaaagttggtttcaatccaacccgtctccgcttgatcaggtgcgtcacccgtggcgccagcgtcaaggctgtggaccacaaaatgaaagagaaacccaaaccataattgccccttcaccacttgattaatttatcctctcctcgcgtcgctgtcgcgtctcccagttgttgggggagtgatagtctgaggagaagaatatcatgacacaactagccaaccaaccaaccaaccatccttttgcttttgcatctcacacttgtgtatacaaatgaaggaagacgaattacattccatctcctccccttccatttcataatccacccccaaaatagcaaacaaaaaaatatcttatcaataattaaatccctttttttatctgatccaaaacttttttttaaattctagaagctactagaaaaagtcatggggcgagagctgactgtgccgtgggctccaggccaatccaggcccaggaggcccagcaatttcttcccctctctctccttcaaagcaggagaaaagaagaaaaattgattgctctctcgttccgttccggaggagagagagagagagagagagaggagagcggcggcgatggcgtcgtcgtcgtcgtcggcgtcgagcaggttctcgccggcgctgcaggcgtcggatctcaacgacttcatcgccccctcgcaggactgcatcatctccctcaacaagggcccctccgcccgccgccttccggtgagactcctaccccgcgctcgctgattccctttctgccctaggctggggctggattggagctatgcccggcggcgctgctccggtgttggttggcttgccggtcgcgtggttggtcgctggccgtggaaccgtgcgtcgtaccaaaaaaagtgtgtgtagttttgtgtagccatatgggtgatgcgtggtaatcttagcagcgtactagttcgtctcaccatgcgatgcgggatgattctgtatcgatattggaagattttcgagtgctgtactgctgatgtctagcctgtaggcatcgattgatagagcgtgcagagtagagaggaggaggaaaaggaggcggaattgattttgtccttctgctgttaggttgtttgtgaacgagacgaggggacaaaatggtcttggctaaagacgagccaccattatcgaacactctgaattcttcggagttcgggggtgggatttatggtatcagatgctttttttgctgcatactgtctttcctgctgttcgttttagtcgagagaaatcaaattaaagcctgcagtgagtgaacaacctctccagaggtgttgaagaaaactttttgattagtaatagagaaacatatgaaaccaaaacagaagtccagtatcaggtgttggttgcaaacatgaaagcaacgttcaatcatatatgatttctaactggcacctagttccctaattgtttgttgaatggcagaataaactcaataccagactttgcacctttggtatttacatctctgcacacatttgtacaagtagcttcaaaattagtataactggatgattcgcttcccatccgcataccattcctcatatcttggcacttctgttaacagatcaaacaaaaggaaattgcagtgagcacaaatcctccagaggaagcagtcaagatttcactgaaggactgtttggcttgcaggttttctttactaccttgcactgttcattcaatcagcagcttgtccaaatccaaataatgctgactgtttcattttaatcccatagtggttgcataacatcagcagaaacagttatgcttgagaagcaaagcttgggtgacttcattactcgcatcaactctgacaaagctgtcatagtatcggtctctccacagtcaagagcatcgctagctgcattctttggtctttctcaatcacaggtgattaaatatttttttcagttatctgcttccctgtcaaatctgtccttataaaatgttttgtccgaaatgctagtttatttgaacataaccacgactagagatgcataaaggagtgcatttttatcatgaacgtggtaacaaaagcaggagcttaatacctttatgctcaggttttcagaaaactcactgcgctgttcaagtcgatgggcgtaaaggcagtttacgacacaagttccagtcgagatctgtccctaattgaagcatgcagtgaatttgttactcgttatcatcaaaaccagttatctagtggcaaagaagctggaaaaaatcttcccatgctttcatctgcatgcccaggtaaaattgtttgcagggtactatgtaatttaggtatcatgaattctgtacttccacataatgcttgtactctggtaaaaaatatttgatgtttagaataagattcactcaaacttttaaaattttgaccatcaataatttctcatcgaatgcttagtttaaaaacaaaacaaatgatatacatagatttacctcgaaaagtactatcataatatcataaacttattagattttataaactaattctaatataaaattgattgttggaattttaagttgggcaggatcttgtcctaaatgtccctttttttttttaccgtagggggtagcttattagttgcatcttattttataaacaagagtaagattagtgcacaaatatattcaaacctcttcaacttgcaggttggatatgctatgcagaaaagactctcggttcatttatcttgccttacatctcagctgtgaagagcccccaacaggccattggtgctgctatcaagcatcatatggttggaaaacttggtctgaagtgagcactttgccatagttgatgtaaaggtgttaccttcatattttatatactatagacccttaaatatttggacttacagttgtacatgaatgaatttgttgtgtaggccacatgatgtttatcatgttactgtgatgccctgttatgataaaaaactagaagctgttagggatgattttgttttctcagtggaagataaagatgttacagaggtagattccgtattaaccactggtgaagtgttagatttgatacaggtaactgatttttttcccatgtcctgtcttttgatatgcatttaaaaaactatgagaagcttataccattttcatgcttgtgcagtccagatctgttgatttcaagaccctagaggagtctcccatggacagattgtgagtccctagtgtgcctttagcccctttgggtgaagtcctaatagaattcaagttggaaagtaaaatcagtcattatctgttcaaccgatatttcagatttacaaattttgcattgaatttaatcactccttcaataaaaagtcaatagaataattcatgttgctttggataacatgctgtggtatatcacagttgttttatctgtcatatctggaaactcacatatacttacgttcattgttgatccagattaaccaatgttgatgatgacggtcaactatatggggtttctggtggctcagggggttatgcagaaacagtctttcgacatgcggcacatgttctcttcgatagaaaaattgaaggatcagttgatttcagaatcttacgaaattcagattttcgtgaggttacactggaggtgaattcatcctgcatcatgttggcctgctttcaattctctcttaagcatgattcaagtggccttagattaattttgtataacgtgtgttgtgttaatgcacaggtggagggcaaacctgttcttaagtttgcactttgttatggattcagaaatctgcagaacattattaggaagattaagatgggaaaatgcgaatatcactttattgaagttatggcatgtccttcaggtactcccatttatgatacagtgtggcttgcccgctttaagtaaatggttctgagccataggatcttgattctatgaccttaattgttcgcttgcaggctgcctgaatgggggaggtcaaataaaacctgccaaaggccagtctgcgaaggatcttatccaactactagaggatgtgtacatccaagatgtaagctagcgaaatctctcgctaaatttcatgctgtttgtttggaacttgcttttctatgctatgttatgttgtctcagcattggttggattcttccatgtcaatgtggagtagacctgaagcttcttacttgatgtatcctagtaaaaaaaaacagagagaataatctgacctcacagttcatttatggtgatccatcatgttgctgttaacatgccaatcaagtataactgtgtggtagtatgcaattcatatttaccgatcatcacatgtgcatatgaaatgctagctgtgatgcttctaggatctaattactactgtgcaaatatgttatgtttgctgtatgccagaatttccactaactgtaaagcttatggccttatgtaccaggtatcggtatccaaccccttcgagaaccctattgcgaaaagattatatgatgaatggcttgggcaacctggttcagaaaacgcaaagaagtatctacacacgaagtatcacccagtggtgaaaagcgtggcatcgcagttgcagaattggtgataacacagtggtggaaagcatttcccagtgtgggcagttgcttgtgccatcttggtgccctgcccacactaagcaaacactgaacacacagaaaagaaatacacgtcatcaaagattttgcatgcgggcaaatgaattttgttagattgtaggttttaccagcttttcttggtaatgtttgtatactacctcctcactgggaaacacagatgagattgtaacatgtaaaaacgaagtgaaccaaatagtagttgatctactcagctgataattccattgcaatttttcaaacagggcctattcgttagcatttatcttatgattccttaatttgttttatgtacaacagtgatctttttctcttcttctatgacgtgcgtgaaacagacgtttgtcttcttcattgaccttgatacagctttgccccgttgacatttgatggtgaagacatcaaagtgaactttgcaaagttgattaaaaattaaggagaagaccaactccgaggtgtgtttggaatccgcaccttcctggcccgtggttttgcatttggaatctctatataactctggagattctttggggaaacaatattttttagatgaagggaaaaacaaaatactccaatttggcagactgacattgcacagaaacaaagagaaggcctgcagctgaccgccgtacgaggctcaaaacagcaaactttatccttatcaagaaggccaaaatcactcaaaaataaacgatacaatttgtgctgcattttcatcagcaaatcagtagtaaattctacagaggttgaggttcagatgcaggctggaacatgtcggggagcgtctcgagcaggtaggtgaacagcccgcccagcaagaagatgaacacgaacgcgagcacgatcttggtgatgtacgctgccatcgtctcctggtcgcgaggattcttcgccgactgcttcgtgtcatctcgtctctgcatggcaaccgaaaattttattcagagaggaaatcgttgctcattttgttcttgatttccgagaagaaaagaggaggaaaaaaattttctgaacttcttgcataccgtgtcggacgccggcgtctggtagtaacccggcgcgtcctgctcggtgatggtctgcagcttccatccgtcgccgtaatcggcgagcggcgcggcggggccgaagctgacgggctcctcgccgtccttcacggcctcgacgtgcagcgccgccggtgcgccgggggcgagcttgcggttcacggcgtgcagcgcgtaccgcgccgtcgtcccgaacgcgaaccgccgcacctcgccggagctcctgcacttcacctccaagaactgcgagcacacacacacaccacccacattgagccaatttccttctcctcgttctcaagattgaggacactctaccgtagaaaaaaagtaagcaggtttaccggcggtggaggagggtcgccggcgccggcgccggaggctgccttctccggctcgtcgggcttccgctccatcgcgccgccgccttccgatttcgcgatggtcgcggcaaggcggaggaggagttgtggccgactgactttggcccgtgcgcgtggagcagcagcgaggaaaaaagcacgaaagaatccgctaccgggttgactttttcctatccgtttctggtccgggccgaatcgctcagagatttcggctcaataccacgcgggatccaccgtgatttcggcccaagattacgcggaatccaccgtgatttcggcccaagatcacgcggaatccaccatttcgcgagcacacgcgatgcgcacgcgcgaggcggagaccaaaccaaacaccaccgtcgcggcgcgtgcgtctcaccagtcgcgcgagcgagccgcgtgacgcggtggtggtgggcaccagcgatgggcaagggcggcggctgcatcccgagcaagaggcaccgcgccgccgcggcggcggcagcgccagcgtcgcactcgcaccagcgcgagaggacctcgatcccggcgccggcggcggcgccgcggccggtgcgcatctacgtcgtgttctactccatgtacgggcacgtccggctcctggcgcggccggtggcgcgcggggtgggctccgtcccgggcgcgcgggcgatcctcttccgcgtcccggagacgctgccccccgccgtgctcgcgcggatggaggccgacgacggcggcggcggcggcgacggcgaggacgtcatccccgtcgtggaccccgacgggctccccgacgccgacgggttcctcttcggcttccctgccaggttcggcgccatgcctgcgcagatgcaggccttcttcgactccaccgtgccgctctgccgccaccagcgcctcgccggcaagccagccggcctcttcgtcagcaccggcacccaggccggcggccaagaaaccaccgcgtaagtatccgccgccgccgccgcgagatcgcatccctctcgcatcagatcatctcactctgctccgtgaatctctctggctgcatgcatggatgaagctggacggcgatcacgcagctggcgcaccacgggatgctgttcgtgccgatcgggtacaccttcggggaggggatgttggagatgggcgagctccgcggcgggtcgccgtacggcgcgggcgtcttctccggcgacggctccaggccgccgtccgagctcgagctggccctcgccgagcaccacggcaagtacatggccacacttgtcaagaaaatggtgcacggtgcctcgtgatccgaatgctctaccaaatatggaatctctcgatcgagaatccttgcaattagactgagatttcaagccgatatcctccagaaattcagtggcattgtgcgaattgtgacctgactatcttgcattgccctgcctgttctagcatgatcagacccaaatgtgatattgggattatggaacagaaaaggatgcagacggtatgcataatctaggtttgtctaaaagaattacagaggtcatcaataaagacatcaataactgagaacgatagtgagaattaggcagaggtgacaatatatcacatactaatgtatagcaactcaaaactatgatctccaactccaagtcaaagaggactaacatttctaaagcagtaatatttccagttttggatgtgataaatgtaaacttgcaactacaccaagaacaaggggaaaaaataactcaggttcatcactctcatttcatcattgtgcactcctaaagagtttttaaaaaatcgcagattctagttgtacaaagaatatgtccaggaaaaaggtcaggggtgtctacatttctgcagccccaacaaatctaacattgcccaaccaaccccatacaacaaatgtctgccctacttttctttccccgaggaactattcctaatatatctaaagaaacactcgtttcccatgaaacatatctaatctgaaaacagtcttacacaatgcagcttgtaaaattaatagcatctcacttagcaggggtagcatttgttttattttgcatagtacttgcttgggggtcttcagttgtcttggatgaagcaccgtcaatggcaatgttccccaagttcacagccattgcatctctctcttcattctcaatcctctgtttctctgaaacaccatcatcggacgaattctgtgtcaggtctgatggccgtttaggctgccggcgaaggggcccgacatcaagccatggatgttgaagcagttgagcggctgaaggacgcttttcaggaacaaaatcaagtattggaacaagaaactctgccatgccatttgcatctatatcactgaattcatatttctcaaccaaaaccttgttgagcggccaaaaccgcaagcgccgaatgtgcctcaaatccccataacgattgaagaactcacgtgaatatcgaccacccaaggcaatctaggaaacaatgtctttgtattttatctataattcagaacaatttacatgaaagcttacgaagatggaaaatttgttacctttcgaggcatcattcctaatagctccatcatcagcgcgaggtgatcctgcttcaagcaagaattgatcagaataaacttccaatggaaagggatggcattctgtactatagggaagacaactagatttcatatctatcattatggttttgctacttgcccatatctatttcacacagcatctccaaacaatggcaggtgtttaagaattataaaaagattactcagagaacttttcaattagtaatattgctaaatgaaaagtttgaataaattcagcagttgatttcccacaaatatgaagtggtcaatcaactaggacaactgaataaaaggtttgagcttataatgcaacttgacaaaaaaaagcaattggcatcatgcattcatgtagtcaatgatatgttccaataccatataccacaaacttgaaatgtatttatcaatcacattcagaattcattcaatcaagataaccatatgacatacctgaaaagaactagcttagaccagtccttaacattacctttcatctgttgccgatcatttttagaagaaaactgtggcttttatcacattggtatgacttagtttcattctctctttttttctctcttatagactacaagttatagcttctgtagaacacgtgatgtagacgagtacgttcacagattttcaaaatgataaaatcacaattataatagtaaagtatgtatgccagagaccatgccaaactgccaataaccgaaacttcgtttatttcttgaacaaagcgagtttctaatgcataggtgcatgttattcatggttaaaaggaaagtgtcagactcgaatagccaagtacactacaaattgaataaacacatggcatagcaaagttttctcctgtcatcttatgtgctacagtacttcttccacgagtaaggaggaagagagggtgcgtcgtgtaattgtgtatggtggtggtggttggtttggtttggaggccttgtcaggtctcataactaagcatgaaaagaaaatatactatgtgttcaaaattattgtgaaacagtaagcaaacatgaacaagaaatgagctgtatcaggccggtaccccacaatgttttatgtatatcaaccttaccattgtccaaacatgatcgccttcaaaacgaaatgttcttatttacaatatttaaaatttgattatcattttttttctggaataattggttagattcctaccgaatcccacaaatctgagtcagaagatgcatcgaaatgctcaagctttattaagaaataatttctccaaaacaatctttgtagctttcattttatttgcttttggttatgagatcatggcacaattagatgttgacaaatatcaaatttcagagtgatgttccttttaagtattgtcacaaaagaaaacctaggtacatgccaaactggagttttgggctgtagccagtagatgtcatttggcttgatcactcaaatttctattgtgatagactcctatttttttaagctaaagtgttgacaggtgatagtttgagttaagttttgtatagatatgaaatgtcttggaaagaaataaatagacatacctcatccctgtcataactgtcaccactgtgcggatcaaatagcacatctcctgtggcaagctcaaagcatatgcatgcaaaggaccacaagtcagcagatgtagaatacttggatcccagtatcacctcagggcatctgtattgccttgtttggatatcacttgtaaactgtttgtatgtccaacatgcatttccgaagtctaccagtttgcacttcaggtcagcctccaatgccatttttttcctggtccctttgctaccccgtctactcccttcaccttcttctttcttgtctccatcctgattcggactaccctcgtttgccgtactcaaatttcccctatcatctgacccatccgtctccccagatgcaacagtcccacttccttctgaagttgcagcggctgcacgcttggctttcctccgaatcttcttcttttggttcctggtgagaccaccattcactgatggtgcatgtgcctttggaggaggatcatcagttcttgcagaaggtgccaccagcggcacacctgatttccgggggtccttcgagggatcaatagtggattcaagcaatatattctcaggcttaaggtcagtgtgaatgattgaaagtgtgcggtggagatagtcaaggccaatgagcacatgtcggcatatctccttaaccatgggaagtggaattccatggtaatccgtgtactttatcagggtcagcaaattatcaccaagaaactcaaacaccatgcacacatggttcccattaggccccgagtgcttgaagtggtcaagaagcttaacgacgcaccgagagtcatcaggatcaccatcggcaatctgcttcaagatcttgatctcatccatggccgcctctgtgtagtgctgtgcactcttctgcaccttcagcgccacatatctctgcatatatataaccaacaaattcagaaacacaaagggtatataagaacagatacatttcgtgtatgatgatggtgggattaacgaataaaacagtactcattaacaacgaaattagccattatgataccaccaaagcaataaaacgaacaggttgcgggtacaaacgaaaccgcccgcaatacaccagatgattaaaacgcatccaggtcgagatttcccacaaatcatcacgaatctaggaagggaa

SEQ ID NO: 27604 - DNA, 34090 bp, Oryza sativa
  unsure (1)..(34090): unsure at all n locations
nnnnnnnnnnnnnnnnnnnnnnnnnnnnnnnnnnnnnnnnnnnnnnnnnnnnnnnnnnnnnnnntcaaacgacttttaaatttgggttcgatttttatttttatttttttgggtgagaggacaggctaactaaatatcctccgtgaatctacacgctttgagggtacattatagtaatcatagtaataaaaagcaagtttaatagtatagctaactactaactctaaatcatgtataatcaatttagtagccaatttatatataatagttacctataaacatatgctacattattaatgcatggtcccacctgtcatacaatcattgtgtcttgaaatctatattatagctggctataagtctataatctagtgctcttcttttctctattgtctccttaaagtatgattatagttggtttataatctactatttgtacatgctctgaataaataaaaaaggccaattgtaaaatggtcccgttcttctcatcatattgtaattcaagattttgagtatggctcttagttcctccattcaaaaatattgctacctagcacgtgattggatatttcctagaacaatgaatctggacaaattcaatcacgtgttagatagtactccctccgtcccaaatataagcatttttagctatgaatctggacaactgtgtctagatttatagctaaaaagttgttatattctgaaacagaggtagtaatattttaaaacgaaggaagtagtttatgatgggattttctcagcatcatttttttaattcaatgacttgtgctggtttcataacattaactggtaacatggtctgcaatcaatgactcgatatgttggggggagggggggtacgagaatttcccatggatttgtgagcggtatagatacatatactaaaattgttaaaagttcatgccaatatcatgtattcaacaaaaatgctgaaaaaattttgtaggttgttttgactttaatcaaaatcaaattgtttcaaatttgatcaagcttataaaaaaataacattttcaacccatacaaatatattatgaaaatatattcaattactaatttaataaaactaatttggtattttaaacattattatatttgtttataaatttagtggaaagcagttgttaaagaatgggatagtgcattggtgtagtcgtgttgtaacaattatctaatatattaaccgtcatgttaaaaataatatcttttaggaacggaggaaatatatgttaaatatacttaattactttagaacaagacgtgaacatttcagataaaagcatagcttgctgtctaccaagctttatttttgcaagaaagataaatgtgtaggacgcctgctacctggaaaagcaagttcatgttcaggttcatgctccctgtcaagtgcaaggtcaattccaagcatcaataattccttgaaaaatataaacgcatccactatgacatggacatgttggagagaaacaagggaactgacctacactgatgaataatcctatgcaattgagacacatgaggaatagtgaaaattgttggaatgttgggtctacactctacacggccgcaacttatatatttgtcgcgtataaacttgtaactctatttgcttgacacggtaaatctcttcactgttttttttgctttgattttacagagatttcagcaacgagcatatgaaaaatgcggaaaattaattcaccatatcgccttggaatattctagagaacagggaagagcaggcttggccatgtgaacttgtctagaacttcgatttggttaattagaagctttgtacggctcaaaagaatcactaccagcagtataatattaagggcatgttgagttccaaaacaaaattttttacgctgtcacatcgaatatttggacacatatatgaaatattaaatgtagaaagaaaaccaattacacaattcgccaggaaattgcgagacgaatcttttaagcctaattgtgctataatttgacaatgttgtgctatagtaaacatttgctaatgacgaattaattaggtttaataaattcgtctcatagtttcttgacagaatctgtaatttgttttgtcattagactacgtttaataatataaatatgtatctatatatccgatgtgacatacgtggacaaaattttttgccaactaaacaggccctaagcaaacaatattacagacaaaaagcacaaaagatagataaagtaatcaactgcttgttttaattaatcatttttctccactaagttgttttaattaatcattttcctccactaagtcccatcacatgcatgagctcgaattctgaataagaaaacaatgtctccagaaacaatgttgattttctacagtactgtttagtgcagtagcagggactgatgtatggatccggactcacatatcagcctatcaatagtactgctgcagatgatctgcatccctccagaaaatgctactcttgtacccttgcaaacagtagcacacacagcaagaaactgttatctgcccgcttctttacagctcattgtttggtttttgtttatcagtcaaactaaaatttagattttaattcctactttatcgatagaaacgacgcactatcgaaacgacgcactatctaaaaatagattttaaactcaattaaatattgatttttattttttatgatagtttatttttcagctataaatataaaaaagttttatttgtatttttttacttcgtttatttttgtgctgttgttttctgacgaaaattaacgggcaatgtgtctgctgctccctccctgcgtcgcagactcgcagtgcagagaggcgagagctggaccagcggcagcgcggcgcatcagcactgctgccaaatcggtgcggctgtgtgcgtatccctgaaaattcagtgcattagtaggggctgaaaattaggtgacatttattattattatttatttatttagagaataataatttttacccggtctctacatctaatcggatataaacaacctttttaaattgagaatttagcccctcgtaaaacccaatctgaaaattaggtgacattgtggtgtttagtagcacaaccgcatatactaccagctgcacacgtacggataatcagtggaaaacaaagagcaatctgagagcaattcatctgtgtcgcgggagcagcagcaatgatgctagtaaccgtatagtttagggcccattttgaccaaaggatatttggagaaactttaaaggattctaattctaagataatttttcctatgtggaatgacctaaattataggaattttggaaaaaaaaatctaccatagcttagggcctctttgatttgtagaaaaattataggatcttgaaggatttcaatcatatatgaaaatttactatgaagacctttgaaataaaaaaatgaaccatatcctattattgaaaattcctatgtaatggacaatcctataaagaatttgaagaaaattttgcaagagcttcaactttttgaaaattttcttttgagtctatctctctcatccaattcatgtgttttaaatggtatttcctgtattttttctacgttttgcaatcctctattttgtatttctatttctattataattgagttttttatattctttcgttttttttcatttctatgatttaaagggtcctcaaaactcttagaaaaattccttgtgttattccctcttcaaattcctatactaatttcctgtgaaacatccaaacaacaagattgagtaattcccgtgttttgacattctaattcctatattcttttattcttgtatttttaaatcttgcataccaaaggagccattagtctaaattcttaggccttgtttgcaacaaaagaaaaacaagagagaaggatttaaggatttgaaaaaacatgaaccatgaaaattcctttgaaaatcatatgaaatgaatcatttctttaggattggacgatattttaggattttcaaagaattcaaatccttagaatttctgtagtgtcctttggaatgaaggaatgcaactttaaaaatcttatagacctggttttctatattccatgttttatctttgagaagtttattctcacctcgtggatttcttttaacgtgtctttaattcctataattttgtcgtgttatgcaaacgactactattttatgcaggaattttataaggcatgagatttttatccccgtgtttcaaaatcctatgttttaaaggaaccggtaagattagcaacgtaaattttgatcataggaagtataagtactgcctctgtcccaaaagagtacagttttgcattgtttatgtgcaatgtttgattgttcgtcttatttgagaaaaaaatattattggtatttttattgttattagataataaaatataaattgtactatatgtgactatttttaattaattttttaaataaaacaaacgatcaaacattggacattaaaatccataactgcacttaaaataaaataaaatgagatgtagtagtaaagaataccctccaatatcctaccgagatcacaatgttcttttctcatttcggttccgttcgtttgggctattagggaataactaattactatctccgtcccaaaataaacacagccatgagtttctatgctaaactttgatcatccgtcttatttaaaatttttttatgattagtatttttattggtattagattataaaacatgaatagtattttatgcgtgattattttttttagttttttcaaaaaaaaaaaaataaacaagacgaacgattaaagttggacacagaaacttatggctgcacttattttgggatggagggagtaagttttaattagtataaactttaaaattaattatatttgatattttaaagcaactatcacatataattttttttgcacttaaaaagcgtgagaacggaaaagggatattttcgtcacatgtcaacctcaaaacccgaagacactgctgacacacacaggtacagatagagagaacttgcagtctttcagataaggctacactgccactcgaccaattcttgcaagaattggccatggcgttctgcactcctactgccaccactcctcctcatgccactccacctcctctcaccacctcatggaagcagctcgccttctgcaactcttcccggctagccgccgccgccgccggcggcggccagagggcgcggccggccggtgcaagtgttgaggcgcgcgcattggcgccggcgtcgacggcggcagacgcggcggcggctgcggcggcacccgcccctcccaacgtggactacctggcggcggagttcgccggccacggcgtcagcttcgaggccgtcggcggcagctgcgccgtcaagatggagctgcgcaacggcagcgccgcgcacgtgctgctcccgggcgggctcgtcacgtcctacaagccggccatgtggcacggcgcccccaccgaggtgatccacaccaccgtcgccgagggcctcggcggccgcgccgtcatccgcggcggcgtgtcgctggacctccgctgcggcggcgccgccggcggaggcggtgacgggatgccgccgtggtcgccgagcggcgcatggtcgctccgcgacgtcagggggagccccacgggctccatcgaggtcgagctggcctccgccgcgccgccggaggcgagcggcgtcgaggcgaggtgcgtcgtgacgctgcacccggaggcgctggcgactgagtttacggcggggaacgccgcctcgccgtcgccggtggctctgtccggcggggtgtccacccacctccgcgtgagcacgccggacgccacctacgccgtggggcttcagggctccgactaccgcgccatagatcccgtgctctcggagttcgccatcgtgcccccggacttcatgtcgcggtcgtcgtcggcgacgacgctcgcgcggcgctgggccaccaaggggttcgacgcggtcctctccgtcgacgacgccgccggcgcgggggcgcaaaagcccgacggcgaggaggacgacgactacaagcggatgaccgaggagatgtgccgcatctacagccacgccccccgccaattcaccatcatcgacagggtacgtacgtaaaaccaaaaccaaaatggtgttcgcaaaatgaggatgaaaattaaggacagataaaacgagaaaattatcagtgattaattgaattttgtttattataaatttgaaaaataaatttagttaatattttaaagcaacttttatataagaaagttttgcatgaaacgtatcatttagcggtttaagaaatgtgttaaggaatactgaggtagaaagaaaataatattactaaaaaaacacaaaaaattcacacacgacagctcaattttcgtaataaaagtgaaataaatttctcaaattcgatctgaacttttgatcaaattcgtttgatggtgcaggggaggaggaactccatttgcgtgcagcggagagggttcgaggaggtgtacgtgttcagcccggggtcaaagtaccagtggtacgggaagtacgcctacgtgtgcgtggggcccgccatgctggagcccatcgtgctgtcacctggggccacatggtcaggggctcagtacctgcgcaacccaaacctctagatagacaagacaagacaggctagctggcgactcaatgctgctggggaacaaaacaatggtcattgtacatgttggctcacaataagcaagaaaaacatgtgaaacaatatatatatgtttgcaaatgtgtttcactgattactgtggtgttctacttatgcaagatgcgatgctcaaaagagcagaatcatgtgagatcagtggagatgaagcttcaccaactatggaaatggatacttggtagccaacatttgggagactacagcagctgcactgagcagtaaagcatttcaccactataagaacaactgtctcacagggagagatttttgaacaagtttatatatatagtcttactgttgccccttgcatatacatggacaaactaaagtaaacctggtgaaccaacaaccttaacccactgttaactgtcaagtaatgcgcaccctacaattccaaagttgtcaccattttgcatcctaccaactttggaccaactcattactgaggattccctcatgcatcttctgaaaccgctccgagcgccgaactaacacatgagcagtggagccactgtcctgcttcgcactgttgagccaacatataatagttaggaacttaggatagaaaggccacttcgtaaatacaaaatctgaatctatccgatcaatataacatgagctggcacatcaaacatgatcatgtgatgattaattacaatttaattggcttcccgttgtgatcccacagttggattgatatgttttttcctgcacaaagttaatcaaacagtttttgtttggcaatggaagtatttaaagatggggcattatgtgttgactgcaatgtgctacatgcgacctagttaacaattatgtgatgtatgactagcaagtttctctagacaagttcatttttgttgtacctatagctttgccttttctaagtctttttctccccctaacttaccccattcttttcactacagaggccgacattccaatttggaattctgatactgctagtgcactatatatttgtaaaaggaaaaatctgaaaagcaaatctttggacttgaatgaaggattgagtcatatgacgtaaattctcctttacacctctacactgttctacaacaatgaatattcatttggaagatggaatgaattcaagagcttctataaggcaaattaggatttgtagaaagcaaaagcggcaagtagtatgcttcttaccaactttggagaacctctcattaaagattcctgcatgttgggcaaaaccatttccccttgaatctcgtttctggtgtcagaccaacacaagtgtaatggaaccattcacctccttcgcactgttgagaaacattaaacagctaacacttagcataggttgatgcctttcgtagaacaaacccataattcattaagaacaaaacaacttgtattgacaagttctagaacatctgccaattgcaacaagttcaaggatatataagcaagaggcgtcccaatatttataatctaaatgacaagagtaaagcagcgataggagtgagcaagaaaattaaaaggccgagaaaccgaaccacacggcccatattttgctaatatggccggctaaatcaccaagacaggcttcggtgatctggtattctgtcggcctcgaggctttgcagaccgaagcggcgtaataacctaagactaacatgcaatcaactttctaagctactgacgtcgtgaattttgcacctaccatgcatggctcgatccttcgaggattttattcacaatcaaccaagaattctgtgctgcagtatacatggtaataatatatatatacacacccgtggatcctaatgattatgtggtgtgtggattcgcaatgcagcccaacatctgacgtcttcccacattggctgactgcccatggctacagcccaacattcgctgcaaagttggcattttatttttacatgatggacaatgtgtaattactatcagtttgttctagtagagctgaataaattgaccgaactgaccaaagtattattcagttaatcaggttctgtttctattttttattccgctaattcagttttccagattgttcaacagaaatatataattcattcggtgtaaaaaatattataactgaccaaatcagccaaacgatcacccctaagcagtgaggcatgtcctcattctggatggcagcaagtaagaacaaatggtaaaaggaaattacaagcataagataagatgatcaccgccaccctagcagtctagccacaacatcatggatccaatgctatattgcttgaaataataattaaaatcacaacaaaaatcacacttcagaatgttctaaagcttctctaaaactacctgataaaagtgaaagtagtaacttagaacataggaattaaactcctccaaaagaaaactatcattacttagcaccataaagacttacgttatcattgtcacaagcaatcatatcaccatatgaaatctgaaatatcaataagaagcagaggcacctttcagaaaacatcttagaaaaagtttgatgtagactaatttccaggaaaatcgctatacattccaagctgacctggtggcatatacagtatgttggttcatttggatcaattgtttgatccacatccataggtgcagttgttttcttgttgctacctggagggggcattaagtcgaagtccatacccctttccctgtcccattccctctctctgaacttctttgttgcttgaggtgtactgaaaccaggcctccgtttgtcatccctgctaaatgctgaaattgcaggaaggattgatggttcatctggaggtatctttccttctgcaaatgagatcagctcattaatataacaatattctgctcaataggatgacctttctaagatacaagtaaatgctagggataattgtgattcagaccctattctgaaggctaactaccaacttgcccccccccccccttcctttccaattttgctcatttgaccccacttttcaaaaacgaacctgccgtctgaccctcttctaaccacaccattaggagtgttattagaaaatgcatttagagaatgaacaagaccaaaatgcccttggaaaaataaacaagaccacagtatcggcctttcccgtttcagcctcaaatctaggtcaaatttgttaaactaagtcaaatatgtcaaacctgtgtcaattttgtctcatattttagtcaaaaattgccatcacatttttatagggataaggtaaaaaaaattggatcaaataaacgaagattttgagaaattagggtcaaatgagcaaggatataaatggtatttttccctgagttaaccccgttaggttgtcttcatgaaacaggttcatgcctgatcttcatttttgaaaaaagagggtcaaatgagcaaacttgaaaaaaacagggtcaaaaacacaattgctcctaaatgctactatctcttgattataccttgcttcaagtcttctgcaaactggcctaagtcttcatccagacgtttgatatgactctctatctgtacaataatccatccatggtacttacagttaggtattaacaaaatattataggatataaatgacacaaattggaacaaatatcaaaaatggattttgtttcgttagtctgggtccctgaatgggacacagtgagttgataatgtaattgagattctagaattaggacatgcaatttagtatatgattctagcattgatgtaatttagtgtcaggcatccgaacattcaatttagtatatgggcagtatgagacataacacagtatgacagacatcaggcttttcattaaatctcatgagataatctcaagatgccagatactattagtggtttgtaattgtaacaaaacagagtttttagactgcaaacattagtcttcctgtgtgatacttctaagttcgtaactattcattatggaatctggagttgaacttgacaaacgcaaactgtcaaaataagtttggactttaatatagaacgatcaagtttgtttaggtgtatcaattaaagggtatctaagatctcgtctaaaagaaaagcgggcaactaagatggcacttaacatgaaatgaaatgtacaagttccttgagttacgggactagaaaaaaatgaagggtgcatgcagaaccaggtcataagcttggcgtgcaagcaacactttctcggtgcagagactcaacgcattgtcctgactagcttcgatgtcctttttcattctctctgaggcagattcatcatcatccatgtttgacctgtcgaacccatgggatggcactccgagtagatactttatctgttctttggtctgtcccataatgcctgcatcaacagaaacataatccgtacaactacaaacttgagaaaactatcaatatcacataaatttaatctataagtgggcactagccctatacaaaacaatcacatgacattatagccttgtatcaactattaaaaattactacatatcagaagtacccaaaatgattattttttaaatttttttttggataatctgtattttagaaaaatgaaaaaggagtgtaaaaaagatcatcaccatgagccctctcgtcgagctcgcgcatggtggagagaatcctctgcaggtcgccggccagcgtgctcgaatctgcgacaagaaatggagccaataaacagaagcaaatcgaaggcaaccgcaaaaaaaaattcgacggcctctgacacgggagctagcaatctcacactcgaggtagtcgtcgacgtacacgccggtgcgggcgatcgccatggcggtcgattagaggacggatccggcggcgtccctggctcaatccttcgatttggggtcgatttgaggaccaatccggcggctcccgatccttcgatttggggattagggtttcggggaggacggcggctagcaaaaaaacattttttttcagagaaatccactgggctagtgggcttgtctggttctgtgggctctgaaccgtcgggtggaggcctcatgggcctttcctgttccctgatctgtatgatatttttcaccagatcttgataaattaggtcgaattttactatttcaaatttgaattcttgaaaaccattcaagttttacgtggaatctacttccatcccaagtaaaacttcagaacctcaaaatttgacggttttcaaccctaggtaatatagagttggtgggtttggactataaacgtgaatctattggtgggtggcggaagagatgatgcgaagttagcgagggacgacggtggctcggaagtcagaactcagaaccatagatgatgaggatgctttcagataaccttgagtattcttttatgaaagatattatagactattgattttgacacaagcacacaatcatccctatgaatatgcacacacactttacatctatctttgtttcgtaagaacacctttaaaaattgagccagtatatattgaaattgatgaagttattaaggtgcttcaacatcgacaatacaataatgtctccaagtgttttaagcatccttgaacgtgatgtgggcgtgtgcatgataacacgtgggtccatatttagctaatacttcctccgttttacgatgtaagtcattttagcattttgcacattcatattgatgttaatgaatctagatagatatatatgtctagattcattaacatcaatataaatataggaaatgcaagcatacaaccaaaatcaagaagtgaatgcaagcatacaaccaatgagtatttagatgactctttgggttctaataaaacatttaatttatctcttcatttaagtcgaaaaaaatataaagactataaataggaacaacttttttggaaaaaactcaaatctatttataggtgtaacttttgtggatggagggagtatcataatattatgaatctggacagatagtctgtccagatttacagtactaggatgtgttacatccgtccaaatcccttatattatgagatggagagagtacatcactagttatagtactccctccatctcaaaatgtaaaaaagttttggttggatgtggcatatcttaatactataaatttgggcatatggtctgtctagatttatattactaaaacatgtctcatccaacccatccaatctaaactaatacaaccaaaactcattatatttgggacagaagagtatttgtcaagatatttttaaaaaatatttaatctacttttatgaatataagtagataattcgtgacgacaatccgatatataatgtgttttcaaatagtctagtcgatcctttctactcaactagtcatcaattattatagtagtttaacagtttactaaaataattattaggtggatccttttggttcttaaaaagttaaccggaagattatcgtattttatagcgtaaaaatcatggtacttatagagtaccgtgaaaccactcttacattgaacgaacaaacacaagttacaacgacgacgacgaattttagcatgtagctagcgcaactattggatgcatcgcatcggcagttcggcaccgcacacgaacacggaaaggatatacttcatccgtttcacaatgtaagtcattttaacattttccatatttatattgatattaacatcaatataaatatgggaaatgttagaatgacttatattgtaaaacggagaaagtagcgaggatacatggtcctagctgattcgtcttattcaaaaaaatttggaattattatttattttgtttgtcatttgctttattatcaaaagtactttacatatgacttatctttttttatatttgcactaatttttcaaataaaacgaatggtcaaacgttacaaataaaaagttaaaaacgtcacctattagtatatcaaaaccgaagtaaccattccaaaaggacagagaacaaacaggtgctcataaggtgaccagaacattcagacaaatactgtttataactgtcacgcacaactctcccaagctgaaggtaagagcacaacgtgtaccaggataatgcaattcatagccagaaaatctacttcaaaatatttcaaatataacaacctagctagcatgacatattctaatattataaatcttacgtttaaatttttagtacatgatatatcttttttattttaggttgttatattttagaacggagaaatcatttattttggcgcgcaggccagggtagctagatagtgccgccgttgcagcggatgacctgggcgttgatccagccgccggcgtcgctggcgaggaagccgacgagcggcgcgatgtcgtcgggcatgccgaggcggcccagcggcgcctcggcgatgtaccgcgccatgtcctcctctgtcttgccggtgtacatcatcggcgtgcccgtggacccgggcgccactgcgttcgccgtgatccccgtgccgcgcagctcgcgcgccaggatcttggtcatcacctccaccgccgccttgctcgccgcgtacgccgcgtaccccggccggagcgacccgacgcccgacgacgagaacgtcacgatgcgcccccggccgccgcgcgccagccggttcgcggcctcgcggcagcacaggaaggtgccgcgcgcgttcacgccgaacatggcgtcgtacgctgcctcgctcgtctccgccagcgccgggtacgcgaagtccagcacggccgccgtcgtcaccaggatgtggatctcgccgccgaacgccgccgccgccgcgtcgaacagcgccctcacccgcgccgcgtccgacacgtccgcctccaccgcgatggcccgcggcccgcgcttctcttcctcctccgcgcgcaagtagccgtcgttgatgccgctcaccagctcgttcgccggcgcggggtccccgatgtaggcgaccgcgacgcgcgcgccgagggacgccaggtgcctcgacacggccgacccgatgccgccggcgccgccggtgacaattgccacgcggccgtgcagcatcagcggcgccatcacgccggccatggcgttggtgttcgacgacgcctccatccagtccagtccagtgtgtggcgttctctagctagctaggagagcagcacactacactgtcagtgtgtatagctcacacactgatagttgatttgatttgacgtatatataggcaccggatttactataaatagactttcacggcgaactatatatgtgaaagaatctcaccgactcgatggccttttctcgattgagattggagatctactacagcactacagacaggagtggccgagtgggtagatccgcacaagtagtgtagactgtgcacttgtgcagcatgtatgctgtgtggtccagccagaactttgatcgctagctcttgattatatttggaaaggactgtttgttgtctatttttttaatcacatgaaaatgccatcaaaatttagttacttttggatttttggaatcgtgtggcccttcacagtgttcctacgtggagcatggccacggctcaccacgtaggatagcatgctatcgtggcggtgagagaccattacttcgtgggtaacacaagactaacttgagagccgagagcctcagctgaaaaagctaagaaaaacaaggaatcttactgcgaggctgcaacaatccccaccatccccacctccccatccttggaggagaagagaggggagccggcaatggacgacgaggaggacgccaatccactaccgagctccattactgctgtcgccgtcgccctccgagccctcaagccccatctcctcgtcgtcggctgggaggggaggggccccagcgagctgactaccgctgaggcgcgggaaaggagagagttggctatggtggagctcaagttgccagccactgtcgctgacctttggctagatccaggcggcgccgtcgagctctaggccgaatcccgctcctcctcaacgcttgagaggagagaggcgatgatggtggcagccgagcgcacacgccgctgttgtcgaggtcgtcgtcctttgaggaggggcttcgtctcctcatcgcgggccgggagaggaggggcactggcatgcgccgcagagcttgtcgtcgtcctctccctcccccccctcccgaccgagctcgtcacgtcgccttccacttggtggctccgccaccgccgtgtccctagcctcctaattggttgctgccaccgtgaggagagaggaggggcaccatggagctgtcgtcctccccccccaacccccgctactcggtggcttcaccaccacctcggcctactcaatccgccgccgcgttcccagcctctttggacgtcgccgctgcgaggagagaggaggggcaccatggagctatatatcgccggcctctagtggatcatggtgggtggagtaggggagccgtcagttggtgctcgtttgccactggctgccatcggtggattgaggagagtagaggggagagattttatatttgcttctggaaattagggtgtgtgtagggatggcaatcgggtgtgacgggcacaggtagtgcctacccatacccatgcccgtgagattatttgtgcccgtgggtatacccattactacatgacgggtaaggatggttgcccatgcccattgcccgcgggcgccttatgcccgcgggcgtgcccgtttacccgccacaacaaaagcagtggaacaaaaagtctacaagctactaacttcgaatcgaacttaaaacatcaaatattctccacctcggtgtcgtgtctctcctctggcggcgatagagtaagaggagagaaataataagggaaataaaagggaaaccgtagaaaacaaagaacgtggcttatgtattctagtggattttactcctagcctacatgtaagttagatttcgcgggtaaacgggcaaagcgggcatgggtagtgattacccatacccatgcccatttacccatcgggcatagcttttgaaccaataagatacccatgggtataaaatggagaacaaacccaaccctaatagggtttttacccgcgggtaaacgggcaaacgggcacaattgccatccctaggtgtgtgcgtgctaaatttttgactttatgtaaattgaaaacacattaggactaaaatacaagatggcaagggttgacatgaaaaattgaaaacactccaagagcaactctgcattgtgggagaggaggtgtgatctcggcctacatggcacatgaggtccattattttgagtagctcgcactggtattgcactaagatctatacaattacagtatcaccctcaacttgttttttctctcctcctcccaaaagcccaataacagttaggtgactcggccctattgtgcttttcattttcgacagttcccccgtcatcgggaagtcatcactatcctcacctcttaacaattaggatctagcacatctttttcctactaccgacattgtccagcaccctcctctatagtcgtggtttcgtcaccacctcacctcccgtgttcattggccacaccctttccacctctcccaaacccctctcccaccttgaccccaaacccataaacctaaactctacgttctctatcggagttccaacacaccatcgtcatagctggaaagtcatcgctaccaccacttggaagttcatgccactatcgctattgctagtgaattaccctcctgcttgtctttccaaattcagtgctaggttaaaaggtgattgcagttcctatcttaaacctagcaatcctttatttggaaatatggaaggtatgtgactgaaaatattctcatactaaatgactttgaggttgctcaaggttatttatctttctgttccacatgggtcttgtttagctagtggtggaaccatcggttggtagcttgaggttctttcctatgtttggagaggtacgtatataccttcgcactgcatttgagatgtaaataaattaaactaattattttgattaataaacaagtttatgataagcaatgacaagacttttctaattgttgaggtatgagagttatatatataccttatagtgtgtacgttagtccagaggtatctctacctctagatataccactaaaaatatatcttaattggcacaaatatttatacgcctcaaaatgtaagataaattaaaaaataattagttctcaatcctattctaatatattagattagttttggtatctttttttttagaaaaaatatttctcaagtataaagaggtatacaggagtacacctctataagaatgggagataatatctcacaaatgctttctaacctggacatgtcctccctgcagctctgagaacattttccagactccaatacgaatactgaaaaggatactctcacttattctcctctaactttgagtcactgatgtatgggtccgttgggtagagggtccacgtgtcagtgacccacgtcagtgggaaataattgagttagagaatctcaatctactgctatagtgtgtactgttgtccattaaatttattaagttagagaatctcaatctgctgctatatgtgtactgttgtccattaaatttattgcatttcatgcaaaccagcctgtcataggcggttccccatctaacactgaagttacgatgcaatatcttgcattagcacctccacatttatatatacacactatctttatttaaatttttatcttaaaatatagttattcttcacatacctcctcatctcgattaaccgtaaccctcctctctataattttatctatttttaaatttatgtgcaaaacctcaaacgtacatattttaagatgtagtgagtaattaacagtctcacacaattatgtgttcaacatacattggacattatgaaccttttttttttctattcgtttccttccgatggtgaaatcggcacgcgtgatattcaatactcctatttgccttgtttattggcaggtttatcttttgtgcaacagtgaattgatacctgcttctcatctaggcagtgtagagcctctccttgacgaaggttagagctttgcatgtgaaggggccgcgtcatagctaggatttgaaggtcctgttcgaaatacatagtgaggtcttaaaatttgacagtcaaatccccacgttcttgttatcatgattgacaagatataacttttagaacgggaaaaaacgaacaaatggtcaatcacaatgattcatagaacataataatatctagttcagtagatttaactttatgtattaggcatgcatgttgtgttattttacttttcgttctaagccttaattctgaccttacgggttttatgggctttatcattctagttatactgctaattatattactactaattataagtatacttagcacttcacgtaattattaagatttgggaggcctgaacaatcgaacatgtcatgttccgacggattccgagttctgcatctgccactctgcgtgtgcctgaactgttctttgtttttatggggaatcgatgtctgaactgtttttagccatgaaaaatcttgccggatctatatatgaacttgtaatctgtggaacgatgtcagtcgattgagatcacatgcaggtgaacccgatcaggacaatgatcaggtcaggtgtcagtagaactcgtcagaaacgagaagagtttggcactgcaatatccatacatgatacatgtgcacagcagactctgtaaataactctagctatttgtattgcttattccctgtgattgtaactggaattgtaattccatttgtaagttcagaagtcggtgtacaaatgaaaattaataaatttaaaaataaatatagtccatgtgtgttaagaggaaggagttttaatatgctcaattccctttcctttgtcaacctgactgtgttcggcattgcctgtcgttttccatgcgcatgcttttcaaactgctaaacggtgtgtttttttttcataaagcatatatataaaagttgcttaaaaaattatattgatccattttggaaaaaagctaatacttaattaatcacgcgctaatggactgctctatttccacgtgcactattccacgattgggaacctccagcagctaacagagccacaatcaggtcctgattctgctgagattttgattctcatggagaaaaaggctatacaggacgtctctatggcatcctcgatgtataaatgatcaagtgagtaatggatctgttcgttagctggacactacagccggctgcggcaatagctgcactgcctcaacagtacaagcagtgcaatttctactgctatattgtagctgctgcagctgaacagccgcagcaaatctctaccaaacaggcccaataagagcatgtacaatactagattataagccagctataaacacatacgaggagataatacataaaagagaatggcagcgggctacatatttatagccagttgcagtactgactacaagacataatatgtgtataacaggtggaaccatatattaatagtgtaatatatatttatagataactattgtatgaattggctattaaattaactatagatgatttggagctaatagttgactatactattaaaaaacttgctctaagatgaaacccacgaaactaggttatagttattcctaactcctactccctccgtcgaaaaaaagataaatttatgtccagattaattgtactagaaaatgtcacctccaatactaagttaccttttttgggacggagggagtacaatgtgtagatagtagtaagctagggcccacgtctaaaacattggttggttgaaaaagggagagtagagagttaagtgttttttattgcttcttaccaggtactagtaatgctcttgccggatggaattactacatcctctggtacccacctccacaatagtaaaaaaatttccacatacctctgaaaagtttcgcaatcttttctatacctctgaattttgtctcatcccctatatacctttaacttttcattttaatctcctctatccctattatgttagttgcctgttaattttcttttttctaaaatgaccctatcgtccatttcccattcttacagttatatgctatctactctactttataattcaccaatgtgaaaaattgtaattcatgataaaatcaaatgggacataattatttattgaatagaaaatttaaactgttgaacaaatttattttttttggacaaaatccatagaagagttttagcaagaaattgtgaaccaaaattatttatttgttgggttcaaattttgatgatatcataaaagttaatttaattttttttatttttaaaatttgttgtcaaataattatattccctttgtttatttacaaatagattttttccatataagaattgtgcttttatcattaaactaacacaggtataagagaggggttatatagttaatttcaaaaacatttaacgattacatagagaagatcaaaatgaaaactcgagagtatataagggaataggcaaaattcagagcatctctctcaaggatatatagaggattttctccaattgtaaagtaggtagtaagacctcttctcatgcacatcgtggatgcctaaaatgcacgagatgattgatgccattttggcacattgacacttgaaagcagatagtacacaacacaagggaggaccaaccaaaaccagagttcttgtcttattaccttctccagtgctgcaaaactcggaaaactaccttactgttgttcagatttatcgaaatttggatgcttcgctaacaataacaatagatgaaaaggctaaaaaaaacaaaaaggataagggttacataaaacccgatgtcataagagtaatatatgagacctaacgacgcaaaaaaccagtcacacgagctaaaatcaaagtaagaactgacccactccccaggcaccaagcctatagaaagtctgttacgaaatttagttgccaagtcccaacccaagtagctatcgctcagccacgccgcgaaccttcagaatttgcacaatctgactgctcggctgtggcaattaacgcagaaaatatatcgcgctaattgccatttgttacactgctttcaactgcagattttgaggcgttcagcatttcgccgacaataggggtgccctccttgctcaatgcctgcttctgagctgtggatttcccatcaattgcattcttctccttttcatgtgaagcattgtcaagagagccctgtacaaagtgcataaaaacagaggcatcagaacctatcaccaccaatagctctgagtggtgctaacattctgaacaggttttttaaccacacaaggctctatgtgtgaatagaatgcttgcctgtccttgaagcagttgctgcttagctctcttctcctgcatcagcttttgccggttctcgtaaaaaccaaaatcatccaagattgatgtcttgctgatgtggtccttgaaaatcttgagcatttcaagaccttgctcaagcttaacctgaagcattacatctacttggtaagtaacgcacatggagcatactgaaaggatcatcacattgtcatgccatatcaatagataaaaataaaattcatcagcttcttatacatgaaggtccactcatgaccataagcatgatgaagaaattgatatatatcatgtcttaagttctcatttactgaacgactaatctggttccacagcaagaaatttgaattatctcaagaaaatgacgatgaaattaactatctaaaataacagagacattaatagtacccttaatggcccgtggcctgcaattgaccattgtacaatcaacagaacttggcaagttattgagaaaggatacctcttgtgtgtcacggctgtttgtcacaggcttattgtcgttgttatccaatgtaatgtgcttcaagatgttgttgggtacatccttgacaacatgccacttgattggaaaacacccattccacttgtcttgttgccaataatccactgtcttctcaaaatcaacaggaccaaccatttcagcaacaccaacaaactggccacttgtgtttacctatattccatgcccaatgtcaataaagagtgatatgagggacaaatggatcacataatgtggtaataataatacttacagagaagaacaagaagactgggcattcactggatttctcctgcgcttcacggtatccagcatccagcttcttgtttccattaggagtgcttgcccacacattgtattttatacttttgtgcacatcatcctcactgtaagatttgataacaaagaactttgcatctttgtatgttactggaaaaccttcctggttgaattggcccttatctggaatggcactattctcctgtttcccgactgaggggagggcttggcccttcacagcaatagtgacagaaggtccaaactgtttttggtgcttgaatcctccagatcttggtcctctgttaagctcagtgaagccatcttggttctcactgccaaaaccaaaagatgcacgacctctaggcttgtacttgctatcaacaattccccaccgtccattatttctggagttgtacatatttgatccgaaaccaagcccagttttaagtgcgttcccatactgaccatactgcccatataatctgttgtctgggtacatcctggtatgataactaggagatgtcaaacccattcccgacgaaggtatctgtgcatgcataccctgaaacaaatggatattttaggctaatacttgtactttgtgagagccacataatgcatcactatcatttttgctatgtgcaacttaaggggaaggcagtaatcgcagaatctaatactaggtaaatgcatttaataagcagaaaaaaaaataattgtgagacaatcatactgctttgagaagctatggaaaaagaagaagagtgggggaaggaggggggcaatggagaattggacagtcctagaacataccatgaggtttgcagttgggcgctggctctgattttttgctgaatacgagttagaaccataagatgtggaattagtatttgatctctgatgcccattagagtagactggcccatcataccactgaactggagaatgaagaccactgtgaccataattgttagcagatggtccaccttgcaaagtccctcctccatatgaaccattgtttaatactgatacattttgatgggtttgcttacgtgctaatgaactactgttagtatttgccatcccattagcagtcccattggcactagcttttgctgattcaaccggaacacgtgcctggtgagcagcaacagagggcatctcagactgagaattgacagcattgacgccatggcttgcattggttggagctggttgctgataatattgaccagggtactggtaatgctgtgcgccgtatgactggccatcatgcccaacagttgggacaggagaaccagaaggatatgggccatagggagcatagccatatccatacatgtcaccataaacactctgctggatcattgtaacagaatcgagttaatttatctccaacacatagcatgagtagacaagcaattcattaaattccaaattaacaacatatgtcccccacggtttctatctccatatttggtccttagcctcctctaggcacaggtgaactcgtgatatcacattacaccttaaaatacctatcgcaaagtgatgaactaactataaataactgcattaacttacaggaggcatctccgttccatcatgggcagcatatctggagtcccattcattggctgagccgtcataacctatatacacgaacgcacaaacattaaaatcagcacttaattagactacctgattatccagcaaagtactaggtgtttgtaccagtaggatagtaatatgctgagggtccatatccattggtctgatacaagatgttggcattcacggcctcctggagcaggggagtgatcgacctgtccaccggcgacgccgcattctgcgcatcgccggcgcttgcagatccatagggcatcccggcaggctgcaattcacaaaaaggaccataatttttagctacctctcctccaaacaaacaaaaaggatggcacaagcaacacatcacagacaagaatcgccagcaaaagctaccttcttggtagcgtcaggggtggcgccttccttcttgctctccaacgacagcttctgcatcatgtcagtagcctctgtagcttgcgaatcaaggaagaaacacttcgattcaaaagcgagcaactaaacaataatacagccataggattcgaacacgagaaaaagaaaaaaaaaggctgtttaaattatcaccccagaaaaaaaaagaagttcaaatctttacgaagaactggcgcacaaaccgcaaccccccgctgctaaaacagattaaacacatcaaagaaaacaaaaataaaaaggatacggtcgccagcgccaggagcaacggccgccatggttcctcctcctcctcctccctccgtcccagttcgatctaaacccgccttctttccctcctcgcggattggatcccaagaaggcgaaaattccaggaggtacggggggcaaagaaggcaggggtggaatatagatggtaaaaaaaattcttgtggtaggtagaggcgataggtggtggtggataaaccctaagagagggggaggaggagggagagggacacgaagatagccgccacagacgcgaggggggaggggagaagaggaggagacggggggaggggtagccaaagaaggggggttttaggcgattcagaggcggtgattcaaatacctgtcccggcacatccccaccgctcgtttatcttccccacctctgctccgggcacccacccaaaagtgtttcattactctcccaactctacttgtctcatgtattaatgattaacttaggatgtgtttggatccaaagtttggatctaaacttcagtctttttccatcacatcaacctgtcatacacacacaacttttcagtcacatcatctccaatttcaaccaataaacacagccttattttatagtctatactccctccgtttcataatataagtcattctagcatttaccacattcatattcatgttctatctagattcattaacatgaatatgaatgtgggaaatgctagaatgatttaggtggtgtttgaatctcctaaagatgaaaatgaagatgaagattaagtatttcacgtaaaatgaggtggtaataacgtgtgattaattaatttttaattattacaaacttgaaaaatgaattaatctaatattttagagcaactttcatatagaaagttttcgcacaaaacgcactatttagcagtttgaaaaacgtgccacgagtatctattttatcctcagattgcatgagaaacgaacagggggcttacattgtgaaacggagggagtagaacggaaggagtataatatatgttgttattacgacataatggtcatgtttagattccaacttttttcttcaaacttcctacttttccgtcacatcgaactttcctacatacacaaacttccaatttttccgtcacattattccaatttcttcaaacttccaattttagcgttgaactaaacacagccaatgtttgaggcaaaaatgtagtactagttgatttactggtcagaagtgtcatgtataaatgacaactggtggtagtaaggattttctattattggtggtagtagttcttagggagatatctgggcatgtgttgaaagtattgatagatgtaataggttatggaagggcgtaaattaattgattaaatgttaggaagttgatatgtcaatttttaaagagtttttataaggtggaatgaggaagaaagtttgtgtaaaaacaaaattgtttacaaaattgagaaatgcgtccgtgataatctatagtcattatttttgcagtgtactaggatggaagaagacgtaacggagttttggtaagtttgtggcatgccatacacatccaataaatgtgtttttttatactaggaatattacagccttaggtggctcacaatttttagggaaatcctatcccaatatatctacttgtcataataaaagttaaagatagttgtagttaggcattgagggaataaatttaacagtggctagtggagcaaactaaatcatccagggctaataaatcatccataatcatactattcttgcaatttcagttcaggtatttccaaacatcccagttttgtagtgtgttttaattacaaagtgggagtggctgtgtggccatagcattgccccctattaaattacttccacaaaaagcaagagaaaccctagcttccattgggccagcccatgacccaatcaggcccatactgctatgctatgctgctcgttcaactgccatactcataaaggtccaatttttgttcatatctggaagatgtttgttgcttgacgaaaaatctcagttgtttttgtcttcttatcatccatcaattcacggccacgtatattgccccgaactccaattcaacatgaatattcagagaatcgacaaggttctttttttcttttttcttcttgttacaaaagactgttcaaacaccataacaaaggcaaacctttattttttttcttctttttattagagaaggcaaactctgttggacgatgtcataagcatccatactatactgtataatcgatttttgactgacatgtaggatagaaatcgtaataatagaatatgaccagaattgaaatgcctagtagagaaatgaagaaagaacataataataattttcctgagcaattcaaattcttaaagagaaaaaaaagaaaaactcttttgtgccatcgtggaccagagtaaattccaagaaaaatatgaaaagaggtaatctcagtaaattccagaaatattcaaataagaggcattccagagtaaattccaaaatgatattataaaagaataaagaagtggacctgaactttgtttcctttgtttccatgtgctcatgcgttagtactatttattttaaaatataacaaactatctaagagcaggtacaatagcagactaatataaaataagatagaggagagtaacatgctatatatttgtagccaactgcaatacaaactttttaaaatacatgtgtatatgacatatgggaccagctatgacttgtgtagtactccgtttataggtaactattgtatgaatcggatatagatgatttggagccagtagttggttatgtaagttatctctactattataaaaattgaagatgtttttggcggtattttgatacatcatccgtgtatgatgaggcttttaagttcgtttgcttttggagatacatatatgtatttgagttagtttttaagatcgtttacttttgtcaatacataaggaatcatataagaaatctgtttaaaaaacttatgtgctaacttgagatgatcggactcctaactacagctcatgattttttaaaaaatatatatatccaaacaaactcttagagtgaatttcatcttaattaaactatataacaataataaaattaaaatagacttcaccttttgtaaaatacaaatatgtgtaagttaatagtataatttaggacgaaattggtaggagatgcatttgttgtagcagctgcgtgcctgccgctctggcttcgcttcagaggataagaacgggcggtcgtcagtgaggtcggcctggaatgaatgaacaagagaggacggcgacgggggagcgttgttggttcagcgtgttctcgcggcttcccccccttcaaatatctctcctttttctttttcttctctcttttctcgcgcatgcggccagcgccacgccgcctacgacgtgtgcttgccgtggttggttgtggctgggcctgggttggcctcggcgccgaccgaagcatccggcggcagctgcaccgcccatgagcttctcgacccctcctcctccggttgtgatgtgaatgattttttgagtccacatgtgattggactctgtcgtgtgcgccagaggaattgctttttgtaatgaactctgaactgaacagttcaactctgaaatactacgctgttagttggtaatagtaaaaattgtgtcccaaacatgaaaagttttatggttcctcaacatatctaaattttatattgaaaagttagatacatatataaaaatattaagttttatattagacaatatggtatctttcattatatttttttaaggatgaaaaaattaccttctaaacatatattagaggcaatcataccagaaatgcaccactctaccagtacatatttggttgggggaaatatacatatatataaatatactctcgtttgtacaaatttacacgaaaaatacatcttgtcaaacaatcagagtaaatgaagaatggtaagaattgacacactctcacaatcacacacacagaaacaatcatatcagaaattttacatcaggtttagctgaaaatatacatatatttactttcgcttgtacacttttacattaaaaatacaacctttcctctttcaaacaatcagaacaaatgaaaagaatggtaaaaaaatcttctatatttttctttcttgtaaaatctcccacctgaaattgccaacaaaaaaaaggcaagcctgcactcccataaaaaaaagggaaatcaccaccgaggaacttcacaaaatagcggaacctgtttaattatgttttcaactttgcattaacaaacaatgccatcagtctgtgtggcgtggtgctgcagtagaaagtggaactgagagttctgcctgagcagtggtgttggttccacgtcagataggtctatgtcaagcatcagtcgtgctatatcatccaacgatataggtatgctgcaatttgattcagtttgggtgttagatcaatggctactgtttctcccattttaggttcatatcttaatagcagtactgagcagccaatcatattcataccttgagtcgtcatctaacaagaacgaactatttggagtagttattgagtcatcagtggccattgttctcatctttccaatgacctgaaaccacgttggtgtgtttcacatcatatgaagattttatttttatttctttactttttttgcgtggaagtagtcattgtagttgaaaagggaaatatgcctaagtattgagaagtttgcaacttacctcctgagatagaccttgtgcaccgtatttatcatcccagaacattgttccaatgcgatatatttgagtgatgctcaaaacctgggaaagtggcactacgtttcatactatacgcttttgcagaaattcaagtatttacaagttagtcatattcaggacttactgggcaaagctcatcagtgatttcctccaaggttttatgtgtcttctgatgcaaaacctgcacgcgaattcacatgatgctaaccaaacatctatataatttgaaaataattggtttcaactttcaagcataccagaaatccaactgcctgtctgatgtgctgaaattcatcccaagacgttcctgcatactgcattatcacaacgcatttggtcaaatacttccttgccttttactcatttgtcaccaaacaaaattatacacaattttcacttcacctcttcagttgttacagagcaccactgctctaattcttgtaaaccagcctttaagaattccccattgctaaaggagcagcattctcgacggagtagcaaactgaatgagaaggtatagattttgttatagtccagaatcaaccaatttgttcccccatatgctaatgatatttcatatgactttgtgtagtcaaccagagttaactgaagttactttacaagacttagaggtggtgagatacctattgaagagttgaacgttcataaaggcaaatgcttgattgaatgttttcctgattatcattggaggtacctacgaatagataattcataaggaaaactccctgatcatgggacaactgaaaacaattattgccatactcacgtgattattgttcattgtttcgagtgtatggttcaggcacttaatgatgctttgccaatgcacacttgatgtttgccttgatagtgaattagaatgtacacttttcaacgatcccctggatgatctcacacgaacagcccttggagcctgtgaaattgacaaattgttaacgaaattgtatcgccttatattcacgattggcatggaaatgtctggggtgcatacctgtatgcacataatcaagaacgggtttatttccttcttcaggttatctctgatcattccatatatcttctcgacatatgctgttaattgctgtttgaaacgtagtgctgagtattttgcctctacctttgatgcagtgtcaggccttccaaccattccactatatccacttgatatgcctgatcctaatgacgacgatcgagcattctgacacgcaatttttgggatgtaagctcatttttatgttgtgaatatcactttggtcgttgatgtggtgtatatataagtaattggttaatcagtacgaaagtatgttgaaaacttcgacttgcaatgccaataaagaaccttgctttacgcaaagcatgagtatggataaagaacttgcctgcaccatcctactgaacaggttgcctgttgtggttcggctgcgatttgatcctttacctgctgaactgctagacttaagagtattttgtaataggtagagaagagttgatgtagtcgacagccaataagccagttctgtagaactttcagcgtgctgtaaatactcagataatgagtttcatgagagcttgctcaccaactatataatgtcactgcaaacggaaagttttatatagtattttggaagtaacaacctcaattgatgacctaattgtatggatgattcggtcaaatatgttagtcttctctgcttcaaatgagtgccagtgcaggagtgatttgtacacgatgcatgctgcagctggtctgccgttgtcaaatctcctgtcttcagccagacttttgatcaggacatcatgattttcctgtgaaagagcaggaaaaccaaatcgagaaaaaaattattttgaatgtgcacaatgcctgttaactaagaacgtggaacttgtttcttgcattgatataaaaaaattttgaaggcactgaaacatacttgttgtcgatccgtgagcgacttttgtttgcttaaattctttataggaggaacaaccacctcctcctgaaaaaaaaacaaagcaaatatataaatccatataaataaaatgtccaactgaggttttttttttgctctcatgttgggtaatagagagctataaaaacacgtacaatgaggattttatgttcttcaagctgatatcgattcacaaggccctggtgagatttttgatagaaaatttagtgcaactgtgtactatacttcagaaatatcatccatcttatcagataagagatgtgttttattaatgttaaactgacaggattatacctccattgctgatggctgaatcacttcaggagtaattactgcttgaacagctacagaagatttactgcggagcaactggttttctgactccaagatggcaatcttgctttccagactagaagaagagtttgttatgttaagttatgaggctttcaaaaacaaagtggataagaattgcagtgcaaacatttcaaaaattacctctctatttgctttgatttatcgtcatctgcagatgcaagtagtgactgttgacgtaggacctggttttcagattccaagctggataaatttgtttcaagcctgcaccatatatcataaggccgtgactgggtatcatttgtaatatgcacgagccaatttatgtaaatatttaaaataattaatacctttctatcatctcctgaagttgattaagtttggagtccttttctagaatttccctcgacaattcatcggactccttttgaacctctagaagtctcttttctagatcttcagcctttgttctaaatgtaacaagttcatcctggatgcaaacatgaatatggtaattagttaattagtctaagcaaaagggctgaatcatttttttagtaaaattaaagcttatcgagtattatacctcaagttccttattttgtctagtcagcagctcaacttttgcattgtccaccaccggcacctctactatctttggtggtgcctgttcaattgctagttttgcatcttctttctccttttctattgctgcatgtgcttccgaaagcttttcttgcatttcttgcaacacagatttcaagtttgaaatctcttgccccttggcttcttcaaggtcaatctgtcagcatgacaatatttagcaaactcattctttttagaaaatggattaaaccggcctctacatccagaagggatgtacacagccaatttagcaaattcatttgggtccaaggacagataaaactctacagtgaattaccctcaagtgtttctcaacatctaatcgccatgtgagttcctcaactcttttttcaagtttgtcttttgcttctttcagtgcgccagtctctcttgcttcctgtttaccatttcagatttttttacttgacattgcattaacatacacacaagaataacttgggtttcaactgtataattggacaaaccattttgagctttcgaagttcctttcttgcaatacgtgctctccacaggcactgaagaatcaaagtagctcttttttgctttttgtaatcaacataagctttgtgttggcgccatcgagtctggaaataatgaatgaagcggttaattgtggttgctgcttatttctgttcaagaaaaattgtggttgcttttcatgaaagttaattcagtgccatcataataaattaataatactacaaacctggattattatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27605 - DNA, 775 bp, Oryza sativa
ctagttccctaattgtttgttgaatggcagaataaactcaataccagactttgcacctttggtatttacatctctgcacacatttgtacaagtagcttcaaaattagtataactggatgattcgcttcccatccgcataccattcctcatatcttggcacttctgttaacagatcaaacaaaaggaaattgcagtgagcacaaatcctccagaggaagcagtcaagatttcactgaaggactgtttggcttgcaggttttctttactaccttgcactgttcattcaatcagcagcttgtccaaatccaaataatgctgactgtttcattttaatcccatagtggttgcataacatcagcagaaacagttatgcttgagaagcaaagcttgggtgacttcattactcgcatcaactctgacaaagctgtcatagtatcggtctctccacagtcaagagcatcgctagctgcattctttggtctttctcaatcacaggtgattaaatatttttttcagttatctgcttccctgtcaaatctgtccttataaaatgttttgtccgaaatgctagtttatttgaacataaccacgactagagatgcataaaggagtgcatttttatcatgaacgtggtaacaaaagcaggagcttaatacctttatgctcaggttttcagaaaactcactgcgctgttcaagtcgatgggcgtaaaggcagtttacgacacaagttccagtcgagatctgtccctaattgaagcatgcagtgaatttgt

SEQ ID NO: 27606 - DNA, 767 bp, Oryza sativa
aataatctgacctcacagttcatttatggtgatccatcatgttgctgttaacatgccaatcaagtataactgtgtggtagtatgcaattcatatttaccgatcatcacatgtgcatatgaaatgctagctgtgatgcttctaggatctaattactactgtgcaaatatgttatgtttgctgtatgccagaatttccactaactgtaaagcttatggccttatgtaccaggtatcggtatccaaccccttcgagaaccctattgcgaaaagattatatgatgaatggcttgggcaacctggttcagaaaacgcaaagaagtatctacacacgaagtatcacccagtggtgaaaagcgtggcatcgcagttgcagaattggtgataacacagtggtggaaagcatttcccagtgtgggcagttgcttgtgccatcttggtgccctgcccacactaagcaaacactgaacacacagaaaagaaatacacgtcatcaaagattttgcatgcgggcaaatgaattttgttagattgtaggttttaccagcttttcttggtaatgtttgtatactacctcctcactgggaaacacagatgagattgtaacatgtaaaaacgaagtgaaccaaatagtagttgatctactcagctgataattccattgcaatttttcaaacagggcctattcgttagcatttatcttatgattccttaatttgttttatgtacaacagtgatctttttctcttcttctatgacgtgcgtgaaac

SEQ ID NO: 27607 - DNA, 1206 bp, Oryza sativa
  unsure (1)..(1206): unsure at all n locations
ttgtcttcatgaaacaggttcatgcctgatcttcatttttgaaaaaagagggtcaaatgagcaaacttgaaaaaaacagggtcaaaaacacaattgctcctaaatgctactatctcttgattataccttgcttcaagtcttctgcaaactggcctaagtcttcatccagacgtttgatatgactctctatctgtacaataatccatccatggtacttacagttaggtattaacaaaatattataggatataaatgacacaaattggaacaaatatcaaaaatggattttgtttcgttagtctgggtccctgaatgggacacagtgagttgataatgtaattgagattctagaattaggacatgcaatttagtatatgattctagcattgatgtaatttagtgtcaggcatccgaacattcaatttagtatatgggcagtatgagacataacacagtatgacagacatcaggcttttcattaaatctcatgagataatctcaagatgccagatactattagtggtttgtaattgtaacaaaacagagtttttagactgcaaacattagtcttcctgtgtgatacttctaagttcgtaactattcattatggaatctggagttgaacttgacaaacgcaaactgtcaaaataagtttggactttaatatagaacgatcaagtttgtttaggtgtatcaattaaagggtatctaagatctcgtctaaaagaaaagcgggcaactaagatggcacttaacatgaaatgaaatgtacaagttccttgagttacgggactagaaaaaaatgaagggtgcatgcagaaccaggtcataagcttggcgtgcaagcaacactttctcggtgcagagactcaacgcattgtcctgactagcttcgatgtcctttttcattctctctgaggcagattcatcatcatccatgtttgacctgtcgaacccatgggatggcactccgagtagatactttatctgttctttggtctgtcccataatgcctgcatcaacagaaacataatccgtacaactacaaacttgagaaaactatcaatatcacataaatttaatctataagtgggcactagccctatacaaaacaatcacatgacattatagccttgtatcaactnnnnnnnnnnnnnnnnnnnnnnnnnnnnnnnnnnnnnnnnnnnnnnnnnnnnnnnnnnnnnn

SEQ ID NO: 27608 - DNA, 664 bp, Oryza sativa
  unsure (1)..(664): unsure at all n locations
nnnnnnnnnnnnnnnnnnnnnnnnnnnnnnnnnnnnnnnnnnnnnnnnnnnnnnnnnccgacgtgtagtcgctgctgccgccaccgtcgccgtcgtccccctccgtccccgcctccgcctccatctccgcctcctccgcccgccgcctcgtcgcccttgcctccgccatcgccgggggatgccctagatctgagcgccgcgggatgcggtgggccgcgcggattagggttttggggcggcgccgcgcggattttggtggtggcggaggtggagagggtggtggtggcnctcgccttccgccgctgctgcttccctcaccgcggctcgaggggggtcagttttattatggcaaaatttatcggtggggacgcaactaatttaattaccatcttaataaattttaccaaacgacttttaaatttggggtcgatttttatttttatttttttgggtgagaggacaggctaactaaatatcctccgtgaatctacacgctttgagggtacattatagtaatcatagtaataaaaagcaaggttaatagtatagctaactactaactctaaatcatgtataatcaatttagtagccaatttatatataaatagttacctataaacatatgctacattattaatggaagggcccacctggcatacaatca

SEQ ID NO: 27609 - DNA, 730 bp, Oryza sativa
  unsure (1)..(730): unsure at all n locations
nnnnnnnnnnnnnnnnnnnnnnnnnnnnnnnnnnnnnnnnnnnnnnnnnnnnnnnnnnnnnnnnnatcaatctaactgatgactctgaaatcagagataacagtaaacatacctttgcctcatttgatacagctggctttgaagggaattccactctgcgtgcgttgatgattgtatcttcccgaagtattctctcctgggtctggtcatggccaaaaggacgccttccgaagagcatttggtaaaacattacacccgctgaccaaacatccacctgcaggaatgcaaacatcaattttaccaccaatcagaacaaagatgaagttgcccataagtggtttaaattgattactcagggggttcacaaatgactctaactgaaataagggttaagaaggaatcgcgtaacattttgagtaaaaattgcatatccacatggccattgcctgcataccactaagcccaaccagtattccccatccccatcaacagcagatcaattcaccacctgtgacctgcacctttctgctcttgcacctccttctgaaaactaaccatctgcacggccatttcccctggatctgtccaatgggaactactatcagactgatctatttggcacataattgtctcgatattgacacaatttaagctgtgcatgtgagtttcttgatagttttccctgattttcctcattcggcacctctttcctgttctgtattaaataaca

SEQ ID NO: 27610 - DNA, 673 bp, Oryza sativa
atttagttagcctgtcctctcacccaaaaaaataaaaataaaaatcgaacccaaatttaaaagtcgtttggtaaaatttattaagatggtaattaaattagttgcgtccccaccgataaattttgccataataaaactgacccccctcgagccgcggtgagggaagcagcagcggcggaaggagagcgccaccaccaccctgtccacctccgccaccaccaaaatccgcgcggcgccgccccaaaaccctaatccgcgcggcccaccgcattccgcggcgctcagatctagggcatcccccggcgatggcggaggcaagggcgacgaggcggcgggcggaggaggcggagatggaggcggaggcggggacggagggggacgacggcgacggtggcggcagcagcgactacacgtcggaggacgagggcacggaggactaccgccggggagggtaccacgccgtccgcgtcggggactcgttcaagcagggcgcctacgtcgtgcagtccaagctcggatggggccacttctccaccgtttggctcgcctgggacaccggccactccgtgcgttcgaatcccttttgcccccccccccccaactaaaatttcctcgtggaatgggcgttccccccttttcccttcctagattcgtgatgatttgtgggaaatct

SEQ ID NO: 27611 - DNA, 754 bp, Oryza sativa
  unsure (1)..(754): unsure at all n locations
tcggttccctcccggggttcttgcgcgagcggctgccgatccaaaatcttgtcctgcactctttcggagtgactacctctttgcataagacagataaggttcttgagcgatggttagaacgtctggtctttctgcttggttgtatgtcaagcagcgacgaatcagttcctgcgagttttcaggtgatgcagggtcaaacttttgccaaactatgtgcaatgttatttaaactagtgtgttgagggacaaaagtttaaaccaaacggacagcctcaaaggcacaacatggaaaatatagtaaaagggatcaatctaactgatgactctgaaatcagagataacagtaaacatacctttgcctcatttgatacagctggctttgaagggaattccactctgcgtgcgttgatgattgtatcttcccgaagtattctctcctgggtctggtcatggccaaaaggacgccttccgaagagcatttggtaaaacattacacccgctgaccaaacatccacctgcaggaatgcaaacatcaattttaccaccaatcagaacaaagatgaagttgcccataagtggtttaaattgattactcagggggttcacaaatgactctaactgaaataagggttaagaaggaatcgcgtaacattttgagtaaaaattgcatatccacatggccattgcctgnnnnnnnnnnnnnnnnnnnnnnnnnnnnnnnnnnnnnnnnnnnnnnnnnnnnnnnnnnnnnnnn

SEQ ID NO: 27612 - DNA, 609 bp, Oryza sativa
  unsure (1)..(609): unsure at all n locations
nnnnnnnnnnnnnnnnnnnnnnnnnnnnnnnnnnnnnnnnnnnnnntatatatatatatatatatatatagagagagagagagagagagagagagagagagagagagagagagagagagagaaggtctgaggtgggggaatcccggaagccgggcagattcctgagaggctgagaatagatgctttggaccacctccagtccagattctgttctacggattgcgaaattgcggcaggatatacgcatatgcgtcatgtttgatttctgaatcgaagtaaatttacataatttttgcaggatttagttcagttcctaaaagaatcatatgaatttcctcctttcttttctttttgcattgatagatcggatgcccaaataagtcaaagaaaaaactaaaatttaatttttcaaacttaatattgagattaattttaagatattacaatgtagttcctttttcagcattgattttgtaagtgacaagaacacgtaaaaaaattccctaataagacgggaataggagcatacgatgggactttcaaacaggcaaagtggcaaacggctcatttttcaagtcccagtgcaagatttaagtaagcaacatttag

SEQ ID NO: 27613 - DNA, 584 bp, Oryza sativa
atattaggtcggtttgttgggcgcctggaataatgagcacctcaaaagtagtttcatggttgaatatagtatattgttgtttgtcaacaaccttatgtgtttctcatatcaagcgctcgtgtccgccggcgcggctacgcggcagggacatgcgagcagcaagcggcgagcaagcagccagcaggcatgaagcaacaggcggaaggcaagcagcacaagcagcaacaagcaagtggcattcctcccgattcaatcctccctagtccctaatcaatccttgctctccttttttcagattctatgtatatctatcctccctgattcatatatgtgatttattgccgaaacttcattacttgaggtatttttcaatgcctattcttctatttaggcttgtttgcaaatggataatggagctgtacattatagcgcagctatgctgctataactgtgaatctgtggtgtacaaatattatactccctccatccctaaatgtttgacgccgttgactttttttaacatgtttaaccgttcgtcttattcaaaaaattgaagtaattattaattcttttcctattatttg

SEQ ID NO: 27614 - DNA, 1852 bp, Oryza sativa
  unsure (1)..(1852): unsure at all n locations
nnnnnnnnnnnnnnnnnnnnnnnnnnnnnnnnnnnnnnnnnnnnnnnnnnnnnnnnnnnnnnnnttacatcggataaatgagatgagtgtcggtttcatcaattctaatactttgcaatagcgagagtaatatgctagatcatgcctctagttgttttattttctcgcatgaatagatgtatttgtccggcctttgcgccgactcttctcttgttatatcgccgaccacaaagtttggcaccacgcgcccgaacgcgcttaccgtgcacacaagaaggtgcacatacataatccgttgaattgaacgatggagtgctatcccaaacgacgtcaccccatactcggtaacacacgacaccacccagaagttgtcgtctatctagctaatatagtcgttgatctatgaatatattaacacacttgtcatcaccgatcttatggatcagcgcgcttgggacactgttgattgtgacttgtatgttaatccgtcatattgctatctgtatgaagtagatggtaacaaatccgagtcatcggcacctgcatgcgccgccgctgccgcctgcacgtagcgacaccttgacgccaccgcatgacgtcttcccctttgtcaatgggtgccgaatcaatccagagactttccctcgtcaatccgccatctgaaacgccgactcgacggcctttcgagaccatctgcaacgcaattgacgggcttcgcccgtagcgacgccgaggagcttacgcccgcctcccctcgccgccagtatgcacggcatgcctcccgcactaccgcacgcggccgggacgagggtcgaagccgccgtgagcgcccgtcgccgatagccgtccgccataccagcctgtatgccgagccgagtttcgtcgacacgtaacatgaagctatgattgtcggatgccggtcacggcttgatgccaacgaatgccggtgtcggtgctactagatgttgcaccgccgttccgcctctgagcatggcaacttgctatagtcgtccatctctactaagggctcactagcacgtttgccattggttccatccgtcgtctccattgaagaatggcaattggatcatacctcacccacttcttgtgggagaaggtcgtaatagcccattgggcaacatatgagatgggctggccaggttttcaagctagccagtataaggaggtgggccaagtagaaattggcctattaaaaggagtcgggcacaaaccgtgattttggtccgaaaatggcattttatttgaaaagtccttggtttccaaggcattatgcggaactcagaaattatgcggaaaagtcctatgggacattagaaactacggggaatatacattcgccatttatactttgaaccttcatgagttgggtttacgccaaatagagaagaattaaggatttataccttagtcccgtatttctaagtatttgctttaactatttagttagtttcttgaataatcatagtcaatcctagaaacattgtttttaggcaaaagagcttctatgaacttgtgaaacctttgttttagcaccccttttggaagcatcatattttatggtttatttcctggtaattgtttatttggggtaattgattgttctgtgggttagtagttctgtaaattacacatacctttgaatagcagaaaatcatgttaattgctaggattgtaataaaaggtgtgtatagaaatttactattttgtactcgttttgtgcacttcatttactagaagtaaaccggtagaaagttgcataaaaggacatcatgtaagtannnnnnnnnnnnnnnnnnnnnnnnnnnnnnnnnnnnnnnnnnnnnnnnnnnnn

SEQ ID NO: 27615 - DNA, 4050 bp, Oryza sativa
  unsure (1)..(4050): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacaaacggagaaagacatgcattgttagcccatcgtaatgaagggttcagaattagacatcacacaagatcagtctcattagaagactcttctgcaagtgcagaactatccaatggtattgactccactaatcagccaaaattagtgtaacaaataacagtgagaatccaatcttaaaaatttggttcatgttatatattcggtaacaatgttttttaaatagacaatctatgtttaatataacaaggtaccaatgatgtacatcctccatcacaatcattcatcaatacaggcacagcatgcgcgccatgtttatgtatagtcacctatttcaatacaggtgatggtgaagtcatttttgaggttgatactgatgttgatagtatgtttcatgttgtgcaatttctcgtgtaagtgagatgtgattctaatttctacttcctctgttgtaaaatataataacttttatctatgtatctgcacaaagatatgttgaggtacttaacagattagtatgactactggacgtaagatatatttttgttttgcactgagaccacacagttcgaaacacactgtgaaactatgaacatcaccttgtcccttagactttacttattacactctcttctaagtttatggtgtattgttcttgatccactgaaacattggctcttcattttgtacagtttgttaaatcctatgagactaattgaaaatcatattggctggggcaatgcccagagttttggctagctaacctcccacatatataaattaaagagattaacattaaagacaagaagactataattccacttaattatttaaataagaggcatgtgtatgggtgtgtaaagacggttgggttaggtaagactgggtgagaaataaatgacaagtggatatatagctaggaaaaataatactcttgagccctctaatatcttggaacattttttttaaacatggtacagacgcatacgcgtacatggacaccctacccttataataagcatctttggaaggctgagctagcacgtctggagattgatgaagttactactaacgactcgctgttgacggaacatcgttcatcgctgaaagaataattagccgtaaatacgagaacatgtgtctagtctaggccttgaatctgggtgagctagtttcatgatttcatcacaaagaacctaaccagttcagctacactcatttcacttggaacaaattttgaatgtcacgatttgggacggaggggagtaaatattcagtggttacaaaatttagatatttattataacaattaatttgagttggaatattgaaaaagggttgtcaatttcttagtttactttttttttcttatatctattaatcatttcctcagcaaaacaagtagaatatttgttaatttttttaacttatactacacaacgaatatggaccgttcttgcttcttttatatatgcatttgagtgaagtcatgacaatttaactactccatctgtttctgaatatttgacgccgttgactttttaaaatatgtttgaccgtttatcttatttaaaaaatttaagtaattattaatttttttcctatcatttgatttattgttaaatatacttatatgtatacatatagttttacatatttcacaaaagtttttgaataagacgaacggtcaaacatgtgctaaaaagtaaacggtgtcatatttagaaagggagggagtataatatttttatgtgcatttctgttcagtaaactgcatttgtacgctttgtaattataaacttcaaattatgtctagtcgcaccgatatatacaacttctgtttaaaaacttctgaacgaacattaccaggagatcagccagaaaatgaagaatgttgtcatcaccaagtcctcgccggagctcgtcggcctgtcgaccaagccggcgccgccgccgcccggtgacatcagcctctcctccttcgacgaggctcttgctttcgccgccttcacgtcattccacatcttcaccaatggcatcgttgagccggccatggcgatcaagagggcactgtcccaagctctggtctactactaccccatcgccggccgagctaatttcgccgccggcgaacggaggctccgcatctcctgcaccggcgagggcgtgggcttcgtcgccgccacggccagctgcgctctcgacgacgtcaagctgttcgacccgccgttcgcggcggtgttgaaggagctcgccgtggactatccggcggagggatgcggcgaggatgatccgctgctgctcatgcaggtgacggagttcgcctgcggcgggttcgtcgtcggcgtgacgtggaaccacgtcgtcgccgacggcttggggatcgcccagttcctgcaggccgtcggcgacctcgcgcgcgggctgccccggccgtcggtgttcccggtgagctgcggcgatggcttcctcccggcgctgccgccgctggtcgccgccatcgagaagacgatgctgagcctggagaccaagcggttcgcgtacctcgacatcaccatcccgtcgaccatgatcgaacgcgtcaaggcggagtacgccgccgccgccggcaacgtggactccggcgagccgtgcaccgtgttcgaggcggtcaccgccgcgctgtggcggagccgcacgcgcgcggtcatctcctccgacgaccccgacgcgcccgcgccgctcgtcttcgcggccaacgcgcgcaagcacgtcggcgccaaggagggctactacggcaactgcgtcacctcgcaggtgcccgtgccgacgagcgacgaggtggcgaacggcgacctcaagcacgtcgtcaggctgatccggcgagccaaggaggagataccgttgcagttcaagaacgccggcggcggtggcatgaacgggaaacgcgtcaagcagctggccggcgtgctgttcgggtacagcgcgttctacgtggcgagctggcggaacatcgggttcgaggcgccggacttcggcggcgggcgggcggcgcgggtgatgtgccacttcgagccgacgggcgtgccgagctgcgtggcgtgcctgccgcgcgacggcggcggcgccagcgttctgtcgctctgcgtcagggacgagcacgtcgacgcgttcctcgcagaattggcaactctcggctgaatatttgggaaagttttctaaactctatatttttcccgtctcttactacgtgtgtattatattatatatctaaatagttattaaaaagttttaaaatattgagcaatatatatataatctgtcacgctcattgtcacgctcatttcataagttatcgatatctataagttataaccaatgttctaaaagatatttataattactactagctccatccgtccaaaaatataataacttagtatattagaacgaaaggactagaaaataatgtccgtgcactgcatcggccagtattaggtaattaaagattaacatctgttaggtccacctgccaggcaacttgtttagaatagcttatttcttatatgccactacaacttcaactaaagtttttttaaaaaatatatatataaaaactttcccgtgtactaaaatgggtccatccacataacgtatattgcctacatatattcactcgtccccattttaattttttttttgcgcggatcgccccattttaatgaatgaatcatatactgtaatcttgacgccgtgaatgcaatcaaaaaaggaagacaagattcgtgaaataagccaaccgcatattctaaacgagaagaatttgtgaatacaacctttaattccctgttctagcgatctaaaagcaa

SEQ ID NO: 27616 - DNA, 2068 bp, Oryza sativa
  unsure (1)..(2068): unsure at all n locations
tgcgtggcgtgccttccgcgcaacgccggcggcgcaagcgttctgtcgctctgctcaaggacgagcacgtcaacgcgttcctcgcagaattgccaactctcggctgaatattgggaaagttttctaaactctatatttttcccgtctctaacaacgtgtgtattatattatatatctaaatagttattaaaaagttttaaaatattgagcaatatatatataatctgtcacgctcattgtcacgctcatttcataagttatcgatatctataagttataaccaatgttctaaaagatatttataattactactagctccatccgtccaaaaatataataacttagtatattagaacgaaaggactagaaaataatgtccgtgcactgcatcggccagtattaggtaattaaagattaacatctgttaggtccacctgccaggcaacttgtttagaatagcttatttcttatatgccactacaacttcaactaaagtttttttaaaaaatatatatataaaaactttcccgtgtactaaaatgggtccatccacataacgtatattgcctacatatattcactcgtccccattttaatttttttttttgcgcggatcgtccccattttaatgattgaatcatatactgtaatcttgacgcgtcgaatgcaatcaaaaaaggaagacaagattcgtggaataagccaaacggcatattcgtaaacgagaagtaatttgtgaatacaaacttttatatacgtgttcttagcgatctaaaagcaaatgctgaaaaataaattttaatgagaaaacctcaaaatttgctttaaatttaaagttgaaaatttaaattttagctaataagtataagtataagagaaaagataataccataggaagtcgatggtagagagagagagagcatgttcatcaggaaactgagtaagacggtagcgtaaaataagaggaggtggttgttcaatggtagaggaagacagtgacaatacgagaatctaagctagagaaggtgacagggaaaggacgagaggtttagggaagcaaaatcacgaccagattagattaaacaaaaagattgtagtagcgtgttcggtgttcatgcacgatggatcgaacagtggcagctactgtattaatccataaatcaataaatcactagtactgttacttattgtccatgatgatgtgtgcatccgaactgccgatttattctctgtacatatgtatatgcatggcgtcatctatacctagtagaaaaaatgactgtgcattataacaggaagaaaagatgagaaaattgagaaaaagttgagaaaaatttacagtatgtaattaattaaaatacaaattttctgaaatacttgggtatttaataaagtaaacatgggaaataaaatgatatggctagatttaaattttattaagttctccttaattaattacactctttgagtttttttttgaaattttcaaagcttaattgctaattttaataatacaaatatcatttcaacatttatttaaataaaatacttcctttcactctgggccatttttagcccatttcctcccttagcctgcagccgagctggcccgctttcctcccttctcctcccctccgtcttacctcgcaagcacacatccggcccagtaagtaacctaaagtctaatttaccccctactcctcttctcaccaccgtgtgggccccaaccgaaagtctaacctaattgctttgtgttggacccaccggcgcacgcgttgcatagcaaagcagtgcttcggcccgacacaagattgatctgagccattcgttttgatggacggctcagatcagttccgaatgcatcaaaaccaccactgacgtcaaaaaagaccctaaccctagattcactttttcccaccgcccgccaccactccccgtgggccgcttcccttttcttaaactctccccatcagcggtgccactccccctacacaacaccactgacggcgctactccctctcgnnnnnnnnnnnnnnnnnnnnnnnnnnnnnnnnnnnnnnnnnnnnnn

SEQ ID NO: 27617 - DNA, 15098 bp, Oryza sativa
atatatatatatatatatatatatatatatatatatatatatatatatatatatatatatatatatatatatatatatatatatatatatatagggagcgtatcctatgtacacaggccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgttttttttgttacggctaaaatataatgaatttgatgttaagattttaaccctaggtgtaagacaattgaaattatgtgtatgattttttctagattttttggtgatattttttagttggtgtgcacgtgtgtacacgtaagggcctgtgtgcataggatatgttgccatacatatatatatatatatatataaaagttgctttctattcattcataatgctctgaggtgattgcttttattatttttttagttaattccataatttgtgctgattaatttaatttctagatagaatcatgtttttatctctacaacagatttacttcaaatgacatgctaaagttaccttcttttgttttaagttacttctataatatatataaattacttttaggttttactgaatttacttttatatatctaagaagtaaattagtgaaatctaaaagtaatttagacatatcataaaagtaatttgtgatttttcatcaaaatataatcatgtgagatcttgttgtaaagatttaattgttacgaacacaacggtgtaatcggatcatagatcggataagtagtttaagagaaaattgtatttgaagtatagatggatgatacctcttatagatggagtggtagctagtttagacaaaccagctaccactagctatgtagttacgtccaacccggagacagtggcagtggggacaagagctcaagctagagagacgacggcagatccgggaggacgacgcctcccctgctgcgagtgacggcggcagcagcgtcctcctggggcttccacaggcggatcaagcggtgtcgtgcggcttcccgcgagcggatctggcagcgacggcggagtcgacggcgccgcgggctgatctagcggcgactgcggcttcccaccggtggatccgatggcaacagtggcatcggtggcttcccgtgagcggattcgacggtgacgaagatcaagataagatctctgtggtttttataatttttcctgttcgttttctctttggattgttggattggattttgtatatatctttgaatttgtgttttatccgtcttacgcgatgtgttactcgttcgtgtgagaacggatgccatcattcgatcggacttacagatggaaaattgatgtgacgaacggaaagtaacaaattatgtaagtaggtatatgatatgtgcaatcctttcgtacgctatacaattatatgtggtgcgagcctttctaatgtggcacacatgtatataaggcctaatttatagtctgtatttgtatttgtcacggttattcgtcgaatctctactattataaaaatggaagatatttttgccggtactttagtacgtcatccgtatttgaacatgcttttaagttacttgcttttggaaatatagatccgtgtttgggttggtttttaagttcattcgctttttgaaatacgaaagaagtcatataagaaatctcttaaaaaaactcgcatgctaacttgagactatatatagcacttctaattgaagctcatgattttgttaaaaaaaatatccaagcgaattcccacagcaaacttcaccttagctaaaccggttaataataataagattaaaatggcttcacccgtcgcaatgcacgggtatttttttagtcaacaaatatacatgaaaaggttgccgacaccgcctgcgtggcatctcggccgaaaacttcccacctgcagcacagccgcactccaccacagtgctgtctccttccaactcggaagctctaggcggagctaagcacaaacccaaggtcatcgtcgcctcccgctacctcttgtttcctccttcaaatccacttccctagccattggccccaccacgacctcgacgatgatgacctgcggcactgcgtgtctgcgtccccggctgacttgaggcagccgacgctattgctgaagggcgacgcacaagctgacgctgcatcagatcaggccgggttccggggcgcagtggcgctgtcgcattaatttggttgtggttgataattgggcttaatcagattgctcgagcagatcgccatgacgtcgcctcgatgcatccgcggactccatcacacagacatccttgcagagggcaagcgaggtgtgcgatgttgtgcaaggccggctggctggggcgcgcaatgcgaagagacaatgtaccaaaccacgcactcgatggatgaagcggcaagcggatagatacgacgatggaaaaggtatcgaatttttaagtaggtcagattagattttggaagggacgcgagagtaaaggggaaacccttcccattattttgactgccctatccatagttgtgacgattaattctgcagcaatggaagtgatgggctagaactctctgattttctcttatgtctctgtaatgcaacttctgcatgcaaatcttatattatagctacttaaaaattataacttatcgatcgtcaactattttttcttcgtcaatcacctatttttctgtccaccaatcactttttttttgttgtgtgcatctatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttaattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcctatatatatatatatatatatatatatatatatatatataggatacccatatgagactccatggtgcccgggcttcaaggtataaaacacacaaattctcttaaatttttaaaaatttacaaattgtaaatagatatctaggtatatgaatttgattcatacaaatacctaacaacaaaacaactcaaactcaactttatttcacaattcattattacatacctaacgaattatatgtttagatgttatatacctagaaccaaaatgtaacaaaaaaaaagttcaaactcagtttaaacttgtttgaacttgttagtacagaagttaatgttcatatttaaatatttaaaaaaaattcatactcattcaaattgggtatttcttggagcccatactccatgtagcacatatatatatatatatatatatatatatatatctagaaaaaaatgcccgtgcgttgcaacgagtaaaaatattttgaaattgatatacattatctagcttgcttggtttttttagttgaatactccttggttttaggctgaaagtcccattcatttcttttcaaccctcagccttgttcgctagctccatccgctcggcttgcctctttggcacggccagtgttggactcaggatgttgcggatgaaaaaatttaggtaaggacggacgaatccttacatacttttttattactagcaaaaatgcccgtgcgttgcaacgggtgaaaaaattctaatgataatatacgtttttcataaataatcatgtcaatggcaatgtttgtattttaatgagcggcttgttttttacaaacggtgtttttttcttgcgcgattttctcaaaccattcagaaatgacgcatttctttctaaaagatttttctaacatgatctttttgcttttttatttacaatgaaaaccatatttttctccattttttgcttttcttttctcgtgtgtttttttgcctttttttgccaattattttctcgcgtgtttttttgcttgttttttttcaaatgttatttttgttgctttttttaaaaacaagagaatatagacgaaataaaagccgtgtagtaggtggcaaaaaatcgatggatcctatccgactcggagcgatttttttaatagacggtgtttttttcttgcgcggttttttaaaaccatttgttaaaatggcgcgttttttctgacagttttttccttgcatgttttattttttaaaaaagttaccgatgatggaaataattttcctcgcgcgtttttttatttatttatggaagatggaaaacctttttagcgtgtttttttgcgctttttctgacttttttctcacgcgtttgtttgaaccgtttctattctctcgtgcatttttttaaaaaaatagttagattatattagagatagagaagagatatatattgattagaaatttcgccctttccatttttttcctgtgtgcattttttattttatacgaacaagcgttttattttttacgaaccttttttttcgccactttcttatggaatcggacaaacttttttagattttttttctgttttttttcgcctttataggaatccgactttttttcctgtttttaacggaatcgaatctagtattttttttttcacttttttttgccttttataggaatcagattttttttcgttcggatctacggttttttttttgccacataggggaaacggaacttttgttgttgttgtttttctttttttttttgcagctttcctttttctttttatgcacctttctgcttttgttctctcttttattattatttttaacaaaaacggcctcaagtaccttattgcaagattataggaactcaaatataaatataaaaattatagggactcaaaagcaaaagtacaaacccaaaaattaaaatcatataaaaatggaatgctctcgacctgtaggttctgttttattaaacagatctctaatccggcacatcattttgtttcaccaagatatgtgagatatcacggtatagattaagaatcggatctatagtcggactttttttctgtttctgagagggaatcggataggagtcggaccttttttttttagcttttttttacagacgaaggaaacatcttttattattttttaagtagtagagacagagatagagatagagatttttttcgcttttttgacatggaatcggattattttttcgccctttttttgggatcggacatttacggttttttttctcgctcgtccgtttttttggggcagtttttttgtcgccctttttcacagaatcggactttttttttcccttttttattggacagttacggtttttttcatttggtttttttcgccggttttttgtcgccctttttttcacggaatcgaattatttttttcgccggacagttacggtttttttttgcccggtttttttcctcgctcgcccggtttttttgacggacgatggaagcatatctttttaagtagtagagaagagatagagatatatggttttgatctcctgatgtgtgctgaataggacttggtacgatttaaaccaactcctgttcggttgatttacagccaatttggagtgttgattttttttttctatagtcagattttttttatgttatgctgaaccttttttagatggaaacttgttttttttgtcatggtggggtatcgaatcgattttcaaaggcggttaatttttttccgtgttgaatagaaataggacttttttttttgctgcgcctcttttttttttgcatttttctgccctttttttaaattttatggtacgataggaataggaatcagatgattttttggggcgcttcttttttttttttttgccttttttacgttttttttgccgcgtcggaatcggtctttttttgccgcttttttttttctcgccgccctttttttcacccttcctattttttttcgcgctggcctttttttttttacagtcggactttttttacacggacgaaggaaacactttgtatttttaatagtatatatatatatatttttgcccttttttattggacagttacggtttttttcatccggtttttttcgacggttttttgtcgccatttttttcacagaatcgaattatttttttcgccggacagttacggtttttttggcccggtttttttcctcgctcgccctgttttggtttttttcctcgctcgcccggttttttttcgccggtttttttgacggacgatggaagcacctcttattttttaagtagtagtagattaggtacatattaacaccataaaaagtgatcgtgggtcctttgcatgtgcagcaaccttttgtttctttcatggaaagaaagggcattaattttgtatacttgaatatgtattacatcctatatatcggtaagcatatatttatatatatttttgtgtatataatatgattatctttacttttcaaattaaaaaatggttcattataagatttcagaatcaataatttcgaattaaaaaatggttcattataagatttcagaatcaatctgttgaagaaagaggtgcaatagttttgatttttcagcaatgggatgtgcatggtaatatgatttgacacgaaggaaggaaagtagacttattctaggatgggcccatagacatagtgccagcaataataggtgaaaaaatgcgggagatttgacacgagggagggaaagtagacttattctaggaggggcccattagcccataggcatagtgctagcaataataggtgaaaaaatgcgggagaggaaggtgggaatcgaaccctggtcgccgggatgaaaactttcgatgttaaccatgtaagcagattactatatgtgctacgagattacatggaacttacatatagtatataaaccttggttttggagtagattgaaaattgtccgatccgtctattaatcagattaaaacggatttagctacacgtgtgggacggacgaaaaaaacgcccggaatccttacatattttttaattatatattaggtgtatatatatatatatatatatatatatatatatatatatatatatatatataaggaggagttgccccctccaatcctactggtgaaatcactcggatcatccctaccgtccatccacatctatctactaatctggaccgtccatcttcttctatcataatccgtttcgtcgtcctcctgatgagcggtggtcctcgcgcggctcttcctatcctactgccaactcccgcgatgaccgcgcgctgaccacgcctcgctcctctcgcgccgctcctcctcgctgattccaacagcgacggcgattccactgattccaccaattctgccgctgttggatctccactgattccatcgattccaccaatttcgccccgaagcggtgactccgccgtgcgcatcctctctcgctcgctcctcactcgaccagtgccgacccactggtgcaccgccacaacgccggatcagcgccgagccaccaccgcacaactgcatccccttccgccggtgccacgcccgggactgcccccgacgacgacggacgcacgctcccattgctcctccgcaaatagctcctgagcttcacgcgaagcccgtgctggcccggccccacgaaagcctctcctccgcgaatccctccccatggaagccctaagctcctctctcttcctcagggagcgtcgccgatccgtgggtcgctgctcaccctcccgtcatcggctgccacccggcgtctatcgccgtcgctgttggatgcaggtcgttgtccggcgttgactgctctcgctattggatcaaggttgtcgcccatcgtcaggcatcatccactgccaccgccgctcgccggctcgccgcccgatcgagcaggccagcacccatctccagtgcccaccaggtgagttcccacccttgcactgcagccaccctagccaccatgtccaattacgatgaaacattctcttttttccctctttcatgttctttgtaggtgaaccaggtatagaggatgtggtggaggcgtgggggctaatcactatcagtcagattttcgtggatcgagcttattacctgagttttctcctcttcgctgatggaaccggttcaggtgcgctgcaaaggtaatagttcaagcacccccagaaatcaagtagtttaaatacttatgtgttgaataaactagcataaacgacataacggtgattcagtagtttttgttgtaatagttgctatcgttgttttcttgcagatgaatgtgctcttatcctgatacggcatatagtgaatcattgtggaatgactgaaatctgttttactgtggaatgagcaaaaaatgtttacttgcgttgatgtcgagaaggttatataagtcgggagctgtttggaaagggttttatcggagcaacattattgggaaagtattttgcggagcagtttggaaagggttttatcagagcaattctggaaattgtacttttattggatcaataatgattggaaaggattttatcggagaaatcttgattaggaaggtatatgtacgtgtggtcagaaatttatccctttgcaattcaatagatgcattctctattttgctaacaggaattaatttgcatttctttggtaagaaaacagacgatgtgcattgaaagaattattgttctttgagatcttgataatatgtttcttgtccaggcattcccatgagttgcaaatccaaggaagttaataacacgacctgtctacagtattacaagctaatcgatttatcccattacaagctaaagcccactggtatgtttttgtttctctgccattcaccattgaaatatggaatgccatattcttttttccttcgatgcactcttaattgtctgttccaatttcttcgaccacttataatttgcagtttgatattgctttatcccgctgctttgccattagaaccaacaaaaggagaaatgcctttagctgaagtcctcagattcaataccaaagttgattgtttgattctaaacataattatcatggtttcttgtggtcctttaatggtgatattaagatttgggcaaaattggtacaaaagcaacatgtctaaaataccttggtagcttccccatttctattatctctccaatttactcttaaattgtatgatacaacattatcaaatttcatagtagttattttggactcacctcttcaaagtacctgtcatctgggttgggaggtaatttctaaatctcagctctactatgtgatgatctgacattcatattttactatatacttcttgtgactagaattcctgctgcatattacgtactagctaggtatttcctcttacaataatggttgtcagaattagcagcatgaaactgatcagctcaactccatgcttgaacaatttgtgagtttttctttactccagaacacctgatcagttgacatctatgatatatttaacagattatgttgattgcgcataaagaagtagcccaacatatttctgctatgcacatgaacatattggtacatatttacaattctttatttttacgaggcactatgctactgatagtctattgatgggctatagctgaatttagtttaaaaacaactactggtttttttttcacctacgttgccattcctccgttcctgcatgtccactttgttgcaaatctagaattgtggagaaactcttgatgttcatcatatgccagttcatacttttctaaattgccaaattgaaaagagggttacatatttattcagtcctatctgcaggttggaaattgtatgcagctagctagatcactttcttatcacaactcacaagattgccactttattagctatagtttgaatctaggatggtctgccataaggagctttaattacttctatgaattttgttaaatcaaaattgatccatttgtggcttttattgtttgagattgaaaaaaaaatcaggttgctgctcaagagcaaaaggcaataacatggggcagtgataaaactatttttgggcacagttagtctgtgactatgtcttcatgggcataaatgaaagagaaactcattgttaaaaaactgaaatggaaacaacttttccatggtgatccgattgaccatcgctcggatcttggatatcaatactgtaattcataaagtacagaatacatgattcagatggagaaaggcaatacatgaggaagatgttttgaacaatatattatcttaggttaaactaatgttttttttcacatctggtgttttgtacccttactaataataaatttgatactataaattctatctcattatatgcttggcaaaacatatatcttattttggttgtttgatttgtattactaaataatttctgtagcgttatcacggacagattactagttttatataaaggccggaggtaactcgtgtatcatcttgatataattaactgagtctaaagctttcattatctaaaaaaatcacctatttttcattcgtacgagctgtttttacacatccggttccgaactttccgatcggagaagttaatgggtcaagagagaggaagagagggaggctgggccaagatcggtgggccgtatttaggccgggccattttagctgggcagcctgggctggcgcgggtcaacgtggacccacgcatccgaggtggcaaggggcgggtcctttgggccgacgtggcaccaccacatgggtgtggaccgggtcttttgatggtgacagcggcttctggagggaactccggctcggacgtctgatgtttggaaaaaaattggacactgacgtcagcatgacgtcaatgtccgatttacgtgcaaaaactactttaaactgattttcctcttaaattacttatccaaatcatgattcgattgcaccattaaattcgttgcaattaaatcttcaaaaaaaagaccgcacatggatatattccgacgaaattttttttagcttattattgaattatttttaaatgttgcacgatgttccactaggtatatcgtaattgtttcactaaatagatcgaaaatgtttcactcgtttaaatcgggtgttgtttcaccctatataaaaataatgtttcagcaaatagcgaaagaatgtttcagttcactgcaacatttgatccatatatagtgaaacattataagtacactaggtgaagcatttttcggtggaaaaaaatgaaacgtattcccttgtagggggtttccaaaatatgtgggtttttttattgcaatggaatatttcagttcactacaacattagatctgtacacagtgaaagattatgagtacactagataaaacattttttgtaaaataaaaaataaaccaaattcccttaataggggtttccaaaatatgtaggtgatttgttacaacggcgtgttccataatatcaaaatccactgcaacatttgatcatcatatgcaacattaaaaaaatatcaatagagaagctaaaatatttttttgtcgaaatataattatgtgtggtcttgttgtaaagatttaattgcaatgaatataacggtgtgattggatcgtagattggataattagtttaagagagaaatcgttttaaaactagagctgcaggaggcgcgggagccgaggcgtccgattttttctttgacgtccgaggcgccggagccgaggcgtccgattttttctctgacgtcggacgtcaggcgcgcagcattttccgtggcttccgggaacagccgcgacatcgacatgggatgagcagaaacgttaccggcgtttggattgcatgcaaagccaaaacagagctaagagattctatcttatacccaagaaaataagttccaaaaaataaaaggaatagaagaaaagacatattatagtcagaaatatgttggtgttaggggctgtttggatgcttgcttcagtttatcaaagttctatagctaaagtgttggtaaagatatgtgtctataataagtgggatcataaaatcaaaaagtgtgacatgataaaaatgtggcaaccaagcaaacacactaagatggtcaaaatagcttaccaaagttatgggaaagtatagtcaccatccaaacaacctctaacagtaaacattctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccacctttaatctctggattatatatctaccaatcaattatacattatacctattggactgactaattttttacgtgaggaagttgcagtaggcgagtagctattagaagtaattgcttcgtttttaacgtataaagttgttcgacattttacatggtattttactatttgttgtattcagaaaaattatataaatagctttttttaagtatgacatatattgtatcatatttacaatatttttgtaataaaaaatatgttcaaacgttatttaaaagtttatggaattatctatgtaagaacgttaatactacagtaccatacatcatcgagaaatgtatattatacttactagttactaggccaccttattattcgattctccggtggatgagcatggatcactcggtggctctagtagacaaagttacctaaaatgaaatttcaaattctaagtttacttggttaaatcagtcagccagtggataccggcaagtgacgtaatgacgtgcgtgtgctcgtcgcaagaaataactaagcttacgaacttaatatatatactgattttgaacgcttgactaagaactagtcaagtaataagcgaagtggttatttcaagatagtggaaatatctggtttagttcaatgaatggcaaaaaaaaaaaaaacgaccacgcaacgaactctctccattccagaattaccttttctccatatacatcatcagaaaattattactatattttaggatttctctatatacataatcagaaattaaaattattatatattagtacggaggcagtagctcggtatatacagatatggtcggaaaatacatgtacaaatctaataggatgagaaaaagagagattgaaattaagacgaaaaagaaagaaacgtcagattgaacaatattagcccactgtactaactgaagatcgatcagacgcagttctgaaacacaaacccaaccgccgacgccgacgccggctgatcgttcacgaacggcggcatcgccgggtgccaccaccacgccggtaacctcgtcttctccacggcgacgcaccgcccgccgccggcgaccacctccgtcagatggcgcgcagtacggccgccggacacctgatcggacgccgccggcgccgcagggacggcatggagcggcgtgagcagcgggattacctcggcggcggcggcgacggcgtcgtggcagtactccgacgcggcgctcccgtcgccggcgccgccggctcgcacgtcgatggatcccggcgcgagggcgcgcagccgcaggctcccttgccttctgatcggctgcctcgccgccgccggcttgacgacatcctccgctgcatcaacgacgccggcgacgtcctccatcaagaatcacggtcaattcaaagaaaccaatcacacactcgcacactgatgactgatcttgctggttaattgcaacagcttctactgaatatgcaatacatatataggtagatgattaattatgcagataaagcagccacgcagacgcagcagtgtgttggtcgttgggtaggtacgtgtcgacagtcgacacaaatggtctcacaggatgcttgcagttgctgcaggtggtgtccagacttatccagtagctttgactttgttgaccagcagagagaaaacaagcggcgtggcagcaaccagtgagcagtaaccagtgggctcgatcaggctacggtattaactagattccacacctacaattatatggtgtttatatcttagaggtaaaattttagcttgttacattgctatgatatggtataaaattttagtgtgagatctaaacatgcccttatatgtagtaaagtgttaagttacagctatatgcaatacaagaaattttcagttacagcagaattttttttccttccctgtttctgcacaacttttagttcaatctccgcacaaattttgggtcagcttcaacagaaatttagttcagttacagcagaattttttttccctctctcagctcaaattttggttcagattcagaagaaattcagttcagtatcagaagaaaaatttggggggaaggtttattttctgtatgtaatggcatgatatattcagaacatgttaacaaaaaggtcttcttttcttcactgcaaagttacgtatttatacgcatggatagataatactccgtccgtttcaaaatgtttgattcattgttaattatttattctttttatatcatttgattcattgttaaatatactttcatgtacccatatagttttacgtatttcacaatttttttattaagacaaacggtcaaacatgtgctaaaaagtcaacggtgtcaaacattttgaaacggagggagtagtctttaatatatactccctctgtcccataatataagggattttgagtttttgattgtaacg

SEQ ID NO: 27618 - DNA, 35800 bp, Oryza sativa
gccattgcctcgtctcctctctcccgccgcatcgaagcaaggctccaccgccggcgtcgccctgaagagagatgagaaagagaaggggggcatatgtcatgtgtttgcctttttcttgactagaataccacatcagctaaaacaacccttaatattatcatggaccatgatttagacggtttggttaagattagatgaactcttgtattacgatttaggctgtgttcaggacccctccttcctagcacgcaaaacgaaactcgtattattgcatgattagttaagtattaactattttttttaaaaaaaatcgattgatatgatttttttaaaacaattttcatatacaaatattttatataaattacactatttagcagtttaaaaaacgtgcacgcggaaaacaagaaaggtgggttgggaggggagggggagaacacagcctgtgtaaatgaaagtggacgtaaagatgaagacgtgactcccgctcgagcgtcccatgggaggaggttaaaatcggacactgacgtccgatttacgtgtaaaactattttaaactgatttatctcttaaattacttcaaatcatgattcgattgcactattaaattcgttgcaattaaatcttcaaaataagaccacacatggatatattccgacgaaaaaaattagcttattattgaattatttttaaatgttgcacgatgtttcaccaagcatatcggaattatttcactaagtagatcgaaaatgtttcactcgtttaaatcgggtgttgtttcaccttatataaaaacaatgtttcagcaaatagcaaaagaatgtttcagttcactgcaatattggatctatacatagtgaaacattgtgagtacactaggtgaaacatttttaggtgaaacaaaaaataaaccaaattcccttactagggggttccaaaatatgttggttttttttgttgcaatggaatatttcattcactgcaacattagatctatacatagtgaaacattgtgagtacactaggtgaaacatttttggtggagcaaaaactaaacgaaattctcttaatagagagtttccaaaatatgtgggtttttttgttgcaaaagaatattttaattcactgcaacattatatctatttaaaatagtaaaacattataagtacactagctgaaacatttttgtgaaaaaagaggagagataagttggtgggcccaacaggtgcgcgcatgtggggagggaagcgactgattttcccacctcctccggtcgaccgatgttgggcattctcctaaagatgagggatgagaagtgaacttgggccctagcccatagagccattcggctctaacataaatagatgggccaagcctccatttcctcctcttcttcttcccccgcgaccgccaccgttgcagccttctcccctctccgccctccttccgccgcaagccacacgaatcaaggtatgcgcgcttctcttcccctcgccctcctcctcctcctccggtcgccgccgccgccgcttcttcctccgcgacgcgtgcgtgctggtcgaggcgggcgagcggattcgagaacaccgatccggatcacttggattggttcgatgtttcgttcgatttgttgattgatcaggagtgaactgcctgcttgcttgggtttgcgctcctcgactgctgcttgatgtggggaatcgaattgagcccgaattgctagtgctaatcctttagtagtttagttgttctctccggctcagttaattttgtcgccgatttattcgatcgctgcgtgttgattggagtgccttagttactgatccaaagcttgtttccaacagaaatttgctggccgcgcttcctccgagcttttgttccctaatttgcttcattttttgcggatttgttcaattgctgcgtgttgaagtaaccagttattcagttactaatccatgtttatttccaacgaatagttgttgctagagttcacaaactcgcttctctgttatgctagctgttgatatgaaggtccttagatggtacatttcaccttggaagatttgattgccgaaaattgatctggttacaacatgtggattgtttgattgaacatgtcaaaccatttttgcttatgaggaacagtttttgcttgctgattttgataaatcgagcataaactgtgtatatcttcctctcgttgttagctacttgctgtggagcagtaatgatcttcctctgaacaacttttgggttggtttcagtatttcgtgtcctgcttaatttccttgtatttctgtttgttaattagtaatggccaattaggccagaatcgactagcaactgtgtgtacttctttgttgtgatatctccatgcaagagtcgtaaaaaaaccatctgcacagagcaagctatttatgcatacatagtgtttgcaactgtaatctgtacatacaaattaaactggaaatgcttagaagtatatcatcttcctaatatgatgattggaaatgcttgcacaggctaatctctgctcgaagcatgtcaaacgatcagcatcggtcatgccgttgcgtcaagtcgaactgtgtcaagctgtatgcacacatacttcgatggatctgaaatacattccattaattagtttattgtgaagttttgttcttactgtgtaacgtctattttctgtactgtgttatatgcagctattgcccgtgtttcagcgcgtacggctattgttcacagaactgccgttgcactaactgtaagaacagagagtactatgaggactttgtggaggagcgtgtggacatgatcaagatgaaaaatccgagagcatttgatcccaagattgttagggttcaagatgcaagtgagattgaaccccagagctctaatgcagtgccggtaatgcattcttctttcttggagcacccccaaataattaatcttatgctgttttgatttcaaattttcaataatggtttgtagtgagaactcatgcacataaagtaaatttcaggaaaatgagcatggatgtatgctaatgggtgcagatgccagaagtccaagtgcctcgtacattcgtgtgaatgcctcaaggtgtgcataccatacatatttgttttgacttacaacctatatttactactagaagtaatcatgcgcgtgctaagcatgtgtttgccaatatgataaaacaacatattgcaagcacaataatttgtgttttttttaattgcattcatcacagcagtcaattaacattgaaaggggaacattccagcagtgttcataatacataataaataatcaaatctctttctatgcaattggaggtgatttgacatttgttttattctaggagttttatttagtttcaattaatttatattaaatttggatgtccacatgatcgcgttaactagaataatacttaaactgataatgtagaattttttatgcatagataaatagagatatgattaattattccaaacaacttatgttgagaagttgagatgtttcatgtgactagcgttttgtgcatcctactattaatgatctgatcttgtcctgaatctgatatgtgtgattgcaaacaacattgaaatgactaagttatgagccctactcttgagaaaatgaaatcaagtagtatcttgtgtctgtttaagccagagagtagaggaatatttgggtgtgcctctgcacatcagattgaaaaagatttttaagttcgcaaatgcagttgagggtgcgatacaaataaaaatacccaagtattattacttggaatgattagatgatgatatggctgttttgtctcttacagcacgaggtgaggtgcacttcaaaatgccagtgtatagattgcggtaacggccccagaacaaagtgtgagtatactagactgttatttctgtttccttgtcttatgacatccaagtgtgtaatcaattgctttggaatagcttggaagcatcgtattttgattttgttcttcacccatgtcattttctttgtcttgaatatatttatctgacttactttatacaaaacagatgattcaaacatcggaaaagatcagagtgatgttagtggcctaacctatgaagagcccacgatggacaccatgcaatctgagcacactctgaatccaaacaaacgcccaaaatattttgcaagtttttggctccttcacacttcgttaacataatttaccagtgtagaatgtaaatgtaatttcaaagtgttggaaattttcaaaggaaacactgatgatctgctcttttatgcagtgatatctctcgcagatcgtgatgctttaccatcctcaagacaatagccactttcttccaaaaatgcaactgtaaatacaaacaggtttgagtatcccttgtaacgaaatcttaaagcacggtgatcggtgaggccttgaactccatgatacttcaaatcttgtcgtccatttggtagtctcagtgggttcagttgaccttgcgcttgatcaagaactacgaagacagttcccacctatagctaatatcatccatactgttaccaaagggccggggtgtatacatttcatcccaatatggaattagttgttttggcatgcaaatgttcctgcttcttaatctctcatgttcttggggatattttgatcatgcctgaatctgtgaatccttcagtgatgagagcacaagtattatgaggtatgatgatgattgcaagtataagtagcctcgattgtattattgacgcagagcatcgactgatctctcatattcctgtaggattcaacctcatccactgcaagaacacacataatttagaacagaaacggcacatgaatcagtaggagtaatagttagtgactactagtaagtatactgttcctgaagggatggttacatggattaatagcttaatctgatacctcttccatgacattgtaagatatgcagggaggcagctcttcttgcagccaatgtgtgagctctccatcttgctcctcaggatcctagaacaaacattagtcaaggaaaaagtagtctcaacaagtgttttggcagaataataatcctgcattggatatcgaagtgtttacaaaattttgaacgaatttacactagagaagagttaaggaggcttatttgtaacttatcggagggagggcagcatcaactaacacaaaccgaccagccagtgatatcccttttttctgttttagtaaaaggattaattgttttgacacgaacacgtgagatatcaattcaccaatttgtgatgatgcggaactaagggcctgtttgaaatagcatattaacagtatgcaaaacgacgcttcttattagcatataattaattaagtgttaactactatagtttaaattacataaaatgtactgtttagcagtttaaaaaatatgctaacttaaaaagatgaagttgtaatttggagtccaagtttagaattcagcttataatttgtttatttgtggaggtaccccactaggctacgttttgcagataaggatcgggagaaaaaaaatatctcgttctctgtgcgcacgtttctcaaacagctaaacgatataattttttttctaaaaaaatctataagaaagttgttttaaaaactcatatgaatcctttctcaaattgaaaataatcaatactcaattattagttacctcattttgcatatctatctttgtttacctttcctctcaaacaataacaagataatccttctgtgccttccaagcgggccgggccgggtaaaaagattatttgggccgcagcccactctgccattcggccctaaagtacatgggccacgcacgcctccatgtcctcctcttcctcgtgagcgcgagcgccgattgccttctccggccgcctcttcgtctccgccgcatgccgccgccgcctcggctccctcaaggtacgcgcgcttcgctccccctcgccctcctcatcctccccctcctgcgctcgactgctgtttgatgtggggaatcgaatcgagcccaaattgtttagtattttggtgctgatttgttcgatcgctgcgtgttggagtgcctagttagttacggattcaagtttgtttcgagcaaaaattttgttcgttagggttccttcccgcgagctttgcttccctacttctccccaatcctcgttgttacggattttgttcagtcgctgcgtgtttatttccaccgaagaaagttgccgctagtgttgttcctgggcttgattccctgttatatgctactacgaagtagttggcacgcgggtcctcgggttgtgcattttacctaggacgatttcattatcgagaattgatctggtacaaagtttgggggtgtttgattgcacatcgcaaatcattttggatagggcaatcgatgcaagggcgccaacaggacagctagaacttgtgagaaacagtttttgcttttgataaaagtggtagaacagacactgcagtagtaatcttcctcttaaaaacttttgggttggtttcagtattttgggatctgcttaatttccttgtatttctgtttattaatcctatgctattttaatttcaataatggtttgtagtggcttgagaactaatgcacattgaggaaatttccgggagatgagcaatggatgtatgccaaagggtgcacaggtgcaggaagtccaagcgcctggaacttgtgtgtcagtgtgtgaatgcctcaaggtgtgcatactgcatatctattgacatacaacctataattactattattagtaatcattgcatgtacaaagcatgtcatggtcaatatgatcaaacaatatattgtaagcacaagaattaatgtttcttagaattgctttgttagtaatcatgcatgtgcaaagcatgccatggtcaataatatcaaaaaatatattgcatggacaagaattcacgtttctttgaattgcattattagagcatctccaacaatctctctaaatcccactctccaaatatctattttgccaactctatctaatttagctagtcaaacagtcttttactccaacagccttcccattcatcctctctattctgagtctatgacagtagggcccacatgtcagtctctaccactttcttcttcctccccttctctccaaatccccttccctctcccctctgttaccgccgccccatccctattcgcccatcgccaatgctcgggctccgtctgccggtgcccttctagccgagctctcaccggccgcctcgtctccctcaacctcgccgtcgagcaacgccgccaccgccactccctcccatctccaacccacccggcggatgaggcggcggcaggtctccggcgtgcgcggtaacgacgctctagcgcgagtcgacggccggcggggcggcggccgcgggccttcctgctcccttgtgcggcgagacaggtagcggccgtgggtttccggcacgacgaagacaggcggcggtcgcgggggtcctgacgcggcgaaggcaggcggcggccgcagggttccgacatggtgaaggtaggtggcggcggcggggctcccggcgcagcgagtcaagcggcagctaggcttccggcgcggcaaggtaagcagtggcccgggccttctggcgccttgccagccttcctcgttcctccctcgccgtcgagccgccccgtcgccctcgtcatgccgccgatggccgacgccgaagaaggactcatgcgtcgtcaagccgccccgtcgacgacagcaacggcaacctcggggacgacggcagtggatggcgatgactggcgacagcggctggcgacctcgacgatgatggtggcgcttcggcgtgggttcaagatgcacggcgcctgcgtcggtggcagcgtcgaggtcgtggctgcctgcgccattgtagagaagagccgaaggagatggggggggggggggggaatctgtgtgggtctcatggttggccagtgatttttgggctggccaaatttggctagtggaggggggttttgggcagccgcggatggctgcttagccatccggttggagaggctgttggagcttttttttttttttttttttactagaatggctaaaatttggcttggagagtgggatggagagactgttggagatgctcttacagcagtcaaataacattgaaggtacaacgtactctctgaatatttcagttgctttcattgtataaacaataattaactaaatctcttcgtacgcaatgggagaacattatcacactgatgttcctgctgcaaaacaaagagacataacattttagtcttctagtaaaccagaaggaccagaaacggaaaaaaaaagaattcagtttattagtttagaaattcgaactctgatagaatgatattttctaattcatgaaatccaaaaaaatgtacttgacatacaagtcaagattcttgatttttgaaggggtgatacctgttctggaacgaagggggaaaaagggattcattatggcaacagcccacataacttatttctagattctgttatttttcattcctcttcattaggtatatatgatgatatggctgtttttttgtcttacaacacaaggtgagatgcactgcaaaatgccggtgtatagaatgcagaaacggccctggaataaagagtgagtactgtaagctgttatttttgtttcctcgtctcatcacatcataagtgtgtagtgtgtactcaattgattttggagtaacttgggaaggaccccattttgttcttcacccatgtcatttgttttatcttgcctatatttatctgacctgacaaaacaggtgattcaaacactgaaacagatcattgtgatgctagtggcctaacctatgaagaatctatcgtggaaaacaccacacaatatgaggggacttcgaatcgaaacaaacgcccaagaaattttgtaagttctctactcttttacacttcacttacatagtttgccagtagaaactgtaaatgtaatcaataactgcattgcgttaaaaaaattataacatgttcaaacaaaacactgatggtctgctcttctgtgcagtgataacaaccttcagatcgtgttaccttaccatcctcaacctcaagacaatagccactttctgccaaaaatgcaactgtaaacacaatcatcccttgcaaaatctcaaagcacggtaaggccttcatactccatgacccttcaaacctttgcgaaatctcaaagcatggtaagaccttcatactccatggcccttcaaaccttgtcacccactcgatagtctcagtgggttcagttgacgttgcacctgatcaaaaactatggggacagttgtcaccttcggttagtatcaaccatacttttgccgaagaggtatataaacatttcactcatatatgaaatgcttttttttgtcatgcaaaggttatattcttgggtatccagaatctttgaattcttcagtgatgagagagcacaagtagtatgaagtataaacatgattgcaagtacaagtagcctcaacagcattatttttagggaaagtatcaaacaagtactaggtcacatatgcccacttcttacaagtagcagagcacaatactagaagtacactagcacaacgacagcaaaagccaccattaaggtgagcatgttgtattacaagctaccaagccaacattcacctctacatagtaaaacactcttccatgtactgttgcgacttccattagcgtgatctgtcgaggccaagccttgagctgagccatttgccgacatcgtccatctcttcagggatggtatagtggcctagcctgcatcatcatataacttgttaatactgctataattttgggagagtaaaaaaggtgttttgtaatgtgttatgtatgcatatgcatttgtacccattgtaggatttgaaattcagatacaagaaccccgagttacgcagagtgtcgactgatctctcagcattcctgtaggatacaacctcatccactgcaagaacatacagaatttagaacagactgatgcattgactaggagtaataattaactagtaaattatactgtttctggagggaaggcttttcatggatcaacagcttaatgtgttacctcttccatgacttagtaagataggcaaggaggaagctcttcttgcagccatgtgtgagctctccgtcttgctcctcagggtcctagaacaaacattggagtcatgaaaaagtagagacaacgtgtttggattaatatttctgcattattggatatcaaagtggcacctggagcaagggagccagccactcaagctgatgaccgcactgagtgtgattggatatggcatgctattcgcgaatttgccgtgagcgtagcacgctgcggagtggagggcagcagctgcacccatgctgaaaccgccgatcccaagcttcactgcactcgcaaaatatgaaaatcaatggaaggaatgatcaccagggggattctgtagagtcactgaagaacattatcttacttggtgctaattcggtacaaataaggatcactttaaaaagaaaaggaagaaaaaccaattaataggatggtaatatatcttggtagctgcacttaggagtaacatgggtgattagattgaagtggtactggaactagtaccgtcaggtggctctgacgacaacaggtttgcaatatgtgcagctgaagcatccagtccttcaatgtcatcacggccatccactgaaatgtcctccacatcaaaccctatttcagttccatagaaacgttaaccaatcagatttcagacttaagagtaatggtaatgcctcctaagtttgcagattttagagagatggtagcatagtgatgatgaagaagaagctcacacgcagtgcaagggaatccgccgaatgccgtgacaggccgggttgctgcagttgggcaaatccacttgatctacatgacataagctttaaggtgaataaactattttgcagtaagaatcgtttctagttgctgctgaacatgataagctacagtgatctggagacagttacaggcttacagctgttgaaagagaccgttgtgtatcactagtggaataaggaaaatgtatatgtcatgtctatctacatctatcatctgtgtatgcgtgtctgaagtacaaagtatcgatgcttacatttggcaatgaaagagaatccaggagctgggaccagctgaaaagttcagaatgaacaaaacagagaaaagggaaacatatcagtgcactatatcaggaaaagcattgcagctgcaagcaactagtaaagatattctgttccagattctctgaaatttatggattaacacatcatatatatgtataaacagaaaacgtcggctaaaagtatccaagagaaaagagaataggggagagtggagataggaacatctggaactgcaaattggaatatatataagatcaaacagaagaggaaacagaacagtagtgaacaacttttttttttcaacaagttgagcaagttgcctgaatttcatagcttatctgaagggaataaacgattagcttcctttcaaagaagataataataatgtgtaagtagaccagttgttgatcttttcagttactggagataaaggggactaagtggaaaaagaatgagcaatgggtatctgcagctgaggactgagggctgaggttaacttggtaaatgcatggtaccaaacgaaaacgacactcagctagttacttttcattttgtttgcacccggagccagtacttaccattaaaaaaactctactccctccaccccaaaatataagaatctaggactagatgagacattttctagtattacgaatccggacaggctacctgtccggattcgtagtactaggagatgtcccatccgatcttaggttcttatattttgggatggagggagtaatttttaatcgagtgatacttcaatttagtgatttatcataaatatggtgttctttacatgctttgtgcagaccttgggacaggaaattaggcatctttcatgagcgacctacttttatgcaatattcatataccattagcccacatcaattagaagtacttgacattcctctccacttctggatggaaagtgagagcattatctatgtccttggtggcgcagaaggatattaggtgtgttgtgtgaagaaggacaaggaaaacatttactttgggtaaagcaatactaggaatatatgcatgcttggacacacaaaaaggagggcacttcaatcatttctagcagaaagaaacaagggaataaagtgtttgtatccacaattaccatgatctagctctcctcctagcttgctttccaagtatagtttatttgttattcttttgcatttgcagaagatagcattgctcttttttttttcaggaacgcgcaaaaggtagaaggtaccatgcttgaaggagcatgagtaaacaagcaaagtttggaacgaagaggcagtggctgtatatcaagctagccactatataataccttgcaccattgtcacctagaccatggagccacacaatggtggcttggtgccttccctttggcctcactatataggtcctcccatactcgactctccgactgccccatccacctgaatcaaaaatcacatcatgctcagcattgttctttggcacctgtggttatcatgaggacttgaggttagaatggagtagtcagattaccagaagagctgcttccataatagctcatgatgttttctgcaccaagtgctctgtttactgatgctgctaaggtatagaactagttgtgtatgcactgaatttatcgaagagtatgaagtgcacaaccccagttggtctgtatttatagtgaagctctgaagagggaatatatgtcggacaatcccttgaatctgcatcgcaggacagtgcggcttttcgcactgtgctcgctgcaagctgtcatgggatgagcatcttgagtctggaatgctcaagggatgggcaggataaaaaggatttgaggcatttttctctggagctaagaatcctatgcaatgctgacaaaccttgcacacagagatacacacatggtgacagatgcctaaagttcccatgcaagcaaactaaggcgatcgatttatattgcacacagatttatcatgatgcatctttggcagtggagagggaaccataatatataaatgttgtttcctgtcttttttaatctcattttgtgtccaccaagcatttctatgcttattgcatggagtactaatgcccactgccttctgcccacaaattggtgcaactccgtatgggacaaccttagataaaatgcaaggaataatcataaacaaacttattgtccggccattgagcttttcttttgacatctagtttccagttactgctagatggaactgataagttattgctagaggtatcgtgcataaatccgtggactttcagaaagacagaaaacttattccaatggaggaaattcgacgcggaagaaaaagcagaaagaattgttttttgggaatacatagaagaattgtgcatcgttgcactaagattaggagaaagcaaagcaggaagaattatataccacaacttgtgtcggtataccatcacaattacatcgatagaaatatctatcaggtgtcgacaccaaatcaacatggatatgggaaccaaatcaggtagaaatgaaagtccacttgcaggttgcagcatgaacgtggtgcactcttcatgaaggtacagatactaacttgcaacaaatgttcttaccgtgttgctgctacagttaaatcaactgctaaatgcaaacccttgaattagtctaggcgcttattaggaacaccatctgattctttttcttttgtaaaaaaggaaatactccccacatcaataagaagagtacagtggtgaaatacaaatcagaaatgttcctgattttgtgtaaaaagaaattgtctcagccatgatacaatatttcctagtgaaattggtcctgtttacatgtttagctatgtgaatgaatgctactaaaccagtatggaaactataatcttttttttcctcatttgaggtgagtgtgcttttctctaggtttacttgccaataaaggcgggtacctttgccagtatgcttgatgcttttgtaatatggagcacagttgataccttctcaacaatacaaaataaagatgggggtagagaaaatcaaaagtcaactaaaactgacctctaatgaaaaacgtttgcatctcttttttatttaagaaaaaggtttgcctctggggttctactgtgatagccccactacaaacagtaagaaccatatgccattctcctttttgttttttaatgattgggatgggtaatgtggggggcagctcaagccaaaatatgtgatgtatatgtcattcttgtctctatcttagctagcatcagaggtttgaggctgcagcaagctagatgaatctatttcatcagattgggtcattagccacctgatcttgctttctcaactgcaaattataggcctatgattgtgttgtgccctagtactaggagcctgcacattccttcctatgcttatagtccatttctttattgcacatgcttatatgaagagcaatgttttatgtaaagtcagaaaaaaatattctcaaaaaggccatgcacaaaatatgggatttgttgttactaaaaaaggcatacagttaaggaagatatgagaacaggaaaggatatattgtgctttacgtgttctccatttcattcatgcttaactgagtttacataatcggtatgctcactcctgtactactgctgttaagaggaggatacagatggcagtagccaagaattcttgtgactacagttccttgcgatcgggtttcttattgcagattcagttaggtaggatctcctgattcagcacccactaaggtcaattcactgaacaaagcaggcaaatattattcactgtaataagaagtccacatcaacgcttaacagaagtcaacttacaggatgctaagagggaatgttcctacatgaaagatcgcggctgccattaggtgaggaattaatgccttttaaagtactgggtcattctgtatgcttctaactgccttgctttgatctctgctgaaattatttggtaaaatctcatcctctcatttctatttcatactttttttgagataacattttctatctcataccactgatggttcaagtaataatatattttcttaatttttaggtgtgattttccatgtacatgttattctcccatgctcttttaaccttttagacttctgaaaagtactttggaagagagaaaaggttaaaaaaaaagcaaaactgatgttaccatcaccaactcaccatagtgtagaattaatccctttgtcaaccttaggcaatccaaaacaaaaggggatattgtttggttgttggtttgaattttgagatagagcatatataatccatgtcctatgggctagagaatcaaagacttgatattgcaaccttttcacaataactagtgaatgaagtcgcacgttcgcgcgacaataaccttcctatctattaatcgttattgtaattaacaataaaatttccaccattcagttaaatcaataattagatgttaattttctaaaattatttaattagtcatctagtctaaggaccgtttgggttgattggccaagccaagcctgtttgggaggccaacatgagattacaatgagaggcaatgagtggctcaaactcttccttctctatgtattttaccacttctagaagattcctcatttcaatggctaggatttttccttgctattttatcattttgtgaatccaacggctattatttgacggatgatgtggctaattctggttgctttttgagttttacttttcacttagatagatagatatgatcatccataggttaaaatagaaatttccttcatggattgcttactattctgtttttttatggtgctaaccacaatgctatgttctcatcaggaaaatgaaaagagaaagaggctgaacgtaatctgagttactgacttaccaagtggagaatcttccaggacgaagccgtgcaggaagcccaactcgcaattttaatccgatgcagtctggtgcactttgagttggtaaacagttaatcatcatcagggataatcttgtcttgcttgttgtttgccacttttgtcggatgtactacagtagcttcttggtttattttgttttcttgaatacatggagatctgcatattttaatactaataagaagaaaacaatgaggaaaagaaccatgtacaacacacgctaagttccaagaaccatgcgtttattttttcttctgttacacaacatttctagcttgcacttcgatatggaatcgtaagaatggaagagaaacaaagaattcagtttattattttcacttctttcttaattctatatgaatactatagattctattaatacatggattgaaagattacacctagaaatctctcaaccatttccctcataatagaaagggcagaactccagccattctttttcaaaacagaaattaccaacttaccatatagtttcatgactataatatgcaaaacatcactttcggcatcagaagcaattctgttccctggtgcgtgcgttgcacctgtaaaagaatagaatatttatgattgaagcaattgctttctatcgttgttctgtttaaaggaatgtgcatatatgatttgcagcttcagcatccaaaacaagttaatctaccatgtgatcatcttaggctctatttagatctcctggcaaaaattttcaccctgttacatcgaatgtttggacacatatatagagtattaaatataaatgaaaaaataactaattatacagattgcgtgtaaattgcgagacgaatcttttaagcctaattgctccatgatatgacaatgtggtgctacagtaaatatttgctaatgacggattaattaggcttaataaattcgtctcacagtttacagacggattctgtaatttgttttgttattagtctatgtttaatacttcaaatatgtatccgtatatccgatgtgacacgtcaaaactttacaaccctatatctaaacagagccttattgttctcacatgacttgtcttagaagcaagcttgcatgttaatttaatcacttcctgtttgaaggaaactgtgagcaggcataaaagcgaagatgggatatatggaatttatcacatcattcaatcaacatatgggtgctctagaaaacgtgattactagacgagagtttatgtattcattacttgttttttcggttgaagtttttaatttgagcttacatcatcatcccaacatatgtctaaaagacaaactatttaggttggctacataaaacaagtgtactaaaagattgtttctgatgaggacacgattagctcggatataaccatgactaccttatgtattaatcaatcaaaagtgcatataatctatattagatttacttgttatatatttgaataaacgttgctacataatgagttttgtgtgttttcgtttgcagaggtacttgtttgggcgaaagaaaagagaccgagtgtaaggaatgcatagatgattgaagaagttttacacgttttggattcggattcgggccttctgacagcatcaacttcaaatggacctagccgctgatctagaagaaatttcagggcccataagtacttattggaaagcttatggagtctactttcagatgattttggtcccacgtcaaaattcctaccaagctgccaggaatctgcaaaacaagccacgtatctcatctccagtccgaatctgatttgggttttgggccttgtaattgtgtcgtgggcttagcccaagggggtgtgcatcctagggcaaccctaggatgtccctaatcatacttaatcagtagccgtcatcgcctaggacatccctaatcatacttaatcagtagtcgtcatcgtttaaagtagggttttgcttagattaatctgtcaagaacagtttcgccgctagatcggtttgtagaagcccaaattagagtgcttaattattcatatgcaattgtgttgcaatctatcttgttcttgcttgtgttcttcgattcgcatgtagggaaccttctcggcgaggccaaccaggtttcggcacggttgataaccagaggagacgtggtgctgcgattgcagggctcagtagcgtgttcgttcagaaaccggatcgagttgtgtcgcgactccgcccaaatcgactgtttattagtacctatcggaagatcaggacataacaccctcattagtttccatagtactagaaatgtatgttttacactaatacaatttttgggtaaattttataatactacaaatactttgcctaaactatagcaaaactacatagttaagttaagttagtgtatcaaaaactacaaatatcatgaaactaaatattgatgcatctaagctatcatagaactatagattttagagtcacccctagcaagaattatttcaagattttggtaaaatttatgctaaatctgtaattttgcgatactatgcttcaaatatgtagttccatgataaatttggtgctaaatatataattttattatacattgtcttaaatctatcatttagttatagtttagttaaaatatctatagttttgtgaaattcactccattcaataaccaaatgatacttgggagaccataaaaacgaataatatcaagtacaaaagagtatccacccaaatctaagatgttggaaaacatgctcatagttgaaaaagtaaaagaatcagaccattatctctaagatgtggcctataagcttagagttactagcatgtaaaatgtcaagtgcatagcttgaaggaagaggcagctccaataggatgtccaatagtcactcttgaaaatgtggtgcctgattcatcttgcacatagacaaaaatacaatggaaataactgcatcataattttcttctctctagggccgtgttctttttagctactttgccaggttattcctatggatcatttgctccatgcctctaaaggtatttttgtaaagaaaaaaaatatttctaccgcattatatagaccacttgttctaagatatttgtcaagtttatttttttaaaatatttaatttatccatgtaatcaagtagataatccatactaataataaattaaataatctattttaagtagggccttagtacatttaacgctcataagcagagaatataaagcaaacttagattttactagggataataaaaaataaaatacaaaataaactgtacatttataagcaagaaaatgtatattttctgttcttaaactattgacctgagttaattagttttcatttctcacctacaaaacaaagtaaaccccatccataaattctcaaatcatgtaaaactcgtactttatgaatttgatcattgttttgatccatatatatatggtgatgctaaacctgtcatacgaatggtacagccatatgaatatatgaatatatgataattatcatatgaatatatgataatttgtgtaatatataatggagaatgattgtccatagatgagaaagcttgttctctacgacaagcaggttatacgccctatgtagttcaaaatatcaatcaaattggtcgatttatttggttggaaaatgatacaagtacaaacaaattcttacaaaattttttaaaaaactgatgtggtacactatgattgcatcttgacttgaataaatcaaatggctaagatctttgtttggtaaaagttttataagaattttttagtacgtgcagtattaatctatctcattgtactatagttgatggatgggttttaccaggttgtaattgaaggacaatactaccgactagggtgcgttttaaagcttgtttatcatgtttatcgtttaaagcttgtttttcgaaaaaaaaagaaaaaaaaactaactagccaggaccagcgatagatgggcctccctctaaatgggcccagaaagcccactaatcccatcgcattcgccatttcgcctccactgtggcggaaatatctcctccgcttaaacccccacatcgccctagccgccgccttccccttcctacctcgccgccgccgccaccgccgccgccatggccgccgccgccgccgccatccgccgcccgctcctccgctccgtcgccttctcctcctccaggtcccgctccctcctccacctcctctcccgccccctctcctactcctaccccccttccgcctcccccaaccatctccaccacccccaccagcagcagtggcagccatcgcctccgcctccgcctccgccgccgcaaggacctcctccccagtggtctcctcccggaaactaccaccagcagcaggcccctccccctgcgcgccactactacggccccccgcagcatcagcctcgctacaactacggccctccgcagccacaggcgccgccgccgccgcgcaacgactacgggccaccgccgccgccgccgcagcagcagcagcagcagcgggaggctgtggtggggccaggggagctgatcgggctcggacgggaggggcgagtcaaggaggcggtggagaagctcgacaagggggcgcgcgccgacccgcaggccttctacgagctcgccgcggcttgctccaaccccaagctgctcgaggagctcagaaagatccacgacttcttcctccgctcgcccttccgcgccgacctccaggtcaacaacaagatgctcgagatgtacgccaagtgcgccgccatgaaccacgcccgcaggacgttcgaccatatgcctgaccggaacatggactcctggcacatcatgatcgatggctacgcggtgaacgggctcggggacgttgcgctgcagctgttcgaggagatgaagaccaagtatggaattgcaccgaccgcccacactttcacgctcgtgctcaatgcctgtgccaactcggaggccattgaggaggcattcctgtactttgatgccatgtccagggatcatggcattgagcctggtgtggagcactatgttgggatcattgaggttttggggaagtcggggcatctcaacgaggctgtggagtacatcgagaagcttccgtttgagcccactgacacggtgtgggaatcgctcttgaaccttgcgcgcatgaatggagacattgaccttgaggatagggcagaggagttgctggtctcgctcgatccaaccaaagttaatcctaagaagctccctactccacctccgaagaggcgccttgggattaatatgcttgatgggaggaacaagctggtagagtacaggttgccgcccaagatcgaaaagaaggtggtgaacgaacagcggtatgtcccagacacaaggtatgttctccatgacattgatcaggaggcaaaggagcaggcactgctgtaccatagtgagaggctagcgattgcctatggtttgattagcaccccagcaaggactccacttcgcatcattaagaacctcaggatctgtggagactgccacaatgctatcaagatcatgtcgaggattgtagggagagagcttatcgtaagagataataagcgcttccaccatttcaaggatgggaagtgctcttgtggtgattattggtgaacatggcttttgttcagctgaatacaatggtctgaaattgccaatacgatgtattgagcacttcttttttcttattattaggattgcagccatcctatatgaatatatgctggcagccatgcttttagcgcataaacaatatccagttatctgatggtagtgttagtactcctgttatccatctcattatgatcatgaagatgaatgtgatgcttttattcttgatggcctattttttttcagagcttttgatgaggtttcttactaacatgttagtcctattttggggaaatgtttacattgcattgatgataagagaggtttcctgcaatttcataaagagtatgtgttgttggatattggtgtattatgctgtacgctaatttaaatctttgaagatatctcttaaatttcctttcaatacagatataggaaacatatggaattactagcctagagcctgtgcgttgcaacggaaaacaatttgagtttctatcttgttaaattaatcaataaacacttatttagtccaggtaatactatgattttccttattaaacaagtaggcgattttgaaatttgggaagagccaatagtgaaacgggagaggactcattgaaaagatggtgtaacagtatagattgtggggccaacatttcagtggtaagggtggtgtgggaatcggcaccaccactactaacatttgaagtagcatagaatagtttattttattgttaactgttgtcctttgttcttaatcttgcttttcatcttccttgactaatcaaaccggatgtgttttactggacatgttgcaaatgtgtgttctattcatccacaaggactgcaattataaatttatttttcgtcaatttgttctcaaatagttctttttacatttcttttgctattccttttgattttgctatatgaggattattttgttgcgactctttattgatcttacacatctgaattcaaaatgttatttattttccatattgaactgttcttctatcactcttcagcttatggatcataatgtcctgtcaattttatcaaattcttccatcatgaattcatatgattcattggccattgaaccccttattgcaaatcttcttgatagaatattaaatctgattgattctggtatggctccatcaaaaaatttcacctgtgatttcttgtctctccatccatcttatataacttttcatgtgtcttgttatgtcgaggtccaggagaagttccagattgtggggacatagaattctgtgtttctagaacaaagcacatatgcaggtgaaatcttcattatctaggcctacgatgacaaagtgtagtactttctgtatctgaattatttctgtctgcttcaatgcttaaaatacttgctaactttgaaattctctatttcattgacctgcaatctttgcatgtgtgaatatttttgcattattgaatcacactgctttatccattgtctatctgaccaaagatcagttattttttaacttctttattcttgagttgtggttgccattctgtttctatttcttataatagtgtatcattttgtcataccatgtcaatgctgttatactgtaacgtgatattactcaagaagcgtgccatatgtagtgtggtgtggtccaacgtttctcttggaccttgcattaatttcttcacaagtattttaaaaaaaggtctacaaggctgcatacaaggaacggatgccaaaccttataccgcttaagccgcataagtggtcgattacactgcataagcatctgattatgccgcataagcgctacaaggtggggtgaccacacataaactacatgctattttgaacattgcttcgtataaagttgtattttgtgtaaaagaacagaagtgtctctggtaaactacatgttattgaggaaattgatattttgcggctcaaatcttgtaatattgtcatattcatcatatgatccttttttcttcttgaaaaatgttccagatttatttaaagcattttgcgagatatgaaagttgtttctgtatattgtgtttgaaaagatttttgctatagctggtttccttattatatcggccctctcctgtttattcttaccctgtaacaatttggatttaggaaacctggttgtgtggttaggctgtgaaattcattgtatttgagaaagatctgctagaattgtgattggttgttttcctgatgctggcttcataaatgcctggaaaaatccattcaaatgtttcagaaaaacacatcccgaaatgaatgtttttctgttttcattagctgtaattccatcaaaggtgcaaaggtgcaaaggtacattatttatttttctggaagcattgtgtcacacgaacacaatccccatattttcatagcagtctcttgatcttccataagtttatgttcctttctgttctccaaaccaaattcatataaaccctgggtcattgtcttgaactcttggcctggacactccccacttaggagcttagctcctgtgggtgcgcatcgcatcggcaatgttttttttctctttttttttttcgggagtgttcatttgtgaagtgctctgctgtacatactttctcttctctttagtaaaatgaaatgcatatggctcttgcgtttttgagaattttttttcttgctttcttctggaactatctagaactcgcatcattgctggaagtttctctgtgaattgacgttttgacattgctcataccctttttagtgtatggtaaagatgtgagtctctcagggcagacagaattggaccctgtagacgtcagtaatctaccacaccattgcttgaactaacttattctttctttgtatatgatactcttccaatgttcttatcagcagtttttcctctgttgacaagtagttatgacttatgagatctgagaaatcttttttctcctgttctggttagttccgtgttatcctctaagtccagccatgtaatttaccatctcttgtaattttcttcctcactatcatgacacagacacttttaactacctcatttatgtacctttccgaaacaactcagtagatctgacattgattcagaatttgttttccattgtccgttgcatctgaatgttactttggtgacttccctgtttcttttctttagcattatttccttttcacacttcccttagtcagaattcaagaaggtttttgtatcttctgttagcttttggtcactcttgccagcttctgaaatttgattctaaccagtcctgattctgttccactgctagtctgctatcttgatttggatatgcataatttgttgcttgtattggattagtcttgattttcgtcgaacaaccttagttcctgcaattaatatagtatattggatgttatggaattttctacctagtctttttgtatatgagtcatcattttcaatctcctgacaattacaatgatataacaacatatatatgttactgctcccttttattatattgctgttggaacatttttgtgaatcttctacgtattgcatacctgaataattcttttgaggaagaaattgtgttgcttaatttggaaatggctttccaaacttgtttctgtttcagtgaaacacaataaacaaaggcaaaagtccattttacaccctcaaaccggtaagcttgtctacaatacacacccgaattactactaatacacttgaatagggatggcaatcgggcgcgacgggcacgggtaatgtctacccatacccgtgcccgtgagattatttttgcccgcggacatacccattactacatgacggacaataattgctgcccatgcccaccacccgcggacatcacatgcccgcttacccgccacaactagaacagtgcaacaaaatttcacaagtttagcaagttctccacctcggtgttgtgtcctcttacaacgatggagtaaggggaagagaaaaaagggagataaaaaagaaaccgtagaaaacaaagaagatgagttatatatcctagtggattttactcatggcccacatgtcagttagatttcacgggtaaacgggcaaagcgggcatgggtagtcatttcccatgcccgtgctcgtttacccatagggtacagtttttgacccaataagaaacccatgggtaaaaatggagaacatacctaatcctaataggatttttacccacaggttaatgggcaagaactattaatatcggacacttaacacccccaggctgtttttatcgtggtttttgatatgccggatgccacgtcagcctttgccgcgtcaatgcataggattatatgggccaagcccatattggctcgatctgttttgacctagcctagcattctcatgagcaggctgcgatggcagggttgcgcggaggcttgctgggagcggtggcactgggaagaagcatctctgataggctgcgcgctgtcgctggtggaagcctatgcgcgtcgccgcacgtgcccttggagatggctgagcagagaagaagcaactccacgtggggcggaagcaacgacgagctagtggaatgttcagccgacgaaacaagcaaatcgaggggcacgagcacctatggaaatggcagcatatccagtcaaggtagaagcgtgcctgttcgtctgccacttcagagaaccatgaatagggggagagagagagcatgtgtgtgagagatagaacctcgacccatacacacttgagccaatactgtgcgctgatgttggcgtgtcaaaaaccactgtaaaacctgccagtttggggagggggggtgttggtggtggttaagtgtctggtatcgacagatcgaggatgcagtacggtttcatagtttaggggtgtattttagacaaccgtaagagttcaagtgtgtaaaatggacttttcccataaataaatactagcactgttcaatgagttgagtagtacgaaccaattccgaccattgtactctttggctgagttcggcccgagttgaaaactcatcccacgcatacaaaacggaatgagtcattagtacatgattaattaagtattatttttttaaaaaaggatcaatacgacatttttaaaacaaattgcttatagaattatttaaaaaaattataacgtttagcagtttcaaaagtgtgcgtatggaaaatgataaagaggagttgggaaatatggctgccgaacacagcctttgtgtgtgttttgatgtgtactagtacttctaactatgagcagattccgttaaaattagtacagcctgaaagcaagttcgtaatcatcttaagttacatgatgcatttcagaattaattggcttgaatgttccttatatgcacaaacatgtagtccgcacatttttctgtattatactttattgaagagtaatttttttttaaaaaagtttttgggcattcgtgacataaaatccttgttattacattttgtttcaacatgtatatgaattcaaagacatttcatactgttctttttatgattattatacataaatatatgtgaggcaaaggaatggtataatcttgctccttgggttttactaaacatttttgtcccaatatatgggattgcttggaactaatcacaataccatggcttttacattatggagcccctaaaacttagggatttgaaaaaaaatgatgtaatattttctgaatgaacatgattgaaggattgatgtataattaggttttgccccattttatagatttggaagtgtttttgggaagaaacgtacatcaactcaattttggattttggaacatgattgaagaattttggatgccattaatgaacgaagatgttctcatccttatggatgtttttttttttcctatggtagatcaccttatttaccacagtgggcattagacatcgtggacaatatccagcatttactactacttgatattgagatccaccctactactaagagcatgtacaatagcatgctataagctaattataaacatattttaaatagataaatgaagatagagaagagcagcgggttacaaatccgtagccaactacagcacggactccaagacgtaatgtgtgtatgacatgtgggattagatattaatagtatagtaagcaactattgtatgaattaactattacattggctgtagatgatttggagctagttgtgggctatactattaaacttgctctaagttgcaaaagttacattgtggttgctctccttgcggtgttcttcagtaaagagcacaaagtttgaggatactgtagcaaattttatcaaaataattattcccctgtccgttaaaaacttcaaaatgaaacactctatcctatttttaacaaatgataaaatggtaaaacaaagtcccaagctcgtgcgtgcactcacgtttttttcaataaccatgacacatgctgttgtggtgctattcgaatcatgaacatctcgaatattttcatatataaaaaatgtcaccaccaaatataattgaacaaacaactcgctttacctgcaagaaccgaaccaaacacgtcggtatcatcgtgttcgtgtaggatataaatataaacacaacaaaaatgatgtaaatatatatgtgaacacaacaaaaggttttgaacgatgaagacttaaccgaaactacaaaaatatattttgatcttgacaaatttgtagatgatttaacattatttgtttttaactatacgcgtcccacacaagctcatcataaaagtactccctaatacacgctcacaaagaacaaccacaaatctttggtcttcgctaaaaaagctatgggcgcataatatctatggacattattatttaaaccttaaagggagcagtaatacaaccacgatttcaccgctgttctaccggtattaatttcctgatttaacaccttattttagttcataattacttagggactagggtttgcattttcgatttcagccaaaatttcggtagcaccaaaatagaaatttcgtgatttttggcacttgtcggaccaaaattagttgaagtacttttacatgttttgactggatttgaataaaacttgaccaaattcaacaaacatttggtaaaatccaaaaatttgggtcgatatatttgaacatgcacagatgtagcctaagggggggactcaaaaacaaatcacagcggtaaaattcaacaggcctggaatctcctggtgtagaacaccggaacttccggtatgttcagacagtccggaacttccggtgttcttggaccggaaaacagacgaaattcaaatttcacttccagaaatttagccaattctcaaaagtagaaacacacaggtgaacagaaaagcaataggatcacagatacaagcatagaaacatcacagaaatggacaaggaggatatttttttcccgaagttcggatctcgcgatctactctccgttgaggagctccaaagagttgggggtatcaattaaccccttgcctcacttgtgcaaaaatcttagaggaaatccacagccttcaaccccaacacctctaggtaattttctagaattgagtgaccacctagatccaacttaacctacttctagaaaacaccataagtgtgagttgctctattaggaaaaccactaggactttagcataagattctttactcacttacctcgttcccttacggaggtgaggaaaatattcacaagctttcccgggaaatccacaattgcaaaggaagctcgcgggtgacacctaaccatctaggagatgatctccaagagtaataagcaccgagatgtcagcccacaagataccccaagtgctcacaccaatcctagccttcacaccttctccaaatcttctccttcaccctcaaaatctcactctctcacaagaatggctcaaaattgggcggaggaggcaaagaaacacctgggagaggctagcaacagttatggaatggaaaagcaaaagtgaaatggccaaagggtgagctggggacgattgggatatatataacggctaggtgacgtcatctagccattactcacatttttgaactggaaacaggtccgaaacttcctgtcctccggaagttccggataacacttagctaggtaaatttcaccattcatcgatccggaacttccgggtccaaaggaccagaacttccggccgagcagatctgtcctgggcagagctattctcaaaaatattttgacacttggatctcactaagagcacttattgtatcccagaaccacacttggaacccctcttaatagtacttttttcctaaaacccgattgcaaaaagtaaactagcctatgcacacttcgagttccattcgttgtggggggtctccaagcatctcttgaccacacaatgacatcttgggactaaagcacctgagtatagctcaataaaactcattagtcccataaccacattgttattaatcaccaaaacccactagggggataaatgcaccttcaattttgatttgccagtggggtatgaaattaccggaattgcaatcactgttagggacaagcaccgaattgtagtcctgtccacttacctaataatgtaacatacccaaaatttaatcaaatttggaaatacaattgctcctgaaatttttaaagagtttttcctttgaaaggtttggtcaataagaaaaaaatgccgaagtaattaaaccaagtaggaatatcttcagattcaaataacagccccaagtaactatataaattataacaagctaggatgctaaggaagacaaattgtgtcaaacaacattttaattgtcatgactgaatatgtggtgaaatatttgctgcaatcggtcccaagccttgagtgctaagagcgtgtaggttggtttgatctacaacaaacaagagaaaatagaaaacataattagatgaacgatagccgatcggccgatagggccgatgacgtatcatcaggacccagccgatcaatctaacttgatgcatttttataaagaaattcgatcatataagtggcaaatatacataaacagatcatgaaacatgcgctatcatgcatattaggtaatatcggctgaaaccctgatgctatccttaattatggttaactccaggtcagtttttatgattctaaatatggctagggatgatgcatcacaaagtatataaagaagcataaagtttaaacaatcaagaagttaatcactttttaggatggtagatatcttagttaatctaatctagtaagacgatttagctgataccaacataaaccctaaaacgagtatcaaccgataggactaaatcgagatactaacactatattaactaggatatatgatagcaatgactacgataaaatgactaatacatctaaaatgacatagtagcccagacaacgcaagtcatcgagacaagttacctcttgtcgagagatcgcagccgatgcgctgactcgaagcaagaactcgtcgaaaagtaaagcaaaaaggatggcgatgcgccgaaagttgtattgattggattcaatcccttattacaatgatttggggcttatatttataccccgagtacaaaacctgtccattatggacgtgattcaaaactttgctaaagataaaatttgaacaagtccacatggctgactattaccatatctctaattcaaaccggtataaatatcctaattaatagataaaattaccttaaattagctcaatctctatacgacaatatcagttattccaatctaggcccaacccgagcctaaatcaatccgtattggctatctggcatatcggctaaggctctgttcgggagtgagggttgggaaccctcagtctccggcacgtaaaacgaagcagcgtttagtacgtgattaattaagttttatctttttttttaaaaaatggatcaatatgattctttaaagtaactttcgtatataaactttttttaaaaaacataccgtttagcagtttgaaaagcgtgcgggcggaaaacgacaaggaggagttgggaactactcctaacgaacgtagcctaagtctgtttccatctctattttcagttgatacgatgtccagccgatgcacagcctatctcctaatccagttcgattccgcaccaaatctgcctcgatttgttcctcctccgagtatgatgcaaaattctgttgttaacaaggtgccgattttttagtagattgacacctgtaaaaaccaagccgtgagcattgaggagcagaaaaggagaggagccgttacctctctctctctcacgcacctctctctttctcgagaggcagtggcagcagcgccttccctgtctctgccagatccgatgggaggggaggtattggcagcagtggcggcgccctctcctccactagatccggccggaggagaggcggcgacaacggcgggctctccacgggcagcggcggtgggctacgcacgggcgatggtggctcttccctccgccagatccggtgggaggggaggcggcaggatacccacaggcgacgacaactctaccctctgccagatccggtgggaggggagacggcaggctacccacaggtgacgacaactctcctctccgccagatcttgcgggaggggaggccgcaggtttaccacggtgtggctcccctcctctctctctcccctggcatcccaccggcggctctcctcctctccaccgcagtggggtgctgccttctccgctattaccgcccgtggtctgctctttgccactagctgctgtgacgcggctagatcgacgacggcgatggtgggcatgtgtttgtgtttgcaattttcttcatttttgtggctgtgtttggatgatttctgtgatgattttgattgtgtttggttgatggggatgatgctgatatcatcgatgatggagagctgcccccacactactacacaaaatattttcctggacaccgaacccttttgttttcaggcgggttgtaagtgaaactgcacgggaaaatagggagactggcgccgggccgtcgcccgcacgggaaaactcattttcccatgcgggcgttttaatccgaccacataggataatccccattatcctgtgcggtcgacttaagaggaccgcacggaaaaatcgattttcacgtgcggacctcttaagtggaccacacgggaaaatacattccttcttttccctcacacccacttcaaatttttcacactctctctctccactcttttccctctcacccacttccaatttttcacacaatctctcttccttttctttttattctctcccacacgcctctttcctctcctcccctctctcatgttctctctctgccactttcctctcctcacatccccctctcctctctctctctgcctcccactgagcgcacgggcgtcatgacgacggcgatgacgagtggcggcgcgatgatgagcggcagcgcgacgacgacggcgcgaggacgacgactgctggcggaggcggagcgatcggccagcctttttcttcttttcgtcatggttttgcaaactttgtgttgcgtcgcacagtggatcggctggttgccgtttctttgctcgagaaatggtagctttgggattaggatcgagaaaggctagctatgcgctcaggtacggctgcctgtgcggggttggacactggactaaagagagacgacggcgatccgatcggattttttcgattttattttttttgtccgttttttttccatgcgggtggtataacttaaccgtacgggataatcgacttaatatgaccgcctgggaaaatcgattataccgtgcggtcatgttaagtcaaccgcacgggataatcgattatcccgtgcggtcagcccgcccgcacgtgaaaatgccaatttcccagacacgcggctgtagacgggccgaaccaccgtaccagataatcaaaacgtccgcacggaaaaatagggtatgtagtagtgccaccatcgccgatgcatcgagccaatatatatatttttaatttatggagcctcaaaagtgctagttcctaaatcggcacctgtttttcatctacatcaatgccgccttctaggtgccggttgggaaatccgacatctttgttggtttgcagctagcacgaatgatagtttctgctgttgtgatgggtctttaacaactctagggagatcgatttttgtaggtgaaagcaattatgatccacctgcaacatagaaaatcaattccgtagtagtttttaggccatccctaacccagaaactatcaagtagtttctatacttgccatgtcatatagacactatgtgtaaaaactatgtattcaatggatggtgtcttcaaattaaattctcatccaatcacttctcttctctcttcttttatccatccattttcttgtttttattcttggttcttgtgtagagatggtttctttattttttttacctctctactcattaactctcttaccacataggattttcgtttatgtggtaatatatttaatgctatagaaactagataataggtaggattcgggatggccttatttcctctcggaaccgcgtgatcaattcagctcgctgtaactttagcactgcaaattgatatacgggactgcaaattgaactttatatgctcgggacattacatggactcgtcgccaactcgtaacctataaataacttaatctaaagcaatcctgtcgatcatatgacatgtaaggcacacgaacgtacgtacgtatatatagtacagggctgggacaagaaagcatccaataatctacatcttatgctgagaagctacggattcaacgagcgagtgctagcgtacgtaagcatgcatgttttcttctactactacttaattaaatcagcattatctaaaaatatatatctgtatcaaaggatgcaagttaaatagactctttcatgactacggttaattatcgcagtcctcactcaacaaaagagtcatatatcatccgatcaatcatggatgtgtcgtaaattaattaaccacactttatttaatgaattaagtctttcatctatcaaactacactatttaacggagaaacattgcgtcttaagactgatcacatgactacaaaatttcatcgtatgccgataagtactgataaactattttatctgcaagattaagttaatgctgacccatgtgattacgttcgtacgtgagctagaaattaaaaaagcagagagaccagcattcttacaaagagtgtttaaacgctctctatctgcatacggtagcccctatataaacaaaccagttgtcgtccagcaataacgaacatcaaccaacacacaagaaaaaccaccagagcctctcttcatgcagatggcgccttccaagagcatcctcgtcgtcgtcttcgccctcttcgccgtcgccgcctcgctgcctccgtcggcggccgccagggacgcccaggtgttcaagcccaccgtcgccgtcgatgtcgtgcatcaggaacaacaacaacaacaacaacctgcagtgaacgccattgccgacgtcagccagccatctacatctctggttggattgccagggctcccgccactgccacctcttccgacgatccaaatcccaggactcccgccattgccgcaacttccgacgatccaaatcccagggctcccgccattgcaaccacttccagcaatccaaatcccggggctcccgccattgccgcaacttccgacgatccaaatcccggggctcccgacattgcaaccgcttccgaccatccaaatcccagggctcccgccattgccgcaacttccgacgatccagatccctgggctcccgccattgcaaccacttccagcaatccaaatcccggggctcccgccat

SEQ ID NO: 27619 - DNA, 9742 bp, Oryza sativa
attgccaccactgccatcaattcctatcactcttggatcaccaggagcacaaatccccataaactcccagagcgcactgtcaacgtctaccacaccacaggtgatcacagagtgcctgtcgtcgctgatgcagctgatgccatgcatggagtatctgaccaaggctgacgagccggctcccccgagtatcggctgcgacagcttcaagtcgcttgtggagaaggcgcccatctgcctctgccatggcatcaacggcgacatcagcaagttcatgccggcgccgatcgatttcgcacgtatgatgtctcttccggccacctgcggcgtcgccccgcctgtcgaggctctgaccaagtgcttcagtaagttttaattagcttcttttctctattgtttgctgcaacttatttctgaatttcacctgtatatactttttttttcaattgttttgtgtggattcaatcttatgtatacatgtaatgtttgtgttcgaaaagattgatttatccatgttatatatgtttgacagcgggaccagtgccgccgttgatgcctgctcctactcccgctgctgctccatctccgggtaattaataattaacaattcattctggaaaaaaactgagatatgctaaactttatctatcctgaattaactctacgataagttctgtacccttacttgttcatgttttgctttaattttattctgcagggccatctgcgtaagtttatatatagcgcaagagagaatggatgctgattaagtaggtgccgtcaagatgaagattattaatagaattttgatagtttatatgagtaaatgctgtctagtttttgttagtttctgtagtcagcaagacgttatgaatgaggttataattaattaggtctagggaggaacaataatatatatggatcaggtcttagttcagaacagtgtcattttgtacgtactctggtacaaatatataaatctacaaatattgttcaatatttttatttcattgtagtcgttctgttgacaaaagtatacacaaaattataaaatgtaatccctgaggtcatatattgctccattcatatatttcagatcgattgaactttttaccatcaataacttctcaaatgcttagttttaaaataaaagattttcttcaaaaggagtatcacagtattttcgtacttttatcatcttttttaaatataaaattgatattcaaatctaagtttgaaaaattcaaccaaatcttttctcaacgtcaaatatctatgtgagaagattatgagatttccaagtactttttcaaaatatttatgactcaaactacaatgtacaggagttatttaaaattttcagtgttgtatatagaacttgaatgctcccctccacacaatcatttttctgcccgaacagccagtgttaatccatcaccaatggttccggatgaaccgcagtgctaagccactgcgtgtagttgctctattaccaaatggtactaattgaagttagatctatatattttgagaatcagaatttgatatcagagtgtataaataacgaaccatttatttgttttcagtacaaatttttttcatgtttttaaatcgactaaaatttttgaggtaacgttaatttatagtttaatttacatttttacagttctttgcaagatatccgaatggcaaaggtacctatgttctacgatttatcattaggtactgacattaattcatagcaaagatatctacgttgtacacacaagtatagagagatagctccaaatatataccttctatatctatctatatctataataattgagcactttctacaagctcccaagttaactaggaaaatatggcctttgatcaaatcgataggataatcttcaccgttggtcataaaatcaaatcgcacatcacacctttaaagcgatctaatatccatccaattttaaagcccgtctagagcccatctaaccattacataaccgtatacgtatctcatcatgcaagcttttgaattatattcgtagacatcgtcttgctaatatatctctgtcccgactcgagatgtggccatgtcgaactcccttgcaattgacaaaaccccagaagcaaaaacaacatgatctgtagctatatatatggacggcaatatttagaggactagaaccctggaattaaccttcgctgaattgtgcatttgtgttgttccatgcacctaggcgatggttgatggtagatcctggagtcaacattcgatgaattttaatgtaattgtgtggcatctaggtggtagcacatggtgtcttagaggaagaaacaattatgtttaaaggaaagaggaagcagacagatagattaacaaaaattatgcatgcttctttgtatggtcgagagacgtcccgttgagtagagatagaagctaagttcagattgatctccatgattggcttatatgtatgtgtcacacccggagttttcccctttcccgtagtttctaattcgtcaataaattatctatagaaattactttggttaaccgggagaaaaccttaagtaacaatgtatttaataatcgaaaatgttagggagaatttttttgaattctctttgctctaaaatcattaacgggacttaaagcggaatattcagagcatcgggattaatgttgttaacttaaactggcaggatttgaattaataataattatttttttcttcttgcctttggtcgtgaatcatgcccaattcactcctctcttcgtacgtgcctccgcgttttcgttttgcatgatgagccaagtccgatttcgcttccggttccatttccgttcttttcccaaaacggcaccgtttttcctttccgatttaggaaagtcctaatcctaatccaacccctcgccctctccctctcggccgctgccctccctctctccctctcggccgtgcgcgcccctcctccctagccggccgaaccgagcccctcttctcctcctattcggttcctccctcttctcctcccaatcctagtcctagtaggacccacctaatccatatattttccccctatataagtcttcatacccctcaattttattatttccctcatattgcaaaaccctagacctagccgccagcgacccctatccccgccgccgtcagtctgctgtgccgccgcctgccgcgtcgtcatcatcgccgttgcgtcgccagtactccattttccctctttattgatgtgtttgccgctgcaaccatcaattcatcattttaatctattcagtttgtttctcatctagcgtcgccgtagcctctgtgtgttactgccggatcgtcgtcgccgtctccagctcgccgatcgtctcggtttggtgaggaaccttctcgtgatctcctagtttaggtgttaattctttaagcgttgttgttgtaaccctaaaagtgtaaccccaccaaaaccctagcgtcgccgccgctaagcaccgctgccgtcccggccatgcgccgctgccaccaccgtcactgccggccgcgcgccgccgccgctagccgagtcgcattgccgtcgccgtttagcgccgcacactacaagaaatgtgatcttctgtgacaaattcctcatgacgatggtgctattcgtcactatgccatttcgttttatgacgtttgatagggggtggtgttaacgaccaaatttggtaagtaatgaaccaagttcggcatttgaatcgaagtggattcggcaaagggattgtgatcgaagaatagagtgcgcatcggctgcggaggtatcggctagagtctgcatcggctgagatgacattggacaggggacagccgatacagccgatttcattgagatggttatgaaatcgtttctgggatcgatcagagtgctacgaaaggattgccatcatagagataagctcccagataggcaattgtatctattaattaggatattttaaatagtttccttagagatatgtttgggcaaaagtctgccgtaaagacttatgtgtatcttagagtttgttagagataatagtcgtgtccggcaaggacatatcatgtatctcgggtataaataaaaccgaacccatgtaatttaacaacaaccgttcaataacaatctcggcgcattgccaccctttttcaggttcgtttgtttcgacgagttcttgctttcgggttgagctgcatcagtttcgatcttcaactagaagtaaacttgtcatggtggcttgcgttttcgggattagtgctttcatcttcatgacactctaatcctgtttatgtaattcgtcgagttattatatacactttataatctttattagtgattctatctaacccgcaatcggttggtttttactgctaaatagtagccgatagagttagatcttgttattaatctagattatacagcacatctaccatcttttagaggttttcatcatcttgcttagatcttacatttatctttacgcttaatgctgcatcggttaagttcgatctattaagtattatctataactataatatctagcttgttttatgattatcaattgagatagtgtcggagttttagccgatatttcctgatttagcatcttttgccttcatatgcttgattgttatgctaaatctgccctttgtattaagatctcatcgcaccagagtatattaggctttcttgtttgatatattttgcttattttaatatcttagtataaagtggtatcggagtattagccgatacatgctagatctatctgatcggctatgctataaatgcctatataatcattgcttttatgtatcttttgacttgagtgatttatactatctcggcatggcgaccgatctatcccaatcacttagtttaaacatacatcgaaggaaagattatatatcactaatatctacagccgatcgagtagatttagtcttatcttattcattcattactgccgatcgattccaacatgacatcggcttgaagataaatgatatgtcatcggcaactaaccgatcggctatcgtttatggatttgaccgtggttttttcttgtctttctttcttgttgaatgcaggatcaaatcgccttgaacctaaaagcacgatttaggacctgcacaggagttaagcagatcttccaggccagtgtgtgtttttcgcatcaacacgcttttggcacgcccagtggggcacgagttgagcgatttttcatcatgtcgggcggcaagcaaaatcccccggctaccaagcaagcgtccgatcaaccagcggaggttgacgttgagaacatcatcccaatcacttaatggcaagtacttgaagaaatcttacacaagtgtatggattaattcatgatcggctgatttttgccaatacatgctagccgatgtgatgatatcgcctttagatggccgatatggattatatcgcccttagtggttttttcttatcataattggttgtggtttgccgatgtatgatgcccgatatgattatatcgcccttagtggctttttcttatcataatcggttgtggtttgccgatgtatgatggccaatatgattatatcgcccttagtgtttttttcttatcataatcggttgtggtttgccaatgtatgatggccgatatttgatatatcgcccttagactaaattataattttatgaatgacttcagcattgcaaaattaggggggcaaatatatatgaaacgtggatttcaaaaacaaaatttaaaggaaattcgcgacaattctaaacttgaagttctttacagcccaaaagtttacaaatttaaagttgaagttacaagattagctcatccagacacatatttttggatggccgatattgccctctgcctaatctgatatacttcatctattatttgggcatcggttgcgtcagtgcttgagatcaccttcagagatttggtcaggtcagtcaagtgcttgacatatgcttttaattttgacttctggtcttcaatggctttcggtaagtcgacaagcttttgttcttcaagagtgatttgtgcactgcattgctccaactcagccaagagctctatcgtccgggcgttcagccgattgatgttagcttgagtagaacttgggccagcctctaattcatcaagtttagctttctcttcgttgatagaagccctgctaacttggatggtcacctcaaggtcccttctctcacggcgatcgacaatcctttgtttggctttctctagtttgagccgatgttgctcaaggtatgccgctggggtataatcgcatcggctaattcgtctgggattttatcatggactacatgaaacctatctctaatggatccactgctggttaccagagtttccagagaaccttctagtcattttgagatgtccagcagggttgctttcacatcatcggctaggggcaccaagactgtgcttgtggtttcttctttttcatccatgaactgcctgatgtcgaaggagaacatatcggctaaaacctcaaaaggaatacattattggttaacaaaagtggcatggtagccgatatgatttgtggattcaaaacaggaacttacagggatagcatgggctggtgctgctacttcttcttcttcttctatgtgatggcttcctgcagccgatagggtatgctcacttgattcgggaataggagttggagtacgacgagcctgagaaggaccaatttaagttatcatcggttattcaaaagttgaaaagaaaattaaatgggatttagaaacttaaccgatggaattggtgcttgtggttttttagaagccaactttttttctgcaaagtacaagattaggaatcagcatcaaatattaaaacagaagatgaaaagagaacacatgcatacccttggtttgtaactgggacgcactggaggtgatggagttctttgaggagcaggaatttcaggtggaggagtttgcacccttgtttcactaagatttttagccgcttcatctacagcttctgccaattcctcaccctccaggaattcttctatgtctggatctacggttggtaggtcatcaatagcagtcttttgcttcttgggcttcttctttgcagccgatggagcagcagctgattttgtttttctcttcttgccaacatcagctgcaatcagcacacgcgacagaccatgtagtagagttgaggtcttgggggcatgatagccgatgactgggggagctaagccaccaccattgggaataagtcctggagcatattggatctctacaccacttttgctgcgatggggaggagaagattctgttgtctgcagaaaagaaaaattaaaagttaagattgatcaatcggcttacaattgttaacaaccaaatttggtaatttcagtatcggagacaaagataaaatcaaagcggaatccaagatggagatcgtcccgcaagaagagcaaaaatcggctaaagtccgaatcggctgcgaccaggatcggcagagtccgagttggacaaggttagccgattgagccgaatccgacaatatgacacggcatacgttgtcgtgttgggttaatgtgcttcatgaggattgccatgcatggacagagtcctgagaaggcaattgtatctattaattaggatatttcatgtaatttccttagaggtatttttgggcaaaagtctgccgcaaagacttatggtatcttagagtttgttagagataagagtcgtgttcgatatggacatgttttgtaatctcgggtataaatagaccccgagccctatgtaactaatctaacacacgttcaatacaatctcggcgcattgccacccttttactttcgttttgtttcgacgagttcttgctttcgggttgagctacatcggttttgatcttcaactagaggtgaaacttgttatggcggcttgtgttctcgggattagtgcttccatctttatgatactctaatcttgtttatgtaattcgtcgagttatcatatattctgtataatcttcaaaaataccgttatttaaccttcaatcggctaacatctatcattggaaggcagctgattaggttaaatatctatgttgtcttagattgtacaggatatccaccactctatgaaacatccaacggcttgattgtctagatattgttcttcttttcatacttatagctgcatcagtggagtttgaccttataagtcgtgattagaatttcaatctctagcctacttttggttgtcgattagggtagtatcggggtttcagccgatcttatctgattttgccttattatttcatgcgcttaattgacatgctagatctgtcttttaaattaagatcttattacaacaaagtatattaggcttctgtttgatatattttacttgctttaatatcttaatatagagtggtatcggagtattagccgatacgtgctagatctatctgatcggctatgctatgaacatctataatcttgttgttaatatatacttcgatttaagtgatttgtatactgtctcggcatggcgtccgatctatcccaattacttgatttaagtatatatcgacatagagattatatactgtcaatatctacagccgatcgagtagatttagtctcttcttacttatttatatctgccgatcgattcaaacatgacatcggctcatagataaatgatgtgtcatcggcaactagctgatcggctatcatttatggatttaaccgcagtctctttgcctttatttcttgttgattgcaggatcaaaccaactggcacgctcacgaatctaaaggcaagatttttggacctgcactgaagttaagcagattttccaggcctcgtgtttttacatcaacacgcttttggcacgcctagtgggaccgagttgcaataacgttctctcatggctgagaaaccaccaccatcaccgtcttcgattggcaagtcggaggtcccttccaagactgatatcccaaagcctagtgggtttgaagttcatgagggaaacattgttcccgtcactatagacaaattaacaccggaacaaaagaaggagctcgatctgatgatgcagcaaatacaacaccagttcttgaattctttcatggagacccgtaagggaacagttgtttagaagtataaggtaaaattagttgctgatgttcctggaacaggttcttctaagaatggagaagtacaacaagttccggctggtacagttgaatcaagtagtaaaggcattccagagggctcgggagataaaggtgatggttttcagggggtacaagttgaagatcttagaccagatggcaatgaagtacaaccgcagtttaacaacttccaagatcggattgactatgccgtgcaacatgctttgattaatcaatctggagtgctagtgtcacaccccgaagttctcctaccaagcctaaaatttaatttataaacgaccccaagaaaatgcaggtgcaatcaagagaaaaccctaagaaagtaatgcaaataataatcggagttgacatgtggaatttttcttgagttcttcatgtcgaaatttattaacaggatttttagtggaattttcagagctctagaaataatttttaaccaattaaaatggagcaagcaatatttttattctagggaaaatcctttttcttttttttctttttcttgggtaccgagctcg

SEQ ID NO: 27620 - DNA, 3272 bp, Oryza sativa
cccacctccaacctcccacgtcgccggcgaaatcgggctcgcctcggccacgtccgtctctcccgagcccctataaagcatgcccgcactcccctccaccttttttctttttccaccactctctcccgtgccctccattgctcccgcgccgtgcgcccatccgctgccgcctctcccgctactccggtcgcctctagccaccgctacactcgccgccgcaccacgccgtcgccgccgatggattcgcgcggccgaggtccacctcgtccatccctcctccgtcgaggttcgccgccggagccccatccccgtcgtgcgccggtaagtgacgccatggccgccgccttcggccggcgttttcgccctctcgcactctcctctctctctctaacccctctccttttgttcgttagaaggttccggagctcgtcccgccgtcgccatcgtcccccgtcgcccgccgtcgtcgaccgatgtcggtgaggcctctcctcctctttctctctctctcccgcaccgtttacccgttgcgccgccgcttagccgcgtagctgccgctttgcctctagccgccgctctccgccgccggtcggtcgccatcggccgccgtcttgcgccgctgccgcatgcgcgccgcgccgtcgcgcgccatggtcgccgggccggtttgcgccgtgcccgcgcgcaccggctgcgagctcccgccgccgtccgatctacccttgggtagatcggggccgtcggttcggctgtcgcgtggccgccgcgtggcgcgccgctcctccccggtccgtggacccgatccgccatggaccgccctccccgagccgctgaccggtggggcccgcttgccggcgccgcgccccgccttgatgacgtcagcactggaatatattgcgcaataaatgatttaaggtttttcttgtatagtaataaacacagtgaatcttctaaaattcataactaattcatccgagctccgtttaagcccgttcaagtctcagtaaatcaagaaaaatgtgtagaatccattaaaaatggttttgttccctgtttcagtagtcttatagcctgtttgcaatgtttgccttgtatgtcgctagattccggcactcccgacgctccggtgtacttcgaaatagtcgccgaggttcctccagcagcagagcaaggcaagtcatgcttgtcacttgaacatgttgatcctatattgcaaatgctctattgttttctttcaaatattgcattgttttatattgatactatgggttgtttacctattgtcatagccatgctattgttgaaccatgtctctttgtcagcttggggttctaacatgattagggttaggactagggattgcttagccatgcttagttcaactagttcacattggggaaaatcctattaatgtttagactgttggttctaatggtttttgttggattagtgacaccgctttggtgttggttaattaaaataaatcacatggtgggctgtgggtgcatggttttgctggtcgcgcccatggcagttaaggaccggttcgcgggatgccctggaagaacttatcgtacttaccacaagccagcgtgggcaacggctgggcttgtagtgtagctttcctctagttgacgcatccaggcaagggtgggcgtgatggagcggggcaggccctgtgacagcctctgtcgcttccggattcacctaggcatgagaggggactgcccgttgcccgctggggacgggggtgacacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcactctagtgtaatcttttgaaattggatagtttaggtggatggttgggcctgtcgcaacgtgagttagcgttggacagtggatagttaatattaattaattattacaactgtttaatctttcaacttctttttataaatgctcgctttatgcaaatgaaccactttagctcttctttgatgattccgtgcatcatacccctattccggtatgacttgctgagtacagtgggtagtactcagtcttgctctccttttcccaaccccagagttcgagttcgggtcagatgaaggtttctccgaggagtaggctccgtccgtgccgtcgaggatgcctgtggagtggtgttccgctgcagttctagtcaaggcttagctcctgttgtctttcgtttttccgctgcatttatgtaagactttatgatgtttgtaagacgtggatctgaatgtcaacattgtcgtttgtgtaccccggctggtcctggacgggggttttaatgcacattctgcttgaaattctattcgggaatttctaggcgtgacaagttggtatcagagccgaccttgaccgtaggacaagccaaatggaaaaacctaagagccctctgaatccttttcattgcatatgttctttgcaattggatttattccgggaaaattgggatctgttcttgtggttcaagggaaaaatcttggtcgctcgtttaagtgagatttttcaaaacaagtcagtccagggttttagtaaaactgttgagatttattcgtcagtcagttgggatctgatgggtgaaatgcattaggtcatagcttaggaacatgggttgcaaggtatttatgcttttattgttattattagtatgtatctaatttctcattattttatcgttatgtgagtctgtcttatttattcgctctcatgcaaaatgatctatgcataaaaatttcgctcttattcgattcccttatttgagtttttattgctttatttaaatttggatttgagcatgcattgatcctactcctttgtcttctctagatgggcggccacccacccaaccaccgcggagaaggcatgatcgactttgtggcggagttggcacgtatgacactggtggtgggctaccccaacgcgccagagtacacgacgattccaccgctcagtggcgagcttcctcaccgtgttcgcctggaggtccacggctacgtgggtacctgcctagctaacatggtggttgaggcatctggaggcacagcagatcacgcctgtcaggaggcagcatacctgatcatggtcagagggta

SEQ ID NO: 27621 - DNA, 6565 bp, Oryza sativa
  unsure (1)..(6565): unsure at all n locations
nnnnnnnnnnnnnnnnnnnnnnnnnnnnnnnnnnnnnnnnnnnnnnnnnnnnnnnnnnnnnnntatttatgcttttattgttattattagtatgtatctaatttctcattattttatcgttatgtgagtctgtcttatttattcgctctcatgcaaaatgatctatgcataaaaatttcgctcttattcgattcccttatttgagtttttattgctttatttaaatttggatttgagcatgcattgatcctactcctttgtcttctctagatggccggccacccacccaaccaccgcggagaaggcatgatcgactttgtggcggagttggcacgtatgacactggtggtgggctaccccaacgcgccagagtacacgacgattccaccgctcagtggcgagcttcctcaccgtgttcgcctggaggtccacggctacgtgggtacctgcctagctaacatggtggttgaggcatctggaggcacagcagatcacgcctgtcaggaggcagcatacctgatgatggtcagactacgggagcgccacaactacatcttccacgacacggcgtaccgatttcaccctcgtcgagccagtgatgatgatgtcagcaccttccgtccgacagccggcgagaacgacaccacctttggtcacatgtgtgctgtgatgaggggattggacaggatgcactcggacctgcacaaggcgaccaaggccttgaacgatgggaagctcatgaggatcgtcactctgaaggacgagatagcgcgcctgaagagggagaatgctcagttgaagggtcttcccgcgccaggaggagtccggatccgcactacgccccgcaagacgatgactgcacccgtgcgcatccagcttgcgcccaggaacccacctccatcagcagctcccgcagcacctccagttccgcccgcagttcctgcagctccagctccagctcccgcgtccgctctctccttcgctccagcatcagccgccaggggtccagccagtggcaccggaggttggttgtctgctactcccagtggcagccgcgatctcagcagcagcagctccagtggctcacagtcaggcagcggcgagacttatctgccaggctccgggagtcgctcagagagacctggtgatgagcaggaggacgccttcgactccaccgaccgcaggagccgttccgagcattaggctcgttttccattagtttatcgactgtctagcttctgcttgttagtttgtgtgtttaggctgcttgtttgggggtcagtcgacggtcgatatcatgtgcttatgatatggctgtcttaataaggatttttttttgcttgttttttttagtgttttaattcagattagaacaattgcagtttaaattcctttgtaataaagcttagtttctgagcatctgtttttcttcttttccccgtctgcttttccctccagatggtctacaccaggaatggtagccgcgcgacaggcgagggcagcaacggcgaagagcgcactgatggggcgcatccccacagcgattctggccatggtccgccgccacttcccaagaatccgacgctagcccaagtgatggcacatcagacacagatgatggcagccatgatgcagcagatgcagcagcagcaccagcagatgcaccagcggatgctgcagcacgccgaacagcagcaccagcagtttggtccccctccccctcagtccaagttgccagagtttctacgcgtcaggccacccaccttctccagcaccaccaaccctatggaggcgaatgactggctccatgtcatagagaagaagctgaatctcctgcagtgcaatgatcaggagaaggttgctttcgccacacaccagcttcaaggtcctgcgtcggcttggtgggacaatcacatggccacccgcccaccaggtactgaagtcacttgggcagagttctgccgtagcttcaggaaggcgcaggtgccagatggggtcgtggcataaaagaagagggaattccgggcgctccatcagggcaacaggactgtgacagagtacctccatgagttcaatcgcctcgcgcgatatgcaccagaggatgtccgcaccgacgccgagaagcaggaaaagttcatggcgggtctggatgacgagctgaccaaccaactgatatctggggactacgctgacttcgagaggctggttgacaaggcaatccgtcaggaggatcaacgcaacaagatggacaggaagaggaaggccgcacagttcagagcacctcagggaagtcaccagaggccgcgcttcgctcccgggcagcagggtggacctaccaccatgatcgttcatcagcaccgcccgttcaaccctagcaactttccccagggcgccagtggcagtcagaaccaccatggaggtcagtccaatcacggtgcagctccacgcccaccaatggcaccggcacagacaggcccgcccgcgcaatccaagaaggagactggagcaaaaccagggtcctgcttcaactgtggcgagcttggccacttcgctaacaaatgcccgaagcctaggcgtgccgggccaaggtttatccaggctcgtgtcaaccacgcatctgcggaggaggcacaagcagcaccagaggctgtactgggtacgtttcctgttaactcaatccctgcaacaatactttttgattctggtgcaacgcattcgttcatttcaaagaagtttgtcgggatgcatgggttaataagagaggaacttagcacaccaatgcgggttcataccccagggaatagctccacttcagttcaattcagcccttctataacaatagaaatccaaagatcaccatttctagccaacctcattcttctcgaatccaaagacctagatgtcattcatgggatggattggctgaccaagtttaagggggtcatcgattgtgcgaatcgcacagtcaccttgaccaacgagaagggagaaaccgtggtgtataaatcactagtctcaccaaagcgaggggtctctttgaatcagattgagacggaaattccagtggacactgtggagaagaatttggggaaattggaagatatacccatagtctgcgagtatccagaagtgttccccaaagaccttactaccatgccacccaagagagagattgaattccggattgacttggcaccggggaccgctccaatttacaagaggccgtacagaatggcggccaacgaattagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaatcaagaacaaatatcccttgccgtgaatcgacgatttatttgatgaactgaaaggagctaaagttttttctaagatagacctgcgatcaggctaccaccagttgagaatctgggaagaggatattccaaagacggagatcaggctatatgagtgcacggttatgtccttcggacttactaacgcacctgcattcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatacgccaagttcagcaagtgtgacttttggttgacggaagtcaaatttctgggccatgtcattacagctcagggtgtggcagttgatccatcgaacgtggagtcagtcaccaaatggaccccaccgaagaccgtgtcgcagattcgaagttttcttggacttgcaggttattaccgccgattcatcgaaaacttctccagaatcgcccgacccatgactcagttgcttaagaaagatgagaagtttaaatggacagctgagtgcgataagagttttgaggagctcaaaaagaaattagtatccgcaccagttttgattctgcctgaccagatgaaagacttccaagtctattgcgatgcatcccgtcacggacttggatgtgttctaatgcaagagggcagagtggttgcgtatgcctcgcggcagttacgtccacacgaagggaattatccaactcatgacctggaattggcagcagtggttcatgctttgaagatctggagacactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgctttaagccggaaaagttactgtactgccctgtgcatcgagggcatgtgtgaggaattgcggcaggaatttgagcatctcaacgtgggaattgttgaacacgggtttgtggccgctctggaggcgcggcctacgctcgtggatcaagtcagagctgctcaagtaaacgattctgaaatagcagagctaaaaaagaacatgagagtcggaaaagcccgggatttccacgaagatgaacatggcacaatctggttgggagaaagattgtgtgtgcctgacgacaaggaactgaaggatctgatactcaccgaggctcatcagacccagtactcgattcatccaggcagcactaaaatgtatcaagacctcaaagaaaagttttggtgggtcagcatgaggagagaaatagctgaattcgtcgcactctgtgatgtttgccaacgagtgaaggcagagcaccaaagaccagcaggtttactccaacctcttcaaatcccggaatggaaatgggaggagattggaatggactttataacaggactgccccggacatcatcgggtcacgattcgatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacgggctatcacccgcaaactgatggtcagaccgagcgagtcaatcaaatcttggaagatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttttgggatcagacaggcgagcgtcaactgttcggaacagaggtattagcggaagcagaagagaaagtcagaatcatcagggaaaggttgaggattgcccagtctcgacagaagagctacgcggataaccgccgaagggaactcacttttgaggcaggagattacgtgtatctttgtgtcactccgctccggggagtacaccgttttcagacaaaaggcaagttggcaccacgcttcgtgggaccatacaaaattttggaacgaaggggagaagttgcttatcagttagaacttccatccaatatgatcggcatccatgacgtgttccacgtgtcccaattaaagaagtgcttaagggtacctgaagaacaggctgattcggaacacattgatatccaggaggatctaacatacgtggagaagccggttcgcatacttgataccagtgaaaggaaaaccagaaacaaggtcacccgattttgccgagttcagtggagtcatcattcaaaagaggaagcaacctgggaaagggaagatgagttgaaagccgcccatccgcatctcttcaccagctcctccgaatctcggggccgagattccgtttaagggggtaggtttgtcacaccccgaagttctcctaccaagcctaaaatttagtttataaacgaccccaagaaaatgcaggtgcaatcaagagaaaaccctaagaaagtaatgcaaataataatcggagttgacatgtggaatttttcttgagttcttcatgtcgaaattcattaacaggatttttagtggaattttcagagctctagaaataatttttaaccaattaaaatggagcaagcaatatttttattctagggaaaatcctttttcttttttttctttttctttttcctccctttttcctccttttttcgaatgggccgccggcccattctctctttcctccccctcctccctgctgggccggccgcaggccgcaggccgaggcccagccaggccggccgcctccctcctctccccggggtcgccgacaggtggggcccacctgtcgggcccttccccaacctccggaccgccgcccacgtcgccacagccgccaaaaccgccgctctctctctctcttccccacctccaacctcccacgtcgccggcg

SEQ ID NO: 27622 - DNA, 653 bp, Oryza sativa
aaggttataccatgccaatgggtaaaaagttctggaaaagaagagaggtatgactttgactttaccaaggctgataagatttttgacttgttacttcgggagaagcagattcaacttcctgctggtcatattatactatcggctgaggaacttggcaaaaggaggtattgcaagtggcataattatggttctcattctactaacgactgcaaagtttttagacagcaaatacaggtagccattgaagggggaaagattaaatttgatgactcaaagaagccgatgaaggtcgatggtaactctttcccggtcaatatggtacatagagccggtagaacagccgatggaagcaggagtaaaagtttttagatgaattcggctagaattattaacaagtatcagaggaaatatgacaagcagcaataggagaggtattatgaagaagacaatggcggttttgatcctcgttgggactgtgagtttttcagattttgctggaacgagggtatgaggctgccatctatcgaagattgtcctagatgcagtgatattgcagaaagttcaagccgatctcacaatagaagcaatcggctgaggttgacaagagttcctgttcatcaaagattgggcccagtaaatcaagatcatgatca

SEQ ID NO: 27623 - DNA, 1175 bp, Oryza sativa
atgctcgggacatagcatgtactcgtcgcaaactcgtaccctataaatatcttattctaaagcaatcctgtcgatcatatgacatgtagggcacacgaacgtaggtacgtatatatagtacagggctgggacaagaaagcatccaataatctacatcttatgctgagaagctacggattcaacgagcgagtgctagcgtacgtaagcatgcatgttttcttctactactacttaattaaatcagcattatctaaaaatatatatctgtatcaaaggatgcaagttaaatagactctttcatgactccggttaattatcgcagtcctcactcaacaaaagagtcatatatcatccgatcaatcatggatgtgtcgtaaattaattagccacactttatttaatgaattaagtctttcatctatcaaactacgctatttaacggagaaacattgcgtcttaagactgatcacatgactacaaaatttcatcgtatgccgataagtactgataaactattttatctgcaagattaagttaatgctgacccatgtgattacgttcgtacgtgagctagaaattaaaaaagcagagagaccagcattcttacaaagagtgtttaaacgctctctatctgcatacggtagcccctatataaacaaaccagttgtcgtccagcaataacgaacatcaaccaacacacaagaaaaaccaccagagcctctcttcatgcagatggcgccttccaagagcatcctcgtcgtcgtcttcgccctcttcgccgtcgccgcctcgctgcctccgtcggcggccgccagggacgcccaggtgttcaagcccaccgtcgccgtcgatgtcgtgcatcaggaacaacaacaacaacaacaacctgcagtgaacgccattgccgacgtcagccagccatctacatctctggttggattgccagggcttccgccactggcacctctttcgacgatccaaatcccaggacttccgccattgccgcaacttccgacgatccaaaatccagggctcccgccattgcaaccactttcagcaatccaaaatccggggcttcccccattgccgaacttccgacgattcaaatcccgggctcccgacattgaaaccggtttcgacatccaaatccaagggctccggcattgccgaaactt

SEQ ID NO: 27624 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnnnnnnaagatctagccgatgggtacttacttctgtgtactcggccgatggcgcgatggacggactggcggaggacgacatctctgcgggcggaagtctggccggaggggagattgcttcgaagtcgccttgtgcaccgaggggatcgccggagaaagagaacatgagatttggcttaagcggtgaaaacggaagtaacagtgtgaagtttctcggggacaagtatttaaagcagagcgataatggtcggaaaaatggcaagtgcgatattctctcggagatacgatatggcaaaaacgaaacattaccaaatattccggacttggggggcatgtgttaacaaccaaatttggtaatttcagtatcaaagacaaagataaaatcgaagtggaatccaagatagagatcgtcccgcaagcagagcaagaataagctaaagtccgaatcggctgtgaccaggatcgacagagtccgagctagacaaggtagcccattgagtaaaacccgacaatatgacatggcatacgttgtcgggttggggtaatgtgcttcatgaggattgccatgcatggatagagtcctgagaaggcaattgtatctataaatacgatatttcatgtaaatttcctcgcgaaatgtttgggcaaaagtctgccg

SEQ ID NO: 27625 - DNA, 702 bp, Oryza sativa
  unsure (1)..(702): unsure at all n locations
nnnnnnnnnnnnnnnnnnnnnnnnnnnnnnnnnnnnnnnatatatataggacactcatatggggcaccatggtgcccgggcaccatggtgtgtaatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaattaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatagatgcacacaacaaaaaaaaagtgattggtggacagaaaaataggtgattgacgaagaaaaaatagttgacgatcgataagttataatttttaagtagctataatataagatttgcatgcagaagttgcattacagagacataagagaaaatcagagagttctagcccatcacttccattgctgcagaattaatcgtcacaactatggatagggcagtcaaaata

SEQ ID NO: 27626 - DNA, 544 bp, Oryza sativa
atccttatttgtaccgaattagcaccaagtaagataatgttcttcagatacagaagctggtgatcattccttccattgattttcatattttgcgagtgcagtgaagcttgggatcggcggtttcagcatgggtgcagctgctgccctccactccgcagcgtgctacgctcacggcaaattcgcgaatagcatgccatatccaatcacactcagtgcggtcatcagcttgagtggctggctcccttgctccaggtgccactttgatatccaataatgcagaaatattaatccaaacacgttgtctctactttttcatgactccaatgtttgttctaagaccctgaggagcaagacggagagctcacacatggctgcaagaagagcttcctccttgcctatcttactaagtcatggaagaggtaacacattaagctgttgatccatgaaaagccttccctccagaaacagtataatttactagttaattattactcctagtcaatgcatcagtctgttctaaattctgtatgttcttgcaggggat

SEQ ID NO: 27627 - DNA, 709 bp, Oryza sativa
  unsure (1)..(709): unsure at all n locations
nnnnnnnnnnnnnnnnnnnnnnnnnnnnnnnnnnnnnnnnnnnnnnnnnnnnnnnnatatcactaacacacaaaccatgcttaccagaataaaaagcttacatttttgcacagcaaaatggaagattatttccctcaaattcttttttttacatgaagttcttaattatcagcgtttcagtgaggttcctccaataattctggatgaatgttcagttgaaaatatcctattagacctcacctggaaacaaggaacttgactgtgtcctccacatccttcaccacgcttggttctacacaccgcatcatcactttcctcatcttccaaggaaagccatgcaaataccagtagtgcagagatatgttaacccaattgctacctaacaagatgttaagagtaacttggcataatttatgcaataaatattgggttgctatgtcatgttcactgtaggttttatctgagtttgattattgaatattccacttataggaagctagcaaaaggttcatatatctggcaattcctctaaaatgtatgaaaaacaattggtaggcaattcatatagatgcatcaactttaatctaaagacggtatagcctgtatagtatttaacaattggtgaaccactgaataattaataccaaccagaatagccccaacattcttccaaaaaatgaagaaagagtattatatactccctttgttt

SEQ ID NO: 27628 - DNA, 1469 bp, Oryza sativa
ttttcgtactaatcagattgatcaactgtgtttatgcattggtctgttgtcagtcgaaacgatcgcctccaagcgcagccacgcaccgagacagcccgtcaggtgacgcgcgtgcaggtcgcacttccacgcgagcagcagccctgctggtcgtccgtactggagcgggagcccgcaaggcgccgacacatgcgcatgcacaagcagtgcagattgaaaccagctgatgaaccaagaaatttcttcgtgcaagcatccgtgtgtgatccaatctacgtccacgcaaggatcgatcaacatgtatgatgcatgtaccaatcgatattcaccaacacccatcggattcttcaacaatcggacatcatcacgctgatacgctatgcgttggcatccgcggatcggcgaactttacatcggataaatgagatgagtgtcggtttcatcaattctaatactttgcaatagcgagagtaatatgctagatcatgcctctagttgttttattttctcgcatgaatagatgtatttgtccggcctttgcgccgactcttctcttgttatatcgccgaccacaaagtttggcaccacgcgcccgaacgcgcttaccgtgcacacaagaaggtgcacatacataatccgttgaattgaacgatggagtgctatcccaaacgacgtcaccccatactcggtaacacacgacaccacccagaagttgtcgtctatctagctaatatagtcgttgatctatgaatatattaacacacttgtcatcaccgatcttatggatcagcgcgcttgggacactgttgattgtgacttgtatgttaatccgtcatattgctatctgtatgaagtagatggtaacaaatccgagtcatcggcacctgcatgcgccgccgctgccgcctgcacgtagcgacaccttgacgccaccgcatgacgtcttcccctttgtcaatggttgccgaatcaatccagagactttccctcgtcaatccgccatctgaaacgccgactcgacggcctttcgagaccatctgcaacgcaattgacggccttcgcccgtagcgacgccgaggagcttacgcccgcctcccctcgccgccagtatgcacggcatgcctcccgcactaccgcacgcggccgggacgagggtcgaagccgccgtgagcgcccgtcgccgatagccgtccgccataccagcctgtatgccgagccgagtttcgtcgacacgtaacatggagctatgattgtcggatgccggtcacggcttgatgccaacgaatgccggtgtcggtgctactagatgttgcaccgccgttccgcctctgagcatggcaacttgctatagtcgtccatctctactaagggctcactagcacgtttgccattggttccatccgtcgtctccattgaagaatggcaattggatcatacctcacccacttcttgtgggagaaggtcgtaat

SEQ ID NO: 27629 - DNA, 36955 bp, Oryza sativa
  unsure (1)..(36955): unsure at all n locations
aatcttgcattcgttcttttgagataatattttacaatacacgagttacattatagtttagattaagttcaacatgaagaacatggttaagctcatgtagagcatctttatcttttgctttaggcatagaagcttctgcattagattactgaattttttttttatataggtcatctcaccttacctatattgcctttttttacctatagtaattctttaaccttttgtggaataaaattgtgaattgtatgtctaaaattgaatgtaaatatttgtcttgcctattatttgaagtatttttggcgaatgtattcttattatccactaagcctcaatcaaccaagtaggttgatagttctaagtgcattgacgccatattggcatacatgtaaagttgtttacttatacacatgaacaattagaatatttatggttaagcattgaagcttaaatatatccacccgcaaccacattatttcttttagaaaagtcgtaccatgaagttacaacaaatatgtgggtttcacgacaactattttgtaggttttcttacgattggcgtgaaaagggggaggaatatgtgtatttttgcaatttatttcagaatatttgtgataaagaagcataagaaattgtggatatgtggcaggcaaattggtgtgttataggtcaaatgctagaagcaaaaatagcccaaactattagcgaatcttatttgggataattatgaattattgttacacaatgaagtgtgttatttattggccattgaaaattgcatattcatcaaggaagtatgaaattgcatatagctatttgaaagctattggtttacttgtagtatacaatatcctaaataattaatgaccttttggattcgaatgattctgaatgatcaaatgacaccacatttactttggcataatgaataaaagttagacatatcacccaattaatttattggcatattcaagaagaataaatattctcgtaggataaatgtttgggtgatttgaaaagttccatgatggttaaactatgttcatagatcaatattttagagttatagttatgttcttgaagacatcataaagttatataatactaacacatccatcttatgatcatatctatgttgcataaatataaacatgaagtttattgatccaacttaattcaagaattgaatatagtatcagtaattggatcaagtcttgggcaaataaaaagagctagaaaatagagtaattttgtcgactagtggatatttgtttgggcttcattgtcgcagaataataaccctctatgaattgggataacctacagtattagggatgtgcaatttttcatgccattgcattaatttttatgttagctcactgcatataatatatttaccccctttattttatataagtgcgtgttcaatgaatgaacatttccttcatatatcaccaccatagcatacatatatgggcctccacatgaagttggggatacaaatagaccgaattccattaatccagtgcctatgataggggatttttgtgatatgctattagataaagatcaaatatcggcatcagggggagaaaagcccatgtgttaaagatgccttatattttcaagaagaaaaagatctttataagtaagaataacgcacaagccaaactaaactagaaggtttagtttattctcctataagccagaagcgggagcttgccagataattatgaattaaaggagtaatcaaaagttatgtttacttgtagtaaactttctgctaacagtggtataccctgggttttgaatagtatatccacaaatgcagagtgacatgttagtcaatgttctaaaatctacggggacgcctgcggattctaagatctaatgactattgtcaatgtacccattaataactccttacaactcttgtagagtaatcaccatgaaaaggtgaattgcttcatgaagagattcatcatgaagatgaaaacccagaattaaagcgcgcacatctatctaattctgggatgcggaacaaccatacatcttatgtttgggaaatgactaagatatggtttataataaattaacctcacgaaatgagtatgtggagaaaagaatagttgtcgacaacatcgcctttatgattgctaatatttctctaataagaatccggatccggaaccaaagtccatggcagagttgcatagtagcactcatatcaggtctattgaagaaagcaatgaggttgaaccatagtcgctaaataagtctatgtgaacatggaagttcagaattaataggaaatgaagtggtgaaaagcgacggtttatttggtcatgggaaagactgatattcttctactataaatgtattaaattcggctatatatatcactggtaaaaggcatgaatgaataaatgatatgcagtttatgggttatgaaaatccatatgaagttttcgctagaaagaaaacaatttcgcaacatatatgtaaatctcatactaattagtgtcatgaagcacactatattatcatgaagagaattgcaagactcgtagaagagtttatgatgactcacaaagagtttttctcctagaagtgagaatatttctcatagcagagaaattgacttccggaagaacaagttgatccttgtaggactacgctaatgtatgaatcaccggttaatctccacataacaccaataactcttactcccatgaagtggacagacccgttcaaacgaataaatttgaaaatcacatccactagcatgcaagtggatcggtagttttctacatactatgaaggtgtaagattttatatatcatgaagatatacttatcaatggtatttggcaatcttattaattcccctaatgccaaaatatagaccggtttatgtcactctaagtggtttaagctaattgttgaagattagtgaaacaatcaaattggtaattattgataaatccactaagagaaagttgcataatatttaatctcttgtattgagctaattattttatacataccgcatatgtgtatcgttgcaacttattttcccatagtcctccgtaaggataaaactttgtttgtattgcacatttgaataagtggttatacatattgctcctatacgttgatttatttctcatgttcatagtagaacttatgaaataagtaaacgaaagattaaacattgtggtaattttattttcattattttacacattaataaaaatgtggttatgatattggaacatggaagtttcaacggatctcttcttgagggggagcatatatgctaaacattgattatcatacttaagacttggaagtcttatttttgatttaccaagaattaatcaaattaatcattgttttgataatttaccttgaaggttactaccgctatattgttgtgttaatccaagttgattaatataataatgcatatagatcattagctatttatgaagaatagtcgatcttaaagattatgcgatcaagaagatcatgtgttgtactctttttcccttagtgagtttttacttgaatatttctcacgcaaggtgcaacaagtgcaatataactagcgtgtacgatgtactcctttctcctatccttttctcccactaggtttttggatggagtttttaatgagacatgtgtatagcgcggtattcgtccaagggggagtgttatgaaactattatctcctgccagagataaatatgggctcataccaaatatatggatacgtatcctaataggactcttcctattatgggtatatataccgatagagaggtagagagatatgaatgtatccacatatgagaaagtaataaagctgtgatgcctctccctatatccgtgttcattgtttatctattatgtgcttgtatgagagatcgtcgtcgtctactccggatcagcaaataggccactagttattcaatagaaacaatgaaaacaggttgacagtgatttctctctagaatcttgtcgcccatctcggctaatcttctggttgtaatattctcactacacccttcacagatctactgccatctggaacatgatcatctcttccgttatcttgttgattaccctgcttttgaaaaccaatcgatctgtttccctctttccaaatatcccacaacacaaagatgaattagatcggataccttttctttgtgttgctcatccggcccattcgactgtccgcactagtttcaattagtgatctgttccctgatacagcggctgaaagaaaattctgcccaattcttttgccaaatccctgctccaactgctagcgagtatgagaaatctttcaaaaggtgttgcatcgtccccatgttccaaaacataaatatcaaacacaatagttcttgttcggtcatcctcgactttgtagtcactctgaaatccatagccgattgtagtacagcagccaagcaaagaatctttggttagattgtcctaggtttcccaaacggtttatcattttccttggactaaatgccatattacacaagggtggggtttgtagtatctaactctaaggtgcttagccagcttctatcactatgaactggcgttgatacatgttgcggcttaaaaaccagtgctaattataaatattagtgccaatacgttcttagttataactggcactaatggacaagactacatcatgccagataaaaaactacaaaatggtcttagctacttattttattgtatctacctcatatagaaggagtaataatcgtggttttgctttcatacaaaacggtcttagctacctaatttaatacatccgcctcatatagatgaagtagtaatcgtggttttgcttgcataaataatggtttagacaattgcaggcttgtagctgactcttgaagctcaatcctgtcaccacctggtggtatgctccaactgaacccctgcagaagccttgcaaatagcatcattgtaattgatgttccgagtgacacggcaggacagccacgcctaccagcactgaacgatacaaaacgtaactctggctcagctagcaccacagtaccagtatttttcagatgtcgctctggttggaattcgagtggtttatcccatgctctagggtttcgaccgagcccaattcggcttaacatgacatggctaccctttgggatcatgtatcccgcgacggtggtgtctgcgatcgcgacatggggtgggttgaatgggtggtaggggtggaggcggaacgcctcccggatacatgccttgaggtatgtgaggttgtgaatgtcggattcctcaacaagcctttctctaccaacaaccatatcgagttcatccactgctttcttcatgacctttggattgttcaccatctctgccagtgcccactctacagcatttgatgggttgtccacggtagcaaggattatttcctgcggccataagatcaaattaaaacagtgttggattttcatccttcaaggggcaacctctaatatgcctttaactctttatacaatcaaaattttcatgagaacttttggaaaattgacaacaatattaagtatgtactgacatctactgaggtcacaacagtcaaatctagactggacaaatatatagaaaacagaagaaatccagagatgaacactacaatgttaatgttcatatatagttttgatctgtcccttttgtttcttgatgcgtgggttgagtttagaatgagataatagatatgcattatactagacttacaattcttttcaaacattttcatagctatttttcaaaaagaaaccatagatattttgcacgttcactatcaaatcatcgtaacggttaattttaacttcaaaatgaatgaaacccaccatagtatatctttacctataacgaaccaaaggcctcactaattatttctaaaatataatcgatcacttctagcattagaaatttggaccaaaacataagtacttcaagcatactatttttcttccgaggacatatctatatagtccaagtttgaaaaaaaaattaatagagcttattaccagcgtttctgccttgatctcatctactgacaaaaacggtttcccttgtgcatcctccaaggagatcaacacgtccagaatttagaataaatgttatattttttaataatgtttttgtaatttagaagctatatactcccttcgtcaaaaaaagacaaaccctaggttttcgtgtttaacgtttgaccgtccgtcttatttaaaaaaacttacaaaaaaaattaaaaagacaagtcacatataaagtattaattatattttatcatctaccaacaattaaacgttggatacggaaacccagggtttatctttttttttttttgacggggggagtagtcgttacatttggaatagtaccattcaatactctcaaaatgataggaaagaatactaattactctagttcggtaatactagcaaagtgcccgtcgtctcgccggccgccaacctggcgagcacgctggcatgaaccagctcgtcgttggtgccactgatctgctcccactccccctgacatccgcgcttctccccaatggcagcccgatgaggagcggaaggaggaagatgggccggtaccgatctgatggacgggaaagggaaggaagacaagaaatataagggtctctgaccggaaatgctaaggggcgatcgatcgcccctagagcgctctccacctggtttcctttttttaccgcattactttcctattttagtaaatttatgcacctaaagtttgtacatcttaattttacacatctaaagtctagagatccaaagtttataaataaaaagtttatatatctgatttaaatttgaatttgaattcaaatgttttttatatatagtatttctatacatctaaaatttatacacctaaagtttatagatccaaagtttataggtcaaaagtttacatatccgattcaaatttgaatttgaattcaaatattagtttatagacccaaagtttataagtcaaaagtttacatacctgttttaaatttaaatttcaattcagatttattatatatagtatttccatacataagttttttcaactttgtgttttttattttttaaaaatttatggtgtagtaggaagagaagaaggggagaggaaggaagagtagtgtattggggggatggggggtgattgcctggggcgatcacccgcccattaggcggccccatcactgacagctgggcaccataggatgactcagcaaattagaccaagtcaaagcaccacatcagctaaactgctgagggagacaaattacatcggttttaaagtgaactcattccatagaaaaaaagacctgccggagtgaatttggcccaatcggcccaacaagctaaaccaacccaattaactaaccctaaaactccggctctctctcccactacaaatcgcacgccgcctctctcccactacgcatcatgcgtcattttccctgcaccacatcgctcctctctcccactccgcatcacgcgctgtcgtttttccctgctccacatagcacttcctctttcgctctccgtagcggaccgtgcgtcggcatcgctgctgccgccaccgccaccttttctgccacggttcttacacctcctcctctatccgtacatcgttgttgacgcaagaaacacacactgccctgggaaatctgcttagctccagtgcaggtccaaaggttgacgagatgcgggtgtgccagtcaatttaatcctgcaactgacaagataagcaaatagcagatcaatgagccgatcagctgacaagccgatgtagtaattccagccgatagccgataccagccgatagcgattgggttttgaacaatcggttatatgtccaatgtagataatgatataaaggatgacaaataataataatataatccagtataaaccaatcggctaacaatatgaatagaacaagtattgatatgaaggttaaagcatacatcagctggaggtacgatgtcataaaatccataagattagatagatcaatgaaacctttattgtcatcggctagacccaacttatatattatgcaatccttataagcggatgcaatgtccataaaacatatcgactagcaccccgataaaacactagtatgaacctatcggctcatcaagatttatattatcaacaacaatctagtaggtcggacctaaccgatgtagcacgagattatatatgacaatctaatactcaatgagccgatagatctgtctaatgtgatggatataacaaatctatttgtaacaacattgtgattgtagagatatatcggctaagacagaagattggacctaaccgagatagtcccaactaaaccaatgcgtctctaaacacaatgcaactagagatagaattgagacattaggtaggcaaatatatcaaccaaactagagcgatccaagagatcgaagtgatgcagccttgaacaacaccaatatagccaacagattcaccagggccggcggaacgcagggcttaccccttcgccggaaattgaactgaaccgatccagccccacgttaggtgctagattctgccggttgataagtaaaaacctcggaaaagagggtggcgatgcgccaacagtagtattattgatcgagagatgttttacaatgacctcgggtgtacatatttatacccatgggaagatactagtccttgtaggacaaaaaagaaacttccctaaaagataaaaggaaaacataaagtccttataggacactaaacacactttcctaaagataaaaggaaactaacaaactattcctaattaatagataacttgccatgccacatcctccttgaactcggtcacttctagataagctttctttaatagattaatttccttaaccgaatatagcaggaatccgactattggcgttgcgataattctcttaggggcttaccaaatttccccgctaacacatgccccccaattttagagtatgagaactcatacttgaaaattatcttatgtctgatcttggtaactctaaaattgatcttcctttgcttcttgtaatcggctttcatgagccgatactgtttgcattagatgagccagattgtcaaactcgtggcaaaagaatatatctatgataggtgctgacaatccctggaatgcaagatctgctagttgctcatcacttaggtgcaaaccataacatcgactgcggatattacgaaatctcttaatattttctatagccgattctcctgcttgttgctgaactgatatcaaatctgaaagcttcatctcatcgacgccagcaaagaagtagtcatgaaatttcttctaaagatcagcccatcctatgatagaatgtgatggtagagatgaaaaccatgtgaaagccgatccagccaaagacaatggaacaaatctaacttttagagcttcttcagccgatacctccccacattatgctaagaatcggctaatgtgttccattgtagatgtatcatcctaccctgaaaacttggagaaatctggaaccttgtatcgatgtggcaatgaaaccctatcaaaccactcaggatatggtagccgatacacagaagtatgttccttaggtttgattccaaaccactcctctattatctttgcaattctatcggccaaatcttctccataccgatgtatttgaattccctctgaccgatattgttgatatgcctcatcatgtcgatactgatatgtttaccccccgagccaatattgttattgttctgcaatctgccccccaagctgacgtctttgaacaattaactcatcaactgtcaatttgatcaaattttgcaatgtatccgccaaaacttctgattgataaaatactagtatgaacctatcggctcatcaagatttatattatcagcaacaatctagtaggtcggacctaaccgatgcagcatgagattatatatgatgatctaatactcaatgagccgatagatatgtataatgtgatggatataacaggtctatttataacaacattgtgattgtagagatatatcggctaagacagaagatcggacctaaccgagacagtccccactaaaccgatgcgtctttaaacacaatgcaactacatatagaattgagatatcaggtaggcaaatatatcaaccaaaccagagcgatccacgagatcgaagcgatgcagccttgaacaacaccaatgtagccaatagatttactagggctggtggaacgtagggcttaccccttcaccggagatcaaactgtaccgatgcagccccgcaccacgtgccagattccgccggttgataagtaaaaacctcagaaaagagggtggcgatgtgccaatagtagtattattgatcgagagatgttttacagtgaccccgggtgtacatatttatacccatgaggagattctagtccttgtaggacaagaaagaaacttccctaaaagataaaaagaaaacataaagtccttatagtacactaaacacactttcctaaagataaaaggaaactaacaaactattcctaattaatagataacttgtcatgccgtattcttcttgtactcggtcacttctggataagctttttttaatagattaatttccttttccgaatatagcaggaatccgactattggcgttgtgataattctcttaggggcttaccagccgttttggtcaaatccaagcagcgtgcggtggggaggtggaccgagtgcatcgggtttcatctgagccaccgatggtcgtctgctcctccctgttgccccctcacgccggccaatactcggtgactcaaggtgagggtatggactatgagcagcaggaccgttgatgatttcaccgatttttatttcttcatttttctttttcaagtattatcggtcggtttagttccgatgcatgttagatttctgattgctcaatgggtttcttaatcgatgtttgatgttgtgatttgtcctccttatgcgattaggattttatatggatctctgattttttttttctttggccaccgaacgcgattacatgcttgcggagatggaacacgccgcttggtcggacttatggaaaaaaaaaattgtaacgatcagaaagttactgatttttcaattaattaagattaagatttggaaccttttcaacagaaaactattttgcctttttttgaaattttcatcttttttagtttagaacaatttatttaaatgtgatcaaattttgttcaacattaaaaattttattttggaccaaaattactacaattttcgaattttctgtcctatcagcgcagccaatagctatacacaaaccgatatatattaatcactgggcatgatgatgaagaggaagacgaagatgataccaacatgagagatacggaagttaatgaaatagtagaagatgcaaacacaatattctctaatgagaaaataaataaaacaatacagaagaaatctctaatagaataaaataaatatataccaaataaaaaatacgtaagggttctggtaaaatttagatgtcaaaatttagaggttagatgatacgtatagtaataaaagatagcaatcaaattgaactatattttgatggccgtattcatggtttcatcttgaacagtgatgaataaattccttctagaatactgaaataatagagattcgagaccatgtaccaagtccaaacctgtccttccaagaggacctaattattcctctgctgccagactgatagtacctaatttaattactcctccatgcacggtcaagagaaagacgtatacatctgaattcgattgatgatagatcccagcttttctacccccagatcaaactggtgacctccaatcactaccatctttgatcggtctgacaaaatccacaatagtctcggttccaaaaagaaccgagactaaagattgtttttagtcccagttataaaaattttgatctctagtcccggttcatcccctgtcagatgcatgtcagggggccgaggatctttagtcccggttggtgtcaataaccggcactaaaatcaccactttagtcacggttggtaataaagatcatctagatctttagtcccggttggtattatcaaccgggactaaaattgaacacgtagtatataatacctatcccttatcctcttctccacagttacaacttagcggatcgaatctctccccctctcctcagatctctcctctctaactctcttcgtcatcccctctcctccacctccccttactcctctcctccccctcctcccctaacggctgccccctcctccccttcacattcagcgggccggcaggcgtcaatgccgcgtgcggcagcgtgacgaaggcaggcaaggccgcgcccggcggagggcaacgggacctcggcaggcggcgggcggcggggccacggccgccggtcgtggtgagcggcggcaacggcattgttttttctttttttttaatttgtgattcactgagatgtacaaatttgtgattcattgtttggatctgtgatgtatttgagtaattttttaggattttgtgatgtatttgatttgtgtgtataagtaactttatgatttgtgatgtggatttggtgatgtgaatttgggatgttactttgatttagggatttgaggatttgcctacttgattcgggagaaaataaaaagaaaaaaaagaaaaagaaaaggggaccatctggtaacatcaaccgggactaaagagagaggatctttagtcccggttagtagtaccaaccaggactaaagatgcatctttagtcccggttatttcaaccgggactaaagatggacatctttagtcccggatcgttacttccggttggaaaaccggactaaagaggattcccaaccgggagtaaagatggtttctctaccagtgaatgctttcataccaatcaaccaatcagaacaatctgaccttagcttctatctcaattcgaggggacgcctctcaaccatacacagatgcatgtactccctccatccacaaaagttacacctattagagcaagtataatagtgagctataagcctactatatgcttttgtggagaagagaggtaacaaaaacttaagggggttggttctcatgcaagagctatcttaacacaatctccgagataaatacattaaatttataagtgagagatagagagaggaaaagaaaattgtagccaaccatatagctaatctattatatgtgttggttttaagattggctaatagtaggaagtaagctatactattatgcttgctcttacatttgtcaccaagacaaaaaaaaaataaatcatcttgtatgttataaaatcaaggagtgaatgcaatcatgcaaccaaaaagtatttagatgactccttgggttctaatcaaacatttaatttatctcctaatttaaatcttgaatgcataaagactataaatagaaacaacttatttgtaaaaactaaaatgtgaaatatgtctatcttttatatggatggaggaagtattgttttcgttagtctatctgtctggcttcttctttctataaacttaattacttcttcatatttctggcttcttctttctgtaaacttaattacttcttcctctgggacaccatcttctgccggctagatgccacacaaataaagtacaattcatcgaatattgactccaggatctgctgtcagctgttgcatggatgcattcaacaacacaaatgcacaatccatcgaagttaattccagggttctagtttctctaacctttgccgtccatatatacagcttcagatcatgctgttttagcttccaggattttgttaatggcgaaggatgtcgtcatggccacttctcgggtcaggacagagataaattagtgagatgatatttacgaatatagatcagaaacttgcatgatgagataggtatatggttatgtattgtttagatgggctctagatggggtttaaaattggatagagatagaccgctttaaaggtgttatgttcgatttgatttatgaccaacggtgaagattatcctatctatttaatcaaaggacacattttcctacttaacgtgggactcgtagaaagtgacctagtatagctattcatatagatggtatatattgggaggtatgtctctactcaacatttaaatactaaatcacctatccgtgttgaaacactaaaatagtaaatacgggagacgttgtattcaatgttagataacaaaatattgctttcaggttacaataagggaaattcatgatatttatattttcatcatagaggattttttcttgttccctcccatttggtaaatattgtaactcaaacaatagaaaaatagagattgaccataccacaaaacaatacatatgtgcatgtaaatcatcggaattcatgtatcaatagtaggggcaacaaccatggatggatcttactagctgcaaacataatttcttttgtggttcaacatctcgacgtctaaaatttacaggtcagatgataggcagagatatctagatgtaaaaaaatttatatacagtaataaaaagtagcaatcaaattaaactatacttttgtgtccatattcatcatttcatctcgaacaatatgaataaattcctttattgtaataaaataatggagactcgagactttgtccaaagtccaaacctgtccttccaagagttcattattattactatgttgccagccttatagtacctaatttaattactcctccatacaggggcaagaaaaagacgtgcctcttaattcgatggatggtacatccattcatcccagcttttctgcccccagtttgaactgtcgacctacaatgcttttatacgaatcagccattcacggagatcaatctgaccttagcttctacctctacttaactggacgtctctcgaccatacaaagatgcatgcataattttcgttaacctatgtgcctggcttcctctttccatgaaaataaattatttcttcctctgcgacaccatctgctaccgcctagatgccgcacaagtacagtacaattcaccgaatgttgactccaggatctggcataacccatcgtccagatgcattcaacaacacaaataaaaaattagtcgaaggttaattccagggttccagttcctctaacctttgacgtccgtatatacagctgcagatcatgttgtttttgcttctgcggttttgtcaatggtgagggagttcgacatggccatatcttgagtcgagacggggataaattagcaagatgatgtttacgaataaaaatcaaaagcttcaacatgagatacatatacggttatgtaatggttatatgggcattaaaattggatgaagatagatcgctttaaaggtgtgatgtgcgatttgattatatgaccgacgttatgattgtcctaactatttgatcaaagggcatattttcctagttaacataggagctcgtagaaagtgtccaattagtatttgtatagatataaaaggtatatatttggaggtttctctttactcgacatttaaatgttaaatcacctatcagtgttgaaagactaaaatagtagatacgggacatcattttatggagatcgttttattcagtgttaaataacaaaaaattgttttcatgttacaataaggggaattcatgatatttatattttcatcatagaggattagtggttcacgttcaattttgttctttcctcccatttggtaaatattgtaactcaaacaatagaaaaacagagattgaccacaccacaaacaatataaatcatcggaattcatgtatcaatagtaggggcaacaaccatggatggatctccctagctgcaaacatcagttcttttgtggttcaacatctcgacatctaaaatttacaagtcagatgataggcagagatatctagatgtcaaaaaatttataaacagtaataaaaaatagcaatcaaattaaactatacttttatggccatatatattcatcgtttcatctcaaaatataatgaataaattccttctattgtaataaaatagtggagattcgagactttgtccaaagtccaaacttgtccttccaagagttcattattattactatgttgccagccttatagtacctaatttaattactcctccatacaggggcaagaaaaagacatacctcataattcgatggatggtacatccatgcatcccaacttttctgctcccagtttaaactgccgacctccaatgctttcatacgaatcagccaatcatggagatcaatctgaccttagcttctatctctactcaacgggacgtctctcgaccatacaaagatgcatgcatagttttcgttaatctatgttcatggcttcctctttccattaaaattaattatttctttctctgcgacaccttccgctaccgcctagataccgcacaagtatacaattcatcgaatgttgactccagtatctgccataagccgtcgcctagatgcattcaacaacacaaatccacaattcgtcgaaggttaattccagggttctagtacctctaacctttgccgtccatatatacagctacagatcatgttgtttttggttctgcggttttgtcgatggcgagcgagttcgacatgtccacatcttgagagtcgagacggagataaattagcaggatgatatttacgaatataaatcagaagcttgcatcatgagatacgtatatggttatgtaatggttagatgggctctagatgggctttaaaattgtatgaagatagatcgttttaaaggtgtgatgtgtgatttgattttatgaccaacgtgatgtttctcctaactatttgatcaaagaacatattttcctagttaacgtgggagcttgtagaaagtgtccaattagtattgatatagatataaaagatatatatattgggaggtatctctctactcgacatttaagtgttaaatcacctatctgtgttgaaagactagaatattagatatgggacatcgttttattcagtgttaattaacaaaaaattgttttcaggttacaataagggtgttgatgcgaaaaacacacactgacctggtagatttgcttaactcctgtgcaggtcctaaatcttgctcttgggttcaaaggtgtgccagttgatttgatcctgcaatcaacaagaaagaaaggcaagaaaaccgtggttaaatccataaacgatagtcgatcggctgatgccgatgacgtatcgttcaaactatgggccgatgttattagcaatagatcagcaatgaagaataaagcaatataaaactaaatctactcgatcagctgtagatattaacaatatataatccttttctcgatctatatctggactaagtgattgggatagatcgaatagcacgtcgagacagtataaatcacatagatccaaagatacattaagatacgattatatgaacgtttatagcatagccaatcagatagatctagcatgtatcggctaatactccaataccactctatattaagatattaaaacagacaaaatatatcaaacagaaagcctaatatattctaatgcaataagatcttaatataaagggcagatttagcatgacaattaagcatataaagtacaaaatagctaaatcaggtaagatcggctgaaactccgacactatcctcgttagagatcataaaacatgcacatgccagatattgcaattatgaatattacttaatagatcgaactcaaccgatgcagcattaagcataaaaacaagtgcaaaatctaagcaagatagtgataacttcagaaagatggtagatatgcgatataatctagattaataacaagatctaactttatcggctactctttatcaggaaaaactagccgattgcgagttagataacgcaactaacaaagattatgaagcatatatgataactcgacaaattacataaacaagattagtgtatcttaatgatggaagcactaatcccgacaacgcaagctgccatgacaagtttacctcttgttgaagatcgaaatcgatgcagctcaacccgagagcaagaactcgtcgaaaacaaacgaaagtaaaaccgggtggtgatgcgtcgagagttttattgaactgttgttgtcaattacatgggttcgggttataattataccctagatacatgataggtccttgccggacacgactcttatctctaacaaactctaagatacacataagtctttacagtagacttttgcccaatcatatctctaagaaaaccacttgaaatatcctaattaatagatacaattgcctatctgagagcttatctccatcgtggcaatcctttcgtagcacgttgatcgattgcagaaacggttttataaccatctcaataaaatcggttgtatcggctgtcctctgtccaatccatctcagccgatgtagacttcagctaatgctttgccgaatccacttcgattccaatgctgaacctggttcataatttaccaaatttggttgttaacaaaggggaattcatgatatttatattttcatcaaagaggattagaggctcacgctcagttttgttctttcctcccatttgataaatattgtaactcaaacaatagaaaaacagagattgaccacaccacaaacaatataaatcaacggaattcatgtatcaatagtaggggcaacaaccatggatggatcttcctagctgcaaacataatttcctctgtggttcaacatctcgacatctaaaatgtacaagtcagattataggcagagatatctagatgtcaaaaaaaattatatatagtaataaaaaatagcaatcaaattgaactatactttgatgttcgtattcatcgtttcatctcgaacaataatgaataaattctttctattgtaataaaataatgaaggttcgagactttgtccgaagtccaaacctgtccttccaagagttcactaatattacaatgttacctgccttatagtacctaatttaattactcctccatgcatgggtaagaaaaagacgtatatcttaattcgatggatggtacatccatgcatcccagcttttctgcccccagtttaaactgccgacctccaatgctttcatacgaatcagctaatcatggagatcaatctgaccttagcttctatctctactcaacaggacgtctctcgaccatacaaagatgcatgcataattttcattaatctttgtgtttggcttcctctttccattaaaattaattatttcttccactgcgacactatcttctaccgcctagatgctgcacaagtatagtacaattcatcgaatgttaactccatgacctgtcataagccgtcgcctagatgtatgcaacaacacaaatgcacaattcatcgaaggtgaattccagggttctagatttttctaacctttgccgtttgtatatacacctacagatcgtgttgtttttccttccagggttttgtcaatggcgagggatttcgacatgggcacatctcgagtccggacagagataaattagcaagatgatgtttacgaatataggtcaaaatcttgcatcatgagatacgtatacggttatataatggttagatgttctctagacgggctttaaaattggatggagatagatcgatttaaagttgtgatgtgggatttgatttttgaccaacggtgaagattatcctattgatttgatcgaaggtcatatttttctagttaacgtaggagctcgtagaaagtgcccaattggtataggtaaggatataaaaggtatatattgagcggtatctctctacacgacttttaaattataagtcacctatctgtgttgaaagactaaaatagtagaaatgcgagatcgttgtattcaatgttaaataacaaaatattgttttcaatatagagattgaccatactacaaacaatacatatgtgcatataaattgacggaatacatgtatcagtagtagcagcaacaaccatggatggatcttcctagctgcaaacatagtttcttctatggatcaacatttcgacatctaaaatttagaggtcagatgataggcagagaaatctagatttcaaaaaattaaatatgttaataaaaaatagcaatcaaattaaaatgtacgttgatggttgtattcattgttttatatcatacaatgatgaataaattcctcaaactggcgacctccaatgctttcatactgtcacacccagaaattcactaacccaaatttcaagcagaatgtgtattaaaatctctgtccaggactagccagagtacacagacgataattgaaaaaatagatctacatcttacaaaaataataaaataattcttacaaatgcagcagaaaaataaataaactagacttaatcttcacgaccaaaagcatagcttcctccataaaccacaggcatcctcaacgttcagaacaaactcaatcctcatagaactcaccatctaaaccaatctctgcctcttgtggggaggaataaagcaagactgagtaccaatcatcgtactcaacaagtcatactaacgggaaggtatgatgcaagaatggcttattggatatttgcaataaaagtagcatttataaatcatattttgaataagtaaaataatatatgtaattatgcaatattaaatcattactttccaacgctaaaaccatgttacaacagatccaaccaaaccacctgaattacaccagttcaataagtcatattattacagtgaaactaatcacggtgagctggttgaccgcccaataaccgtgggcacggcaattcgaatagttttaactccgataagaggtgtacaactttacccacatgacatgattccacacatgttaccatgccccgaagtaccgccacgatactgcaaagggggaaatcgtgacaaaacccttcatataacccaccctaaccaagcatacccacatcaggtttcaccccctccttattccatgacgggcagtcccctctcgtgcctaagtaaatccagaaacaacagagaccaaaatccaggcccgaactgcaccatcgcctctacccttgccacggtatgtcaactaagttaaagttaagttatactctagatttagccttgagcccacgctggcttatggtaagtatggttagggaaagcggctaaggcggcagcagcttggctcggctctgctggcagcacggctcagggagacggcagggcagcggcagctggcacacggcagggcagggcagcagctgccactacaagagatcttatgatagatgacgcttcatttacgtcacaaacattgaatatttggtcacgtttcataatctgtgacgctcgcgtgacgaaaattcattcgacacctatcatgcgtctctaatggcgttctatgacgaaaccttatttttttcgtcattaatcgattgacgatccttctgtcggcataactttgtgatgctcatattcgtcattatctagctaaaaaacgttataaaatatctgatgacccattaaaatccatgtattgagcaccctgtttatgggcttagcccaatggcaagcccgactagattttagcctggcccatctatgatgtagcatattttcagcccaattctattatatccatttgcttcaatatcaaataataaatgggccaagtccattgcaaaagcccatacatgcccaaacattataccacaccattttcagcatgtcattattttcattatgttagtatcaaataacaagtgggctaagcccatataggcccaacaatcaaacacaataacaatccatatagcacaagcccaattagcatccaacacaacccgacaaacatccaatacaacacaaaatttacaacacagcaaatcagcaaatcagctggttggccactcgtgggaagtgcttgaactgcagcagggacaggaagtgcttgaattgcggcaggggcctcaccttcctcaggaaccccctatatcaaatacacaaagtgcaatagattagtcaccgattgactcattacatgataaaattgtgcctaaaaaatagctgaagtggaagaaataagttcaaaggagagaaaagggtgcaaccattgtttgaaataagtggtttcccgttgtccaagagcagataccaacgcatgcatgacaagaagtgcctatgtcgcttaaaattattttttgatctgtttattgttattattttcaacaagtcattgcaaaaacttaaataacacagattaacatctttctgagtttaaaattttgagactccttatttattttaaaagttttgacgacataatagctcatcaggaagtccaagcaacaagacatggaaaaaacataaatggatatgagtatgtccaattgtcacaaatatcttcgaaaaccaaatgtattaaagaacatgatcttattgcagatcaaaacgatgccattagcttgctatcttaacagttagtttgcctttctattcatgtacctttctactcatgtaatgctcaagctttaacagaaaaatgcaagaacgacaggaaccggtaagcacatagcataaataactaatcttctgtttataccacatatgcatatgctagcaaggtttgcacacaaagccctcattccctaaatgtttgacgccgttgacttttttaaatatgcttgaatgttcgtcttattcaaaattttttgtaaaatatataaaactatatatatacataaaagtatatttaacaatgaatcaaataataggaaaagaattaataattacttcaattttttgaataagacgaacggttaaacatgttaaaaaaagtcaacggcgtcaaacatttagggatggagggagtataatatttgtacaccacagattcacagttatagcagcatagctgcgctataatgtacagctccattatccatttgcaaacaagcctaaatagaagaataggcattgaaaaatacctcaagtaatgaagtttcggcaataaatcacatatatgaatcagggaggatagatatacatagaatctgaaaaaaggagagcaaggattgattagggactagggaggattgaatcgggaggaatgccacttgcttgttgctgctgttgctgcttgccttccgcctgttgcttcatgcctgctgcctgctgcctcgccgcttgctgctcgcatgtccctgccgcgtagccgcgccgccggacacgagcgctggatatgagaaacacataagattgttgacaaacaacaatatactatattcaaccatgaaactacttttgaggtgctcataatcccaggcgcccaacaaacgaacctaatattgcatcctcgatagatttacaggctttgagccttatgagcttcttattagatagagctatgggctttgagcccaaaagagcttctgagagctcatgagctagctagatctcggcttgttaagaagataccgactcgtttaattaattttacgagtcgagttgagcccataataagaagatgagaacaagcttaagcttttacagtaagtttgtaactgctaattggcatgttcttgtcaaaaacgttttctaagtggccatttttagcaacaggactaatccagaatgcatatacatgtaaatattattcagtaagtaagttttttcaaggcaatcatcagtatgtatgtttattttttcttgggatgtatgataaagtggttatgaagaactttggaacataaacggggtaaagaaagttgtgcagactcgtattaaaaaaagacagaattttcaaagaatcttttctctgaagcatactttgtcggtcttcatctccatgctcagttacttgagcgacctgctaacctcgtcagcatgcagagatccagagttagataagccaagaaatctgcacatgaaaaaagtatcacaatcttctttcatctgcatgagaaaaaggccaagagaacttcccagtttgatcagtttgggagaactaatgcagtttccctccctctgaagaaaggtagtcctatatctgaacaaataggatttttaatagatttatccttgcgatatgcccttgatgtgtttaaacatctgaataaattttgctccatgcatctgaaattctaaatgtctgatgctgcaatgtcgtgctaattgatgttattttattaagattgttccagtccagccctcgatggttggtactactacattacaggttacaaattacaagtctttgcccttttcatttttttttaaaaaagaagagatgataggaaaaaagaacagacctagacaggctactgcaagagaggacatggtgaagcagcagcagtaatcagccaccgccggtgctggtgacgccgaggtctggcttgccgtcgtcctcgctgcttgtatgaggccagctccaagaacccccgctgcttgctcctgtacagcagcctgcgcagcacccacccgaacacaacacgcccccccccccccccccgcgtcaacagggtgggggggggaaggggggggtgagatgcggcggcggctctcgtcgaaggagaggtcgatggtgctggtggtggcgccgttctgctgggtggtggggatgaagtgtgatcatcctgtctttcttagaccggacccacttaaatctagtagcttccataccttttataggtcataaactgtcctcacaagtcttttctgcacactttgtcctcactcgtgtgcacccgggaagaatttaccggtctgtcacctatctcaaattactccagaccaagtacgcttaacctcataattctttgaagaccagcttccggaaaagaagttgcaacctgttgatatgagtattctattaatcctattaagccctgggccgggatgttacatgaagccagagaggacgtggtgggctgggaaggccgcggcgaggaggaagagggcgccgacgcagggaggggagcacgcagcggaggtggaggtggagtgcacggctgccgaccctagcggtcgtgccgtcgtcggcgaacgagaggaaggacgaggcaggaggagggggtcttgtcgaatcccgcggcggtgcgggaagagaaagaggaaaggcgcttgtcggggtcactccaccacggcacctggtcaagcgtcacggcaagctccacctcgcccacgcccaccgccgccgccacgaggaaatttatgtaaacccatataagagatatgtaaattttatgaacaatgttcctatcggtttgtcgaatgatgaaataaccaaaataaaagttatagatattgatgagtaatacaaatttgttattgacgactttttcagttgaaatcatttagtatttgaaaatgttgtttgaaattgtcataatttgaaattcaaattttatataggtcaatcaaactcagatggagaaataaccaaaatacaaaattggtagatctcaataatttatacaactttgtttttggcaactttttcacataactttatttagtataataaaattcaattcaaagtttttaatattttgaaattaattgagaggagggaggcaaaatggacttctggctggagggaggaggggaaggagcagcttggcggctgggccggctggttgagtggcgcggcccatgaaggagtagaggaggcccgcagggccggctggttgagtggcgtggcccatggaggagtagaggaggcccgcagactcgggccgaggtgggccgaggagaaagtggggagagggaagggaatgggagtagaaaagaggccgagcgggctagcggggagtagaatcagactttgggacggattcagcccaaatgacaaaggaggattgtttttagtttttctttttaataaactctgttaattttttttatcgcttaataaatatttcggtgctctgagaaaattcaagtaaacatccaggacatattttagaccgaggagaacttatgaaagatactttgggtcacattcaaattttttcttgcacgtattttagtgtttagcattttcttttaggattttagtttattatattattccttttagcgaataatttttaatttgggtgaatttatcaggatgtgacaattattttagtgcgttacaaagggcagttcaagcattcgtcattttaaaaagaaaaaaaacatatgataaaccaacattgttatgaacttgtgacatttgttggttggtctcttatgacaaaataatattcattacaataaaccattagactagtttatgatgatctgtatttgatcttagtgacgacaaccccaattttgtcactaatcatcatcatctgttgatgcgaaaaacacacactggcctgaaaaatctacttaacttctgtgtaggtcctaaatcttgcttttgggtttaaggcgtgccagttaatttgatcctgcaatcaagaagaaagaaagacaagaaaaaaccacagtcaaatccataaatgatagccaaatccataaatgatagccaatcggctagttgccgatgacatatcatttatctttgagccgatgttatgttagaatcgatcgacagtaataaatgaataagataagactaaatctactcgatcggctgtagatattaacgacatataatctttccttcgatgtatatttaaactatatgattgggataggtcggtcgccatgccgagacagtataaatcactcaagtcaaaagatacattaaagcaataattatataggcatttatagcatagctgatcagatagatctagcatgtatcagctaatactccgataccactttatactaagatattaaaacaagcaaaatatatgaaacaagaaagcctaatatactctggggtgataagatcttaatacaaagggcagatttagcataacagtcaagcatatgaaggcaaaagatagctaagtcaggtaagatcggctgaaactccgacactatctcaattgataatcataaaacaagctagatattacagttatagataatatttaatagatcgaacttaaccgatgcagcattaagcgtaaagataaatgtaagatctaagcaagatgatgaaaacctctaaaagatggtagatactctgtataatctagattaataacaagatctaactctatcgactactctttagcagtaaaaaccaaccgattgcgggttagatagaatcactaataaagattataaagtgtatatgataactcgacaaattacataaacatgattagagtgtcatgaagatgtaagcactaataccgaaaacgcaatccgccatgacaagtttacctctagttgaatatcgaaaccgatgcagctcaacccgaaagcaagaacatgtctatacaaacgaacgtgaaaaagggtggcgatgcgccgagattgttattgaactattgttgttaaattacatgggttcgggttatatttatacccgagatacatgatatgtccttgccggacacgactcttatctctaacaaactctaagatacacataagtctttacggcagacttttgtccaaacatatctctaaggaaactatttaaaatatcctaattaatagatacaattgcctatctgggagcttatctccatcatgaaaatcctttcgtagcactgatcgatcccagaaacgatttcataaccatctcaatgaaatcggctatatcggctgtatcggttgtcccctgtccgatgtcatctcagcagatgcagactccagccgatgcctccgcagccgatgcgcactctgttcttcgatcacaacccctttgccgaatccacttcaattccaatgccgaacctagttcatcacttaccaaatttggtcgttaaaacatgccccccaagtccgcgatattggtaatgttgcggatttgctcaatttccttcccgagtagaactagggtttccatctccgattccgttttggccgttaccacgctttcttttaaatagtaaccactgcttggcacttttcacagcgtcagcttccgttttaaccgctctagccaaaactttccccaatctcttcctcgatctttccggcgacatctttgagctttccggcgatcccgcaagcgactcccagcagcgccgacctccatcaccgacaatgtcgacctccgccgatccttcgagcgcgccaactgccgagtacgtcgaggtaggtaccatcggctaaatcccctcttttacgtacaagattggttcttctttcgctcaatcttcgattttctttccctgtagcatctttctcatcaagttgcggttcctagcataaccgatgagcattaattctttcttggtccaatcggcaacccaaaccccaccgagttcatcaatggtgagaccaaccgaatcccctttagatttgccaaccccgatttaagtctctggaagaataccttcaaatcttggccctcagccgaaaaaagctagccagcttggtatatgagggtatcagctagcaagctaactcactgggcagaaattggcatagtccaagctttagctctgactgcagtagatatagccaaagatgaacccatgatgacagctgcaacctatttctagtccactaccatgaatgcctttctcttttcccaaggaccgatgactcccactctcctagatgtcacaatgataattggcctagatataacttcatcggctaacccggtcagcttgaatacaacatccacctttgagttcaaaactcagaacataggtggctggtcaggttttgttgcaaaaaacatgggcaatgggccagtaagtccaagggaacatacattcttccttctgatgtggttagaaaaattcttgttttgtggcctgagctgtggtcctactgccaactggcaacacatagctgaaaacctagtggagaagaaacaactccctcttggaatgtatctgttaggctatttgtatatcctgtacaatctaagccaacatagatatttaacctaatcggctgccttccaataatagatgttagccgattgaaggttagataacgatattgtcgaagattatacagaatatatgataactcgacgaattacataaacaagattagagtatcataaagatgaaagcactaatcccgagaatgcaagccgccataacaagttttacctctagttgaaaattgaaaccaaagcagctcaacccgaaagcaagaactcgtcgaaacaaaacgaaagtaaaagggtggcgatgcgctgagattgtattgaacgtgtgttagattagttacatggggcttgggatctatttatacccgagattacaaaacatgtccatatcggacacgactcttatctctaacaaactctaagataccataagtctttgcggcagacttttgcccaaacatgtcgccaaggaaattacatgaaatatcctaattaatagatacaattgccttctcaggactctatccatgcatggcaatcctcatgaagcacattaacccaacccgacaacgtatgccatgtcatattgtcggattttactcaatgggctaaccttgtctagctcggactctgtcgatcctggtcacagccgattcggactttagcttattcttgctctgcttgcgggacgatctctatcttggattccacttcgattttatctttgtctttgatactgaaattaccaaatttggttgttaacacatgccccccaagtccggaatatttggtaatgtttcgtttttgccatatcgtatctccgagagaatatcgcacttgccatttttccgaccattatcgctctgctttaaatacttgtccccgagaaacttcacactgttacttccgttttcaccgcttaagccaaatctcatgttctctttctccggcgatcccctcggtgcacaaggcgacttcgaagcaatctcccctccggccagacttccgcccgcagagatgtcgtcctccgccagtccgtccatcgcgccatcggccgagtacacagaagtaagtacccatcggctagatcttcttcttccgcagcagattggttttcccttgcttatcttgttttcttcttctctgctcttgtttgcatctgcagcacttgtccaatctggtagcaattccaagtttgtcacatgaaaaccactattttcttggtccaatcggcaatcttgatcctactgaattcatcatcgccgaaaccaatagaatcccctttagattagccaaccctaatcaaggtcattggaaaaacatcttcaagtcttggccatctcttgagaatcccccccccctctgagaaaagctgggccatgtggtataagcgtgtatcagctactaagcaagttcaccgggacgaactcggaattagccaggcactcgccctcaccacagcaaattcggctaaagatgaacccttgatggccgctgccacctatttctggtccaacaccatcaatgccttcctattcaaccaagggccaatgacccccactttgctcgacatcaccatgatcacaggtttggatgtgacctcatcggctaacccaatgagcttgaacaccaagaaccagtttgacttcagaactaagagcataggtggttggtctggttatgtagcagcatatatgggcaaaggatccgtcacctcccgagaacatgtagccttcttactgatgtggcttgagaaattcctcttttgtggatcaagttgcggccctaccaccaactggcagttcttagctgaagcccttgagacaaagaggcaattccctttgggcaaaatccttctcggctatttgtaccaaatgttaaacaacgcatcggctaagattgctgtcggctcaatcgttagcgcaggccggccatggtggttgctgcaaacttggctaaacttggtagccatgaaagctgtcaatcagccagccgtaacagaagctgaatttccgagattagagccgatcacaaatgatgatggagaagagcgcacccatcacagatgtatgtccgatggggagtatgcctccacaccagccgatgctggagcaaagttatcagccgaactgctcaaagactgggtctgcagtttctatgagggtttccaaagagatgctcgagtctggtttccatacgaggacttaataaactttgatctcccaggagactttagatttgaagacctcaactctgaaaagtatcaaaaatcaagagaagtcttctcaactgccattagcccatgcatctttcatattagcaccaaggaagaaatatacaagtgtcctatgaattctaccatccgatgagctcagctaggcaatttggaatgggacagctaccaatcggcttgttctttgccgataaaatccaatgccgaggagagatttcatcaaccctgatgatggatcggctactcaacatccgagagcaaaaactttgatagatggtggggagaatggaagcaaaacatattccatcagtcgacttctatgtatatgacagatctattcccagatgtcatctctcaggtatatctttactttgtcatttttgcttgaataattagtagccgacttgaatcttaactaatctatccctttaccttgcagaaaacagaatcttctcctccacgcaagagcaacagtggcagggatatagagtatgccccaggccttttgccaaacggtggtggattagctcctccagtcatcggctatcatgcccccaagacctcaagtctgtttcaagggcagatgagagaaccagccgatgttggcaggaagagaaagaccaaggcatcggctatagatccattggctctggctcccaaaaagaagaccaagaagaataagcctacgccagccgatgacttgcctgccttagatccatccatcgagcaagccttggacgaagaaaagattgaagaggatattgatcaagctgcagccgaagtaagtgacacagaaaaaactccatcggcttcacccaatcgaactcctccaactccctctgccccagctcatttctcaagggtacacctctctccttaatttcctcctgccattattttattcatagccgatcacttataaatctcatttttgcagaaaaagaagactgttgtgaggaagaaatcggcagtaacaacgcttaaaccggctccaccagtaagattgtcatatataaatcctctcacttatccgatcacagccgacattttacttaacgctttgtctttttgcagcctcctcctcctccttcaccacctatgcaacagatgtcaagtgaccgtaccccattggctacgggaagccatcatgttgaagaagaggaacaaccagccgctaatgccatcccagtaagtctttcattgccataagaacctagatcggctgaaactgtttgatatttaactgtcttcaaatttctcttttgcaggtcctggccgatctgttctcttttgatatcaaggattactttgatgaagaagtagaagaagaatccacaagcaaggctctagcgcctctggatgaaactgtcaagaaaacacttgaagacatatccattcggctagagtcatcattggataatctggtggccgactgtggttcgattcgggcacgatttgcagaaatccaagccctagtcccagacgatctagcaaacaccattactctagctgtgtacctcgagcaacatcaattcaagctggagaaggctaagcaatggatagccgatcggcgggagcggaaagatatcgaagccactatccaagccaattgggaactcgtgcatgaagagaaagctaagttagatcagctctccgccgggccgattcagtcaaacatagataagcttgaagctcgcaagattgatcttatagcccaacttgaagaatgcaatgccgagttgaatcttgaaaggcagaagctagccaatctcccaagtgctgttgaagaacataagtctagattgagatcggctataaaaaatgtggctgacatgaccaagtccctcaaattcatctctggaactgacacccaagacattcaagctattgaagaagtagatcaaattagacaacgggctgtgtcggctatccagcgttacttgtctagatgattggtcttgtaataggatagctcattttgtaatatatgtgcccccctaattttacaatgacgaaggcattaataaaattataaattgaactaagagcgatataaccatattggccattgtatatcggcaaaacacaaccgattacaatataaaaaacaactaagggcgatataaccatatcggctattgtatatcggcaaaacacaaccgattacaatataaaaaataactaagagcaatataaccatatcggccatctcaaggcgatgtaaacacatcggctatcatgtatcgacaacaccaaccgatcatgtattaacccaaacacttggttaatatttcttcaagtatttgccattgagtgctcgtccataaacttgcaacatataagcccctttggatacaaccttatagatttgaaacggtccttcccaattcggcgaccacttgccgaatttgttatcccgagtccctaacggcaaaatcaatttctacacaaggtcaccttccgaaaaagacttgggtaccacctttttgttgtaatgctgagcaattctctccttatctttggtgacttttgctagggcttgcaatcttgattgaaccaagtcttccctctcatcagccatgagattgtattattcatcggctgttaactcattttgtaactctatcctccttgagccgattcaaacttcccatggtaaaactgcctcatgtccataaacaagtttataaggatgaacttgaatcgaaccattacaagccatccgataggaccacaatgcttcggccaatctagtatgtcattgccgaggataatcggaaatcttcctcttaatcagtttaatcaaactcttattagacgcctcggcttgcccattagcttgtgcataatattgtgaagaattcaacaatttgatacccatgctatcggcaaactgaacaaactcatcggacaaaaagatcgagccttgatcggttgtaatggtttgaggaataccaaagcgataaataatatgctcttgaacaaatcgaatagcatccccagaatcaactttcttcaaaggaatcgcttctacccacttggtaaaataatcggttgccaccaatataaacttatgtcctttgctcgacggtggattaatcataccgatcatatcaatcccccaacctctaaatggccacgggtgctctttgaattgctccaaacttttgacaatcttgatatcctttgtactatttgaaacaatcgtccaacattgtcggccaaaaatatcctacccgccgaagcaaccacttcatcttatgagccgattgatgagttccacaaattccttcatgtacctcacctactacaaccttagcttgatcagcacttaaacatttaagcaacaccccatcaatcgtccaataatatagctcatcatccaacaaggtatacttcaaagccttatagcacaacttccgagaagccgattgagatggattctgcaaataatgatgtacatcgtacctccaatcatcggttgttatcgtggaaacttctattgtgacatccttcatcatcggcttgtaacccgatgccccttgagccaagtcattagcttcaatattttgctcccgagatacatgcttcaaagttaccagccgaaatcctttcatcaactcccgacacttctcattgtaaaccattaatgtatcatttttgcactcatattctcctgccaattgactaatcactagaaaggaatcacccataatctcaacagcatcggcttcaactttcttatgtaattgcaaccctttgagaaccgcttcatactcagcctgattattagttgcatatggcttgatagtatatgcaaactcaaaacttgccccccgaggaaaattataaccaagccgataccacaaccatgagtgcatactgacccatcaaaaaacaaagtccagggcacaatctcaaccgagccgattgagtcatcacgatgatcaacaataaaatcggctatagcttgccccttaatcgccttcggtgactcataccgaagatcaaattctatcaaagaaaatatccactttccaacccttcctttcaaaatcggagccgataacatgtacttgaccacatcggctttgcatattacagtgcattcattggataattgataatgccttaatcttgtacaagaaaaatataagcacaaacacaacttttccacaggagaataacttgtctctgcatccaaaagccgacgactcaaatagaacacaactctttctttcccctcgagctcctgaatcaagaccgagccgattgacttctcaccggccgatagatataacctaaaaagtatccccttttgtggaggaatcaaaactggaggagagctaagatattgtttaatattatccaaggccttctgctgttctgccccccaagtaaatttctgatcggctttcaatctcaacaacagtgtaaaaggttctaaccttccagacaaattagagataaacattctaacaaaatttatgttgccgatcatctcctgcaattctgtcttgtcctccggaggttgaatcttttttatcgcattaacactcctttgagttatctcaatccccctttcatgaacaagaaatcctaaaaattggccagccgatacgccaaaagcacactttgtcggattcatcttcaggccatacttcctagttctcacaaaaaccttcctcaaatcggctatgtggtcctctatttcctttgacttaacaaccgcatcatcaatgtagacttcaaccaaccagccgattagatcatgatatatgtagttcatagatcattgataagtagctccagcacttttcaagccaaaagtcatcacaacccactcaaacaagccgattgcaccaggacatctaaaagctgtcttatgaatgtcttcctctgccataaagatctgattataaccagcattaccatccataaaactcaatatcttatgccctgaagcagcgtcaaccaattgatcggcaactggcattgggtactcatcctttggtgtagccttgtttaaatctcagaaatcaatgcacaccctgactgtgctgtttttcttgataactggaagtatgttggaaacccactcagcatatcggtaaggacgaataaaaccagcatcatacaaacgtttaacctcagccttaataggttcgagcatatcggctttgcatcttctcggcggctgttggtacggtctaacccccggtttgataggtagccgatgttcaacaatggatcggctgagtcctggcatctcgtaatattcccaagcaaagcaatctctgtactcttttaagagctctatcaacttggttctgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27630 - DNA, 1205 bp, Oryza sativa
aaaccctgtccttgctggtcattgagatcatctattgtgtccttggtgtagacgttgaaacctccacgacgccctcaaaataatagcttgggctctccatcttcaatgggttgtatatcatcggacacttttagaaaatctccatcccaaccttttccagataagcaatcgataccgtccatctcccaaagagctaaatcggcactggcaacattaactgacttgtcggctagcacaatctcaatcttgttgccttgccattgaatcaaacattgatgcatggttgaaggaatacaacaattggcatgaatccaatcccttccaagcaacaagctgtaggaacccttcccatcgatgacaaaaaatgttgtagggatggttttgctgccgactgtcagctccaaattcaaaactccttttgtctctgacggattgccaccaaagtccttgagaaccatacttgtcttgatgagatcttcagtatttctgcccagcttcctaaatgtagcatatggcatcaaattcacagcagccccaccatcaaccatcatcttggacatcggcttctcattgacatagccgtttatatacaatggtttaagatgccgattctttgtcccttctggtttctcaaaaaccgcttgctctggtgacaaaaccaacctagccgaagcttcctcaacttcatcaacatcagcttgtttagctccgaattccgcaggcaacgtgaaaaccatgttaaccgatgcggtcacaacactcttccctttagccaacctttttgcttcatcggctgtagcagcttggttcttgacacgccactcctgccttggctttgtcttcttctgccgatgattaatctcttgctccacttcatgaaaacactctctgttcctcaatctttgaactcttctcttctgattcttcgtaaaaataccagaaggacaccattgagtttttctgccctcctcgtcctcttgatcatgatcttgatttactgggcccaatctttgatgaacaggaactcttgtcaacctcagccgattgcttctattgtgagatcggcttgaactttctgcaatatcactgcatctaggacaatcttcgatagatggcagcctcataccctcgttccagcaaaatctgaaaaactcacagtcccaacgaggatcaaaacccgcattggcttcttcataatacctctc

SEQ ID NO: 27631 - DNA, 694 bp, Oryza sativa
  unsure (1)..(694): unsure at all n locations
gtctgaccatcatcaggtatggtgcctcctgacaggcgtattctgttgtgcctccagatgcctcaaccacaatgttagctagccaggtacccacgaaccggtggacctccaggcgaacacggtgagaaagctcgccactgaccggtggaatcgtcgtgtactctggcgcgttggggtagcccaccaccagtgtcatacgtgccaactccgccacaaagtcgatcatgccttctccgcggtggttgggtgggtggccggccatctagagaagacaaaggagtaggatcaatgcatgctcaaatccaaatttaaataaagcaataaaaactcaaataagggaatcgaataagagcgaaatttttatgcatagatcattttgcatgagagcgaataaataagacagactcacataacgataaaataatgagaaattagatacatactaataataacaataaaagcataaataccttgcaacccatgttcctaagctatgacctaatgcatttcacccatcagatcccaactgactgacgaataaatctcaacagttttactaaaaccctggactgacttgttttgaaaaatctcacttaaacgagcgaccaagatttnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27632 - DNA, 385 bp, Oryza sativa
ggctggctttgaagccaaatcacagctgcaaaatacagtgcgagatcaacagaatgctctctctctctctctctctctcgatggatgcatacgctcaatttttttctgccatggcagtaacaaaccaaccatataaaattttgcaccctagctatctttatagatggatgcaaggaaaatggaaactattgagaaaagaattgagtggcttttacttacaataggtggaggccgaccagttcgaacgcttatcgggatcgaagcctcaaagaaccttgcaacaagggcacttaactttctcaacaatccacaagagcctattttaaaggcggagagagagcgagagagagatactagcaatggggattacagtgtggattgactg

SEQ ID NO: 27633 - DNA, 980 bp, Oryza sativa
gatcgatgaatggtgaaatttacctagctaagtgttatccggaacttccggaggacaggaagtttcggacctgtttccagttcaaaaatgtgagtaatggctagatgacgtcacctagccgttatatatatcccaatcgtccccagctcaccctttggccatttcacttttgcttttccattccataactgttgctagcctctcccaggtgtttctttgcctcctccgcccaattttgagccattcttgtgagagagtgagattttgagggtgaaggagaagatttggagaaggtgtgaaggctaggattggtgtgagcacttggggtatcttgtgggctgacatctcggtgcttattactcttggagatcatctcctagatggttaggtgtcacccgcgagcttcctttgcaattgtggatttcccgggaaagcttgtgaatattttcctcacctccgtaagggaacgaggtaagtgagtaaagaatcttatgctaaagtcctagtggttttcctaatagagcaactcacacttatggtgttttctagaagtaggttaagttggatctaggtggtcactcaattctagaaaattacctaaaggtgttggggttgaaggctgtggatttcctctaagatttttgcacaagtgaggcaaggggttaattgatacccccaactctttggagctcctcaacggagagtagatcgcgagatccgaacttcgggaaaaaaatatcctccttgtccatttctgtgatgtttctatgcttgtatctgggaacctattgcttttctggtcacctgtgtgtttctacttttgagaattggcttaatttttggaagtgaaatttgaatttcgtctgttttccggccaaggacaccggaagttccggactgtctgaacataccggaaagtttcggtgttctacaccaagagatttcaggcctggtgaatttaccgctggaattgtttttga

SEQ ID NO: 27634 - DNA, 430 bp, Oryza sativa
  unsure (1)..(430): unsure at all n locations
nnnnnnnnnnnnnnnnnnnnnnnnnnnnnnnnnnnnnnnnnnnnnnnnnnnnnnntttcagtgaggcgtggcgaggcgggccactgctgaaagggtccccgcaccgatgatgggttggaggccctttcagcagaacctgtgaggctctgcggagggaaggagccctcccgggctccttgcaaaacgcatttagatcttgccgacgaggtccaggctcggggcgatggtcttggcgccttccttccacttggccgggcagacctggccggggttggcggcggtgtactgggcagccttgagcttgcgcagggtttccgacacgtcgcgggcgatttcgttggagtgcacttcggccgtcttgatgacgccttcggggttgatcacgaaggtgccgcgcagcgccaggccgggtaccgagctcgaattcgcc

SEQ ID NO: 27635 - DNA, 372 bp, Oryza sativa
aattttaaaaaactgcttgattggtgatgcactatcaattgaagcagccttatataaagtcttatcaactgataacatcgccattgataagattaatacattaaaagctagatttcttcacaccccataaattatgatcccaaataaggctttatacccatcaatttcacctgaagtcaaccaaggaatattcttacctatgatcgcatttaatactcctgttgatgaatctaaaatgtagataaatgcgattgaaatagctacagatggagtgacataaggtaagaagaaaatcgtttgtcaaaaccctttagccactttgttataaacaaacacgatcgctgatgagatgattaatgcaatcattaatgt

SEQ ID NO: 27636 - DNA, 607 bp, Oryza sativa
gtatgtaaggattcgtccgtccttacctaaattttttcatccgcaacatcctgagtccaacactggccgtgccaaagaggcaagccgagcggatggagctagcgaacaaggctgagggttgaaaagaaatgaatgggactttcagcctaaaaccaaggagtattcaactaaaaaaaccaagcaagctagataatgtatatcaatttcaaaatatttttactcgttgcaacgcacgggcatttttttctagtatatatatatatatatatatatatatatatatatatatatatatatatatatatatatatatatatatatagatgcacacaacaaaaaaaaagtgattggtggacagaaaaataagtgattgacgaaaaaaaaatagttgacgatcgataagttataatttttaagtagctataatataagatgtgcatgcagaagttgcattacagagacataagagaaaatcagagagttctagcccatcactttcattgttgcagaattaatcgacacaactatggatagggcagtcaaaataatggggagggatttccctttactatcgcgtccctttcaaaatctaatccgacctacttaa

SEQ ID NO: 27637 - DNA, 691 bp, Oryza sativa
aaaaccaaccgattgcgggttagatagaatcactaataaagattataaagtgtatatgataactcgacaaattacataaacatgattagagtgtcatgaagatgtaagcactaataccgaaaacgcaatccgccatgacaagtttacctctagttgaatatcgaaaccgatgcagctcaacccgaaagcaagaacatgtctatacaaacgaacgtgaaaaagggtggcgatgcgccgagattgttattgaactattgttgttaaattacatgggttcgggttatatttatacccgagatacatgatatgtccttgccggacacgactcttatctctaacaaactctaagatacacataagtctttacggcagacttttgtccaaacatatctctaaggaaactatttaaaatatcctaattaatagatacaattgcctatctgggagcttatctccatcatgaaaatcctttcgtagcactgatcgatcccagaaacgatttcataaccatctcaatgaaatcggctatatcggctgtatcggttgtcccctgtccgatgtcatctcagcagatgcagactccagccgatgcctccgcagccgatgcgcactctgttcttcgatcacaacccctttgccgaatccacttcaattccaatgccgaacctagttcatcacttaccaaatttgg

SEQ ID NO: 27638 - DNA, 726 bp, Oryza sativa
  unsure (1)..(726): unsure at all n locations
nnnnnnnnnnnnnnnnnnnnnnnnnnnnnnnnnnnnnnnaaaaatcggcaccttgttaacaacagaattttgcatcatactcggaggaggaacaaatcgaggcagatttggtgcggaatcgaactggattaggagataggctgtgcatcggctggacatcgtatcaactgaaaatagagatggaaacagacttaggctacgttcgttaggagtagttcccaactcctccttgtcgttttccgcccgcacgcttttcaaactgctaaacggtatgttttttaaaaaaagtttatatacgaaagttactttaaagaatcatattgatccattttttaaaaaaaaagataaaacttaattaatcacgtactaaacgctgcttcgttttacgtgccggagactgagggttcccaaccctcactcccgaacagagccttagccgatatgccagatagccaatacggattgatttaggctcgggttgggcctagattggaataactgatattgtcgtatagagattgagctaatttaaggtaattttatctattaattaggatatttataccggtttgaattagagatatggtaatagtcagccatgtggacttgttcaaattttatctttagcaaagttttgaatcacgtccataatggacaggttttgtactcggggtataaatataagccccaaatcattgtaataaagggattgattcaatcaataca

SEQ ID NO: 27639 - DNA, 1037 bp, Oryza sativa
  unsure (1)..(1037): unsure at all n locations
atctgctcgagcaattctgattaagcccaattatcacccacaaccaaattaatgcgccagcgccactgcgcccgggaaccgggcctgatctgatgcagcgtcagcttgtgcgtcgcccttcagcaatagcgtcggctgcctcaagtcagccggggacgcagacacgcagtgccgcaggtcatcatcgtcgaggtcgtggtggggccaatggctagggaagtggatttgaaggaggaaacaagaggtagcgggaggcgacgatgaccttgggtttgtgcttagctccgcctagagcttccgagttgaaaggagacagcactgtggtggagtgcggctgtgctgcaggtgggaagttttcggccgagatgccacgcaggcggtgtcggcaaccttttcatgtatatttgttgactaaaaaaatacccgtgcattgcgacgggtgaagccattttaatcttattattattagacggtttagctaaggtgaagtttgctgtgggaattcgcttggatattttttttaacaaaatcatgagcttcaattagaagtgctatatatagtctcaagttagcatgcgagtttttttaagagatttcttatatgacttctttcgtatttcaaaaagcgaatgaacttaaaaaccaacccaaacacggatctatatttccaaaagcaagtaacttaaaagcatgttcaaatacggatgacgtactaaagtaccggcaaaaatatcttccatttttataatagtagagattcgacgaataaccgtgacaaatacaaatacagactataaattaggccttatatacatgtgtgccacattagaaaggctcgcaccacatataattgtatagcgtacgaaaggattgcacatatcatatacctacttacataatttgttactttccgttcgtcacatcaattttccatctgtaagtccgatcgaatgatggcatccgttctcacacgaacgagtaannnnnnnnnnnnnnnnnnnnnnnnnnnnnnnnnnnnnnnnnnnnnnnnnnnnnnn

SEQ ID NO: 27640 - DNA, 574 bp, Oryza sativa
  unsure (1)..(574): unsure at all n locations
agggcgaattcgagctcggtaccctaggcgtgccaaaagcgtgttgatgtaaaaacacgaggcctggaaaatctgcttaacttcagtgcaggtccaaaaatcttgcctttagattcgtgagcgtgccagttggtttgatcctgcaatcaacaagaaataaaggcaaagagactgcggttaaatccataaatgatagccgatcagctagttgccgatgacacatcatttatctatgagccgatgtcatgtttgaatcgatcggcagatataaataagtaagaagagactaaatctactcgatcggctgtagatattgacagtatataatctctatgtcgatatatacttaaatcaagtaattgggatagatcggacgccatgccgagacagtatacaaatcacttaaatcgaagtatatattaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27641 - DNA, 693 bp, Oryza sativa
  unsure (1)..(693): unsure at all n locations
ttattctccacataacaccaataactcttactcccatgaagtggacagacccgttcaaacgaattaattttaaaatcacatccactagcatgcaagtggatcggtagttttctacatactatgaaggtgtaagattttatatatcatgaagatatacttatcaatggtatttggcaatcttattaattcccctaatgccaaaatatagaccggtttatgtcactctaagtggtttaagctaattgttgaagattagtgaaacaatcaaattggtaattattgataaatccactaagagaaagttgcataatatttaatctcttgtattgagctaattattttatacataccgcatatgtgtatcgttgcaacttattttcccatagtcctccgtaaggataaaactttgtttgtattgcacatttgaataagtggttatacatattgctcctatacgttgatttatttctcatgttcatagtagaacttatgaaataagtaaacgaaagattaaacattgtggtaattttattttcattattttacacattaataaaaatgtggttatgatattggaacatggaagtttcaacggatctcttcttgagggggagcatatatgctaaacattgattatcatacttaagacttggaannnnnnnnnnnnnnnnnnnnnnnnnnnnnnnnnnnnnn

SEQ ID NO: 27642 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnntttggattttaccaaatgtttgttgaatttggtcaagttttattcaaatccagtcaaaacatgtaaaagtacttcaactaattttggtccgacaagtgccaaaaatcacgaaatttctattttggtgctaccgaaattttggctgaaatcgaaaatgcaaaccctagtccctaagtaattatgaactaaaataaggtgttaaatcaggaaattaataccggtagaacagcggtgaaatcgtggttgtattactgctccctttaaggtttaaataataatgtccatagatattatgcgcccatagcttttttagcgaagaccaaagatttgtggttgttctttgtgagcgtgtattagggagtacttttatgatgagcttgtgtgggacgcgtatagttaaaaacaaataatgttaaatcatctacaaatttgtcaagatcaaaatatatttttgtagtttcggttaagtcttcatcgttcaaaaccttttgttgtgttcacatatatatttacatcatttttgttgggtttatatttatatcctacacgaacacgatgataccgacgtgtttggttcggttcttgccagtaaagcgagtggtttgttcaattatatttggtggtgacattttttatatatgaaaatattcgagatgttcatgattcgaatagcaccacaacagcatgtgtcatg

SEQ ID NO: 27643 - DNA, 747 bp, Oryza sativa
attacatttacagtttctactggcaaactatgtaagtgaagtgtaaaagagtagagaacttacaaaatttcttgggcgtttgtttcgattcgaagtcccctcatattgtgtggtgttttccacgatagattcttcataggttaggccactagcatcacaatgatctgtttcagtgtttgaatcacctgttttgtcaggtcagataaatataggcaagataaaacaaatgacatgggtgaagaacaaaatggggtccttcccaagttactccaaaatcaattgagtacacactacacacttatgatgtgatgagacgaggaaacaaaaataacagcttacagtactcactctttattccagggccgtttctgcattctatacaccggcattttgcagtgcatctcaccttgtgttgtaagacaaaaaaacagccatatcatcatatatacctaatgaagaggaatgaaaaataacagaatctagaaataagttatgtgggctgttgccataatgaatccctttttcccccttcgttccagaacaggtatcaccccttcaaaaatcaagaatcttgacttgtatgtcaagtacatttttttggatttcatgaattagaaaatatcattctatcagagttcgaatttctaaactaataaactgaattctttttttttccgtttctggtccttctggtttactagaagactaaaatgttatgtcttttttgtttgcaacaagaacatcagt

SEQ ID NO: 27644 - DNA, 722 bp, Oryza sativa
ctaaatgccatattacacaagggtggggtttgtagtatctaactctaaggtgcttagccagcttctatcactatgaactggcgttgatacatgttgcggcttaaaaaccagtgctaattataaatattagtgccaatacgttcttagttataactggcactaatggacaagactacatcatgccagataaaaaactacaaaatggtcttagctacttattttattgtatctacctcatatagaaggagtaataatcgtggttttgctttcatacaaaacggtcttagctacctaatttaatacatccgcctcatatagatgaagtagtaatcgtggttttgcttgcataaataatggtttagacaattgcaggcttgtagctgactcttgaagctcaatcctgtcaccacctggtggtatgctccaactgaacccctgcagaagccttgcaaatagcatcattgtaattgatgttccgagtgacacggcaggacagccacgcctaccagcactgaacgatacaaaacgtaactctggctcagctagcaccacagtaccagtatttttcagatgtcgctctggttggaattcgagtggtttatcccatgctctatggtttcgaccgagcccaattcggcttaacatgacatggctaccctttgggatcatgtatccgcgacggcggtgtctgggatcgcgacatggggtgggttgaatgggtg

SEQ ID NO: 27645 - DNA, 7156 bp, Oryza sativa
  unsure (1)..(7156): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacatcaaatttgaaacagtggtgtcattgtttgaagcattatcaagggttattgtcatgaccttatcctctattttcaattcaaccaagcaatcaaaaatagcctgagctatgacaatagcggtgtgaggaggctccacctcaacaaagtttaggacacggcatagcaaaacccaatgaacatctatgtaatgagccaccaaacacatatactgaaggttttgatttaatgtccacatatatctgtagttaaacttatggtctcagcctccctaagacttttcctgagatgttccttttcagattcatacaatttcatgcattcatttttatggccttgcgactagtgaattcatagcgaggattcatccacttcatcaaggcattaaaccctttatgctcaacaattctaaatgggtaatcatgttgaattatcataagggcaatcaaaagtttagtgtgatcatgatcatactcagtaggatgcaaaaccatagaaccatcagctaaaggaaaataaagtgtaccttgagctttagcctttgcaagcttgttcagatatatcgtgcacttatctaagtgacgattcagtgttgtagtggttcccccaaggtgatatgcctagctgtgatgacaaaacctacactttgccttacattccattttccctttctccttcttggagggaacattgatcaccttaaaatatttccaacaactagcacgctttcctcttgttatcttaactttggaaggagacagtgaaatacctacctttggcctttttgcaccttgtttttgagcctttgaagtgtcatgtccatcctctcccttattgccgcttcttgaagaaggtaggctcacggacatcacatcattcaagtcaaaggtgttttcttcatcctcccctccatctgaaaaggccaccatgtccatttcctgcacaaattcaattcatacacacacaaactgattactatcttctagttgccttggtagtaggtatagtgattcattcaaagctaaatgcaaaattcacagtggtacatattcaaagctaaataattttagatcgacttcacaatttcacatgactacatgtctatatcagtacatttgtactgcacaaatacatattcaagataattgaataaaccaaaaaggaaagtgattgtggaatttagatacattccacggtcgtggagacattagctcgtgatgctgatgctggtgacggcgatccaattgccccacttgcgattgcggtccttgccgatcctcgactacagccaacgttggtttcagcaatccgtgcggagcgtgtacgtgccgctgcaccttcacctgtagctgccgacgagattggcctcgcgcttgcgcatttgctctgggattccacgcttggtggttgaggcgcctcctccatggtagtaagaagcggcgtggatggcgagatggcgggtggcggcggcgtggagagtggcggcggtggcggcagaaagtggcggcctgactgcctgagttcctggcagtggcagcgctcacgcggtggcagcttggcgtggtgggtggtggcgccaacggcgatgggggttggcgcaggcggcttggcgcggtgcgcggtggcgctcacgcggcggcagcactgatggcgatgggcgagtgaagagctgtgactacgagcctgcgcggccatcacccgccccgtcagagacctgccgtcgacttgccgtcgccgtgcaagctagaacgccgccgcttgtctgcttcttgctgcgcctgctcgccgccgccgcgtggctgttgctcgtcatcgccgcgtggctgctgctcactgcgcatgccagaacccccccaccttgctgccgccgcacgggcgccgcctggctgccgccttaccggagtgccatcgcacgctcgccaccgcctcgcgcacgcctgcacctccgccgccgcctctaggtctagggtggtctggatgttcataggcacaaccacacttggtggggaggagagggattccacccatatccattcgcttagggtagaatggtaaaattgatatttcataaatctttttttaatttccatttgtatttttttaacacacaaacgtgggacccatcaaacaggcgttacaagtaggggcaaacggctggttcgtttttaaaaagttggggtaaaatttcaaaccctaaaaaatgggggtaaaatagaagttgggattagaagtgggggcatagagcaatggtccctatttaattatacaaataaatatgtaagtatatccaatcatcacccctcacattatttgcacaatattttaacaaatctatctatcatttttataatatttaacatataattattaataagttttacattaaagtgcgggtatcatttgtttgtttcataataagtgttgataaatcttgatgttttattatttttttctttttactcctagcttgattgtcgaaaaaaatatattgagaatcatttagtaattcctgcagcaaagcgttggaaatcaccatacaataaccggttagcatgcagagccggtcatccaactaaataaatttagaaaatagtttgttggtttattaaattgtttgattagcgcaattaatcaagccacgtaatcgggaaatggctttcccaacttcatgattagcgggctacatgcaaaacagaatttcaaacttagtgggaaaggaatatggtgaccgatttattttttcgtctcatccgctatagaacaattcagttattttattgcgaaactcataacatgcaaaacttatgcgttggtactacactttcggtagtaacatacactttcggcagtaacataccgaggaaaatatagtaacgcataacatgcattagtaacggtattgccacagtacttgtgcatagtaaaaattttaaatctcaatcttgtgcaaagtacaagtgctaaaaagtgcatgtgcaggcttttcaaactgctaaacggtgtgttttgtgagaaaactttctatatgtaagttgctctaaaatatcagataaatatatttctcaactttgtaataattaaaacacaattaaatatatgttaataccaccttgtactgcataaaaaacttaatcatcatcttcatctacatgagtttcaaacaccacctaactactagcgatattttttaatcttttacaaaaaatatctctcacaccatatattaaatttgatggtggaaattttagaattctaatcttttaaacgataatatctctcacaccatcaaaatttgaattagttttcgtttttttaattttccgaaaaaattcctttctatactttccatttctgaaaatatatctagaatccgaaaacttttcagaccgttttcatcccatcagtgtgatgtaatcacatattgtatgttttgtatgacctaggagtcgaaatgctccttgttcgtatgattaactagtggaaaaagttcaaaaaggctatcgcatgagcgatcagttctgttttctaccatttttggcctgtggtccgattcctctcttttccttttaggccgtgttggtttccttctgaaattcctatctggcttgttatgtgtttcgtttcttgattgggcttggcattcatttttctggagtgagctgaatctatgtggtatactattgttaacgaccaaatttggtaagccatgaactaggttcaacatcggaatcaaagcggatttggcagggaatcatcttccaaaaacatagtgcgcatcggctacgagggcatcggctgagatggatcggatagaagatagccgatgtagccgatttcattgatatggttgtataatcgtctccgggattgatcaacgtgctacacaaggattgccacgatggagataagctcacgaataggcaattgtatctattattaattaggatattttaaatagtttctttagagatatgtttcggtaagagtctgctgtaaagacttgttcatatcttagagtttgttagagataagagtcgtgtccggcaaggacctgtcatgtatctcgggtataaatatatataacccgatcccatataatttacaacaacagttcaataacactttcggcgcatcgccaccctttttctactttcattgtttcgacgagttcttgcttttgggttgagctgcatcgatttcgatcttcaacaagaggtaaaacttgtcatgacggcttgcgctctcgggattagcgcttctatctttatgacactctaatcttatttatgtaaatcgtcgagttatcatatatgcttcataatctttattagtattataatctaaccctaaatcggccaacatctatcattgaaaggcagccgatagagttagatatagttgttaatctagattatatagcatatccaccatcttttagaggttttcatcaatttgtcaagatcttgtatttattcttatgcttaatgctgcattggttgagttcgatctattaagtaatattcataactgcaatatctagcttgttctatgatcaccaatagagatagcatcggagtttcagccgatcttacctgatttagctactttattctttacatgtccttgttatatgctagatccgcccttcatattaagatcttgttgcattaaagtatattaagcttactgtttaatatattttgtctgttctaatatcttaatatagagtggtatcggagtattagccgatacatgttagatctatttgatcggctatgctatgaatgtatacataatcttcatcttaaagttcttttaagcataagtgatttatactatctcgacttactgttcgatctatcccaatcacttagcttaaatatatttcgggaaaaggattatatatcattaatatctatagctgatcgagtagatttaactttatattgctttattcttcattgccgatctaatgccaataacatcggtttaataattaatgatatgtcatcggcccttagccgatcggctatcgtttatggatttaacctcgttttccttgttttatcttcatgttgattgcaggatgaaatcaactggcacgcctttgaacccaagagcaagatttaggacttgcgctggagttaagtatatctcccaggccagtgtgtattttttcatccacaactatccatgtgcatcgcctagaatcgggtggaaggcggtgttgtggatgatggaatatggatatcggacggagagggtaccgctaaacgattaatcggagtgcggacgattaatcagaatttgacgaaaatttaaagttttggacaaatatatgtacgtaactcataatagcttgttattttttacagataaatgcatataactacatatacacctactattcttaaataaaaataaggataacataacattagctcgatatattgtaaaatataggtctgaacactcatagttgtgcatcaaatagtgatatgtttggttcgtaatgcataaaggaaatatcgaaagcaggaaacactatctaagtgacactaaaacaaggtcctattcgagattcaaacagaagattaaaatgaggacaacaaaatatgggagatggatttgaaagaggattagatgaaaataactaaccctagactcgcaggttgcagcggcaggaatgagcttctaaggttttgggattgcaaacgtcgttttgctacctacttatatggtgctaggttacacaactagtgggatagtatgttatcgtgggctggctgggtagggccttgtcacgtgattaggcccggttattcggccgattagttggtagtgatggtgattgtacgttccgaaacgactaatgtgcaccattttgctaaaacgtgacggagagaggtcggcgccaccgttttaatgtcgatatatatggccgtatcaacctttatccacgacactgcaaaatactactagttattaatggaaggagagagcatgcatataaattatagaggcaaataatgaaaaggacgaaactgttatgaaactattatcttctgccagagataaatatgggctcataccaaatatatggaaacgtatcctaataggactcttcctattatgggtatatataccgagaaagaggtagagagatctgaatgtatccacatatgagaaagtaataaagctgtgatgcctctccctatatccgtgttcattgtttatctattatgtgcttgtatgagagatcgtcgtcgtctactccagatcagcaaataggccactagttattcaacacgttatcagcacgagttcgctcgtcccgctgatccgccgggtaagctttttactagatcaatttgttttcgtactaatcagattgatctactgtgtttatgcattggtctgttgtcagtcgagacgatcgcctccaagcgcagccacgcaccgaggcagcccgtcaggtgacgcgcgtgcaggtcgcacttccacgcgagcagcagccctgctggtcgtccgtactggagcgggagcccgcaaggcgccgacacatgcgcatgcacaagcagtgcagattgaaaccagctgatgaaccaagaaatttcttcgtgcaagcatccgtgtgtgatccaatctacgtccacgcaaggatcgatcaacatgtatgatgcatgtaccaatcgatattcaccaacacccatcggattcttcaacaatcggacatcatcacgctgatacgctatgcgttggcatccgcggatcggcgaactttacatcggataaatgagatgagtgtcggtttcatcaattctaatactttgcaatagcgagagtaatatgctagatcatgcctctagttgttttattttctcgcatgaatagatgtatttgtccggcctttgnnnnnnnnnnnnnnnnnnnnnnnnnnnnnnnnnnnnnnnnnnnnnnnnnnnnnnnnnnnnnnnn

SEQ ID NO: 27646 - DNA, 744 bp, Oryza sativa
  unsure (1)..(744): unsure at all n locations
nnnnnnnnnnnnnnnnnnnnnnnnnnnnnnnnnnnnnnnnnnnnnnnnnnnnnnnnnnnnnnnnatgtatcagtagtagcagcaacaaccatggatggatcttcctagctgcaaacatagtttcttctatggatcaacatttcgacatctaaaatttagaggtcagatgataggcagagaaatctagatttcaaaaaattaaatatgttaataaaaaatagcaatcaaattaaaatgtacgttgatggttgtattcattgttttatatcatacaatgatgaataaattcctcaaactggcgacctccaatgctttcatactgtcacacccagaaattcactaacccaaatttcaagcagaatgtgtattaaaatctctgtccaggactagccagagtacacagacgataattgaaaaaatagatctacatcttacaaaaataataaaataattcttacaaatgcagcagaaaaataaataaactagacttaatcttcacgaccaaaagcatagcttcctccataaaccacaggcatcctcaacgttcagaacaaactcaatcctcatagaactcaccatctaaaccaatctctgcctcttgtggggaggaataaagcaagactgagtaccaatcatcgtactcaacaagtcatactaacgggaaggtatgatgcaagaatggcttattggatatttgcaataaaagtagcatttataaatcatattttgaataagttaaataat

SEQ ID NO: 27647 - DNA, 630 bp, Oryza sativa
  unsure (1)..(630): unsure at all n locations
nnnnnnnnnnnnnnnnnnnnnnnnnnnnnnnnnnnnnnnnnnnnnnnnnnnnnnnnnnnnnnnnnnnnnnnnnnnnaatgcgttgcaccagaatcaaaaagtattgttgcagggattgagttaacaggaaacgtacccagtacagcctctggtgctgcttgtgcctcctccgcagatgcgtggttgacacgagcctggataaaccttggcccggcacgcctaggcttcgggcatttgttagcgaagtggccaagctcgccacagttgaagcaggaccctggttttgctccagtctccttcttggattgcgcgggcgggcctgtctgtgccggtgccattggtgggcgtggagctgcaccgtgattggactgacctccatggtggttctgactgccactggcgccctggggaaagttgctagggttgaacgggcggtgctgatgaacgatcatggtggtaggtccaccctgctgcccgggagcgaagcgcggcctctggtgacttccctgaggtgctctgaactgtgcggccttcctcttcctgtccatcttgttgcgttgatcctcctgacggattgccttgtcaaccagcctctcgaagtcagcgtagtccccagatatcaggtggttg

SEQ ID NO: 27648 - DNA, 390 bp, Oryza sativa
  unsure (1)..(390): unsure at all n locations
gttggcttctaaaaaaccacaagcaccaattccatcggttaagtttctaaatcccatttaattttcttttcaacttttgaataaccgatgataacttaaattggtccttctcaggctcgtcgtactccaactcctattcccgaatcaagtgagcataccctatcggctgcaggaagccatcacatagaagaagaagaagaagtagcagcaccagcccatgctatccctgtaagttcctgttttgaatccacaaatcatatcggctaccatgccacttttgttaaccaataatgtattccttttgaggttttagccgatatgttctccttcgacatcaggcagttcatggatnnnnnnnnnnnnnnnnnnnnnnnnnnnnnnnnnnnnnnn

SEQ ID NO: 27649 - DNA, 660 bp, Oryza sativa
  unsure (1)..(660): unsure at all n locations
acggaaaaatacattcgcccttttccctcacacccacttcaaatttttcacactctctctctccactcttttccctctcacccacttccaattttcacacaatctctctcccttttcttttaattctctcccacacgcctctttcctctcctcccctctctcatgttctctttctgccactttcctctcctcacatccccctctcctctctctttatgcctcccactgagcgcacgggcgtcatgacgacggcgatgacgagtggcggcgcgatgatgagcggcagcgcgacgacgacggcgcgaggacgacgactgctggcggaggcggagcgatcggccagcctttttcttcttttcgtcatggttttgcaaactttgtgttgcgtcgcacagtggatcggctggttgccgtttctttgctcgagaaatggtagctttgggattaggatcgagaaaggctagctatgcgctcaggtacggctgcctgtgcggggttggacactggactaaagagagacgacggcgatccgatcggattttttcgattttattttttttgtccgttttttttccatgcgggtggtataacttaaccgtacgggataatcgacttaatatgnnnnnnnnnnnnnnnnnnnnnnnnnnnnnnnnnnnnnnn

SEQ ID NO: 27650 - DNA, 663 bp, Oryza sativa
aaaatataatcatgtgagatcttgttgtaaagatttaattggtacgaacacaacggtgtaatcggatcatagatcggataagtagtttaagagaaaattgtatttgaagtatagatggatgatacctcttatagatggagtggtagctagtttagacaaaccagctaccactagctatgtagttacgtccaacccggagacagtggcagtggggacaagagctcaagctagagagacgacggcagatccgggaggacgacgcctcccctgctgcgagtgacggcggcagcagcgtcctcctggggcttccacaggcggatcaggcggtgtcgtgcggcttcccgcgagcggatctggcagcgacggcggagtcgacggcgccgcgggctgatctagcggcgactgcggcttcccaccggtggatccgatggcaacagtggcatcggtggcttcccgtgagcggattcgacggtgacgaagatcaagataagatctctgtggtttttataatttttcctgttcgttttctctttggattgttggattggattttgtatatatctttgaatttgtgttttatccgtcttacgcgatgtgttactcgttcgtgtgagaacggatgccatcattcgatcggacttacagatggaaaattgatgtgac

SEQ ID NO: 27651 - DNA, 1088 bp, Oryza sativa
tgtaaatatgatacaatatatgtcatacttaaaaaaggctatttatataatttttctgaatccaacaaatagtaaaataccatgtaaaatgtcgaacacttttatacgttaaaaacgaagcaattacttctaatagctactcgcctactgcaacttcctcacgtaaaaaattagtcagtccaataggtataatgtataattgattggtagatatataatccagagattaaaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacatagaatgtttactgttagaggttgtttggatggtgactatactttcccataactttggtaagctattttgaccatcttagtgtgtttgcttggttgccacatttttatcatgtcacactttttgattttatgatcccacttattatagacacatatctttaccaacactttagctatagaactttgataaactgaagcaagcatccaaacagcccctaacaccaacatatttctgactataatatgtcttttcttctattccttttattttttgtaacttattttcttgggtataagatagaatctcttagctctgttttggctttgcatgcaatccaaacgccggtaacgtttctgctcatcccatgtcgatgtcgcggctgttcccggaagccacggaaaatgctgcgcgcctgacgtccgacgtcagagaaaaaatcggacgcctcggctccggcgcctcggacgtcaaagaaaaaatcggacgcctcggctcccgcgcctcctgcagctctagttttaaaacgatttctctcttaaactaattatccaatctacgatccaatcacaccgttatattcattgcaattaaatcttttcaacaagaccacacatattatttttcagacaaaaaaaattttaccctctctattgatatttttttatggtgcaaatgatgatcaaa

SEQ ID NO: 27652 - DNA, 742 bp, Oryza sativa
  unsure (1)..(742): unsure at all n locations
nnnnnnnnnnnnnnnnnnnnnnnnnnnnnnnnnnnnnnnnnnnnnnnnnnnnnnnattattctagttaacgcgatcatgtggacatccaaatttaatataaattaattgaaactaaataaaactcctagaataaaacaaatgtcaaatcacctccaattgcatagaaagagatttgattatttattatgtattatgaacactgctggaatgttcccctttcaatgttaattgactgctgtgatgaatgcaattaaaaaaaacacaaattattgtgcttgcaatatgttgttttatcatattggcaaacacatgcttagcacgcgcatgattacttctagtagtaaatataggttgtaagtcaaaacaaatatgtatggtatgcacaccttgaggcattcacacgaatgtacgaggcacttggacttctggcatctgcacccattagcatacatccatgctcattttcctgaaatttactttatgtgcatgagttctcactacaaaccattattgaaaatttgaaatcaaaacagcataagattaattatttgggggtgctccaagaaagaagaatgcattaccggcactgcattagagctctggggttcaatctcacttgcatcttgaaccctaacaatcttgggatcaaatgctctcggatttttcatcttgatcatgtccacacgctcctccacaaagtcctcatagtactctctgttcttacagttagtgcaacggcag

SEQ ID NO: 27653 - DNA, 685 bp, Oryza sativa
ccggacacgactattatctctaacaaactctaagatacacataagtctttacggcagacttttgcccaaacatatctctaaggaaactatttaaaatatcctaattaatagatacaattgcctatctgggagcttatctctatgatggcaatcctttcgtagcactctgatcgatcccagaaacgatttcataaccatctcaatgaaatcggctgtatcggctgtcccctgtccaatgtcatctcagccgatgcagactctagccgatacctccgcagccgatgcgcactctattcttcgatcacaatccctttgccgaatccacttcgattcaaatgccgaacttggttcattacttaccaaatttggtcgttaacaccaccccctatcaaacgtcataaaacgaaatggcatagtgacgaatagcaccatcgtcatgaggaatttgtcacagaagatcacatttcttgtagtgtgcggcgctaaacggcgacggcaatgcgactcggctagcggcggcggcgcgcggccggcagtgacggtggtggcagcggcgcatggccgggacggcagcggtgcttagcggcggcgacgctagggttttggtggggttacacttttagggttacaacaacaacgcttaaagaattaacacctaaactaggagatcacgagaaggttcctc

SEQ ID NO: 27654 - DNA, 672 bp, Oryza sativa
tcgattttcccaggcggtcatattaagtcgattatcccgtacggttaagttataccacccgcatggaaaaaaaacggacaaaaaaaataaaatcgaaaaaatccgatcggatcgccgtcgtctctctttagtccagtgtccaaccccgcacaggcagccgtacctgagcgcatagctagcctttctcgatcctaatcccaaagctaccatttctcgagcaaagaaacggcaaccagccgatccactgtgcgacgcaacacaaagtttgcaaaaccatgacgaaaagaagaaaaaggctggccgatcgctccgcctccgccagcagtcgtcgtcctcgcgccgtcgtcgtcgcgctgccgctcatcatcgcgccgccactcgtcatcgccgtcgtcatgacgcccgtgcgctcagtgggaggcagagagagagaggagagggggatgtgaggagaggaaagtggcagagagagaacatgagagaggggaggagaggaaagaggcgtgtgggagagaataaaaagaaaaggaagagagattgtgtgaaaaattggaagtgggtgagagggaaaagagtggatagagagagtgtgaaaaatttgaagtgggtgtgaaggaaaaaaaagaatgtatttttccgtgtggtccacttaagaggtccgcacgtgaaaat

SEQ ID NO: 27655 - DNA, 476 bp, Oryza sativa
tggttctgactgccactggcgccctggggaaagttgctagggttgaacgggcggtgctgatgaacgatcatggtggtaggtccaccctgctgcccgggagcgaagcgcggcctctggtgacttccctgaggtgctctgaactgtgcggccttcctcttcctgtccatcttgttgcgttgatcctcctgacggattgccttgtcaaccagcctctcgaagtcagcgtagtccccagatatcagttggttggtcagctcgtcatccagacccgccatgaacttttcctgcttctcggcgtcggtgcggacatcctctggtgcatatcgcgcgaggcgattgaactcatggaggtactctgtcacagtcctgttgccctgatggagcgcccggaattccctcttcttttatgccacgaccccatctggcacctgcgccttcctgaagctacgacagaactctgcccaagtgacttcagt

SEQ ID NO: 27656 - DNA, 371 bp, Oryza sativa
gaagcatatatactcgtctaatagctaataaacacatatctgattttcacagggaaaggatgtgttttcacctatgatgcacctgggtcctatgagaggactggctacagtgcacagggaacaggatctgctttgatcatgccagtgctggacaaccaactaagatcacctagtccactattactccctgcacagagtatggcactgaagttttactagtttgtcacctggcatgtgcattatgattgatcatgtcatgtgatcagctgggtgatttgacatgcaagattatgtgccacccagaaataagtgctcaactgctgatcagaatagcatcactagtcctaagaatatttctgatgcatgcaaga

SEQ ID NO: 27657 - DNA, 579 bp, Oryza sativa
  unsure (1)..(579): unsure at all n locations
gcgaattcgagctcggtaccctgtcgatacatgatagccgatgtgtttacatcgccttgagatggccgatatggttatattgctcttagttattttttatattgtaatcggttgtgttttgccgatatacaatagccgatatggttatatcgcccttagttgttttttatattgtaatcggttgtgttttgccgatatacaatggccaatatggttatatcgctcttagttcaatttataattttattaatgccttcgtcattgtaaaattaggggggcacatatattacaaaatgagctatcctattacaagaccaatcatctagacaagtaacgctggatagccgacacagcccgttgtctaatttgatctacttcttcaatagcttgaatgtcttgggtgtcagttccagagatgaatttgagggacttggtcatgtcagccacattttttatagccgatctcaatctagacttatgttcttcaacagcacttgggagattggctagcttctgcctttcaagattcaannnnnnnnnnnnnnnnnnnnnnnnnnnnnnnnnnnnnnnnnnnnnnnn

SEQ ID NO: 27658 - DNA, 454 bp, Oryza sativa
  unsure (1)..(454): unsure at all n locations
nnnnnnnnnnnnnnnnnnnnnnnnnnnnnnnnnnnnnnnnnnnnnnnnnnnnnnnccgaatccacttcaattccaatgccgaacctagttcatcacttaccaaatttggtcgttaaaacatgccccccaagtccgcgatattggtaatgttgcggatttgctcaatttccttcccgagtagaactagggtttccatctccgattccgttttggccgttaccacgctttcttttaaatagtaaccactgcttggcacttttcacagcgtcagcttccgttttaaccgctctagccaaaactttccccaatctcttcctcgatctttccggcgacatctttgagctttccggcgatcccgcaagcgactcccagcagcgccgacctccatcaccgacaatgtcgacctccgccgatccttcgagcgcgccaactgggtaccgagctcgaattcgcc

SEQ ID NO: 27659 - DNA, 403 bp, Oryza sativa
gaggctagtgagccgccgctcctcttctgccctcccgtcggtcgccctctccaccggcgcgacggacgccgtcgttcctctccctcccacccgtcgactggtgtgcaccaccaaccctttcccgcaggcagctgtgcgccgctcccccacaccggtccccgcgcgccgtcactcctctctcaccctaccgctggccaccgacccaagcgcaccgccattcctctccctcccccctgccggccggcgtgtgccaccgctcctctcgcgtcggaggtgcgcccgacgtccttggcgaggtcgtcgccgctccgccgcaaggacgagggagagccgagagaagaagaggagaggagagggagaggggaggggagccggcgagctcagattggggggcagcgggagc

SEQ ID NO: 27660 - DNA, 643 bp, Oryza sativa
ctaaaacctgttttccggtggggttgggtgcatgccagttgtggaaagtaccacccgggcaaataaaaggattaagctcaggcctctgttgcaaagcactaccgtactaaccacatgtctaatgggtaaggcttaactcggtgctcagtctagtcctgaacaaaaggatacagatagagatggatgaagtcgttgcgatgatggatatctctgaggcaaatgaaggctacgcgagctgcggctcggtaatcgagatgtctaggcaaattaaggctacacgggccggtgtccgttagtcgagatgtcatggcacgggactagtacgtgggtggtctcacccctatgtgtgttgtcacatcctgatttttgtttcaggatttataaattatttaataaattattattagaatttatattaaatgttctttaattttcaagtgaagttaaatgtgggaaataaaatttcctaaatttaaagcatggatggatttaatttttattaaattctccatgattaattacactctctgaaattttctcggatttttcggagctcaattcctaaatgatacaaagaacagttcagtaattagttaatcaattaatgatctaattataattgttaagagcttttcttgtttaa

SEQ ID NO: 27661 - DNA, 628 bp, Oryza sativa
ttcgctggaggatcgttcgcacacaagacaactgccgaaggaaaagaactcttagatctgatcttagagaacgattctttcggccaaagcgaagcatgcccggagatcgagattatccatgagtatcctctgcacgtggagtcggaacccgactcaactgtcgaatcctcattccagtcgctggagccggaggaagaagaaattcatcctccgaaaattccattccaattcaggggtgatctttatgaaaattatgagaacaccctgaattattccagcgaaaagaaggctcatcccaagcatgagccgttcgagaaggtgatgtttgtatcttcgttcgtttcttctgaatctatttcccatcttcatgaaactgaacgtccctcatcaccctcgatcaagcctaagccttgtccctctggccctcataatgatgttctcgtttatcatcatgaaacaacccaattcttgcacgatgtatctcttgagaaggaaaacccttaggccacggacaagcttgagacattgactctggaggacgagagaaaacattccacatatgagcatgaaagtttctctttcaaaaccccccaggattcatgctcacataaggaatccccagagtcct

SEQ ID NO: 27662 - DNA, 695 bp, Oryza sativa
tttccataggtgtgcctcctccctttttcataaaactgagaaaagtgatcaatggggaaggggttgtggttttgctcatcatggaggtcatccctgttgttgaagtgaatgtgcaagagctccttgaatgcacggcagttgatagagcatcgaagggtccccgacatccacttcatggcatcacaatcgccggacacctacacggtggcatagaattgccggatgaggtcttcatcaaaacgttgcttcatggtgacaatcttatcaatgccaacgggcttgaacatctcttgcaaacctaaaaactccggtgtctcaccaatgtgcctccaagaaattcacttgtgttcggcgaaggctttgtttgcatatacttgctcatacacggacttttgataccgtgtatggaatctcagatcattgcaatcattaggcctccggaattgatcgtgatgacagatgataatgtattgctaggcattcctcaaatagagcacaaattggatggtgggatctcgaggactcccatcatcactttgactcatcatactcaacatcggcacttgcattattatcaccaccatcactaccattgttataaccacttactttcaactcatacccctcaatatttttcataaccccatcacctctttgaacatactcatctccgtttgattcctcattctcactga

SEQ ID NO: 27663 - DNA, 713 bp, Oryza sativa
  unsure (1)..(713): unsure at all n locations
ccaagcgaatcggccaatgaatttccggaaaagaagcgatcggcgaatgatcatcgatgcatatgcattcgatcgttgctgtctatacgtcacagatcacagatcgaataactactccttgtgttgtcgcaaagtaaaagagaaagggaaaagcgaaagtaaattttgttccaggaatgaattccgtggcaagtatacatacagggcactcttgtgccgcacaagatagaaaatggtccggaccgtgcggtgagcaacgaggcccaagcacgtacgggacgaaagcgcgataaggcctctattcgtggcgggccgtcacaggcacgacccaagccatgccatcagtcgctgccgcaatcaatcggtccactccactagacgccgcccgccagtgccgccgggcgacgagaaagcgctctgctaccgcctgatccgcgcgcgctggcgtgtacgccattccgccgcgatcgagccaattcacgtggcggccggaggcgacgagatgccgtttttctccaggtctccacgtctccgcggcacaggagccgcggctgccttcgagttcgtggtccgaaatttgagagatgacgcggtgcggctgctgcacgggcacggtgccggtcgtaagctagctagctagactgcctgtggcaacatctcgccccatattgcaaannnnnnnnnnnnnnnnnnnnnnnnnnnnnnnnnnnnnn

SEQ ID NO: 27664 - DNA, 789 bp, Oryza sativa
cctctcctttgagagggtcgtgaaggacaaaagagagagggagaagacaaaagatacatgtaggggcgtacacgtatctattccctctatttcaaattataagtcattttgattttagtcaaaatcaaactactctaaatttgatcaatcttgtggacaaatatagtaatatttacaattccaaattagtttcactaaatctataattaaatatattttcataatatatttgtcttgggttgaaaatattactactttttttctacaaacttagtgaaccttgaaacaatttaattttgaccaaagtcaaaacaatttataatctgaaaagttgtttctaagaaacaataccatctgttcctttttaactgccaaaaaagaccggcatatgtggactcgatccattaaagtcgtgcattcgttgtgagacttggtagcgaagccaagcaaaccgcaaagcactaatcagaagtaccttagacaaagatttgatcactgactcgatgaactctatcatattggtagctacatatggacatggagaccggacctgaaagtgactagcgacaagaaagatcaatcactaagccagcatgcatcaaccaatcatagtagccacataatgtccttagatatttcagattacgataactaattaaacagtgtaacatttcaatgttacaaaacaatcctctagagaagtggcagggatcgaagaagataacaacattatacttgatcctgggagaatttctcatgggattgtcgacaacaagtcctgtatatctg

SEQ ID NO: 27665 - DNA, 491 bp, Oryza sativa
  unsure (1)..(491): unsure at all n locations
tttctctctctcacccagtgatatcagacggcacgacccacgagaaggcacctagtctggcgccccccagcgtagtacggtgggcgcggactccgtcggtggaggactctcctcgccactgatcttgtggcatccgccctcccctaccacgatgttccggcaaaagaagtagaacaagacggcagtgacggttatggaagaagaacatcgccgacagcgacaggagacagcagtgcgatggtgtcggctagagtatgagtacgacgacgtcgtctgaagaatgaggataacgtcgccggtggctgcagaataactatggcagcgacgccggtgaattttttatttttgaattttttgtatgatttttccttttcgcatgcggtcagcttaagcgcgcacgtgcgaaaattagattttcgcatgcggttgcgctggcagcatgtaaaaatcatannnnnnnnnnnnnnnnnnnnnnnnnnnnnnnnnnnnnn

SEQ ID NO: 27666 - DNA, 735 bp, Oryza sativa
  unsure (1)..(735): unsure at all n locations
ccataagtgcttgtggccaccattgtacatgtcctaacgcggcctcccaaggctgatcggctacgggtgtggttggtgttgatgtgcgggaatgggggagagacccgtcgctgcctctgatgccaccggatgccgtggcaggccttgtctgccaccaagaggtctggagggagagggatggatcagctgccctaggagatgtgtgagggagggagtaggtgtgatggagatggactagctgagagagagagagagctgagggacttagcctcgttggtttgtcactgtgctagatttagcctcgctgatttagattgcgaaaatgaattttcatatgtggggtcgaaagaggtccagtgggcttggcagtcaccacccatgatgacggactgatagggtggcgtgccgtatgttgggatggtaatgggcttaacatcttgacctacaaaatatgatggttgggccaaaaagggttgtgctgaaatttaataattttcttgtgctcaaaaatttaagagttgaaggggcttgtgaaagagtagtgagccttgaccatttaccacccctaaccctatgttcgtacattcgcgcaaacataagggaggaaaggggcataaaatggaataagttcactttgacttccttaacttgngggcgaatttgatttgaatccgtgaaccgaaatacaagatatcttgaacccttaataattttaaaacatatacatttgactcc

SEQ ID NO: 27667 - DNA, 765 bp, Oryza sativa
cgttaacaacaatgaggttgatcgagtcttctacagtggaagcaatacggatcaagatctcttgtcaatgagtagcatagatcgagacctgtggcggcatggattgaggcctttctagtggctatggcacggatcgccaatggttgagaggcggattgaggactttccgtggtagtatggatccatgcttttctaactgtggcaatagcgattgaggctggctagacgtgatggtggaggcgagtggagcaggaaggagacacaggtggtgagatatcgagcggatgcgcgcaagacccacttcttccattttttcagtatgtccccaataggagttatgtttttccgatcataatgggtctttctgacaattattagtcgaaaaactggccactgaagctcccattttcggtctagctgacggtactttacactggttttggcaatccctaggctataagcgaacaaagcagaggtccaaataataataagaatagttttacaataaaaatattttcgtagccacttcagcgcaattgtattcttggctctgttttctaatcaaacgatgttactccttttctttagctatatatatatttcttatggaagcttgtgtttggcccctcaatttgttactagtacataatggcgccaaaaatatggtctctatgtagatttgcccttactttcctataacctttatgccttttatttgctttgacatcaagcataggacataattttaccctatttgggttttca

SEQ ID NO: 27668 - DNA, 597 bp, Oryza sativa
ggcatgaatcaattgagcaaactttcaaaacgtgatctacttgtgggcttgaaagatgtgaagtttgagaaagataagctttgtagtgcttgtcaagccggcaagcaagttgcatgttctcatcctactaagagtatcatgtccacatctagaccattggagctcttgcatatatggatttgtttggcccaacaacctataagagcattggtggtaatagtcattgtcttgtgattattgatgattattctcgccatacttgggtgttctttttgcatgataagtctattgttggcgagcttttcaaaaaatttgcaaaaagggcctaaaatgaatttagttgcactcttgtgaaaattagaagtgacaatggttccgagtttaagaataccaatatcgacgactattgtgatgatcttggcattaagcacgagcttttcgctacctacttacctcaacaaaatggtgtagtggagaggaaaaatcgtacattgattgagatggcaatgactatgcttgatgaatatggtgtttccgattccttttgggcgggagccaataacaccgcttgctatgcaactaataggcgttattttg

SEQ ID NO: 27669 - DNA, 29864 bp, Oryza sativa
ctacctcttgtgatgatcttgtggatatgcctagctctagctctagctcttgtgtttctatttgtgatgtctcacttgttgttgagaacaatgagcttaaggagcaagtggccaagctcaacaagagtttggagaggtgtttcaagggtaagaacactcttgacaagattttgagtgagcaacggtgcatccttaacaaggagggacttggattcattccaaagaagggtaagaaaccttctcaccgtgcactcattttgtcaagagcaatggtaagtattgcttcaagtgtcgtgaggttgggcatttggtgaatgattgccccggtggtaagccttctaagacatgcatgtttgattctcattatatgcttaggaaggctcatgattgtagtattgttgctagatatgtgggttccactatacttagtggtaaaaagaatgccatttgggtgcctaaagctttggtctctaacctccaaggacgcaaacaagtttgggtacctaaaagagcttgatcttcttttgtaggtgaactaccacaccgatgggagccattgggtgcttgatagtggatgcactcaacacatgaccggtaatagggctatgttcaccacatttgaagtaggagggaaagaacaagagaaagtgacatttggaggcaatagcaaaggaaaggtaattgggttaggtaaaattgctatctccaatgatttgtcaatcgacaatgtctctcttgttaaatctctaaatttcaatttgctttcagttgctcaaatttgtgatcttggcttgtcatgtgctttcttcccgtaagaggttattgtttctagccttcttcacaagtcttgtgtgttcaaaggttttagatatgggaatctttatttggttgatttcaattctagtgaagcaaatttgaaaacttgtttagttgcaaaaacttcattgggttggctttggcatatgaggctagcccatgttggcatgaatcaattgagcaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattggagctcttgcatatatggatttgtttggcccaacaacctataagagcattggtggtaatagtcattgtcttgtgattattgatgattattctcgccatacttgggtgttctttttgcatgataagtctattgttggcgagcttttcaaaaaatttgcaaaaagggcctaaaatgaatttagttgcactcttgtgaaaattagaagtgacaatggttccgagtttaagaataccaatatcgaggactattgtgatgatcttggtattaagcacgagctttccgctacctacttacctcaacaaaatggtgtagtggagaggaaaaatcgtacattgattgagatggcaatgactatgcttgatgaatatggtgtttccgattccttttgggcggaagccataaacaccgcttgctatgcaactaataggctttatttgcatcgtctcttgaaaaagacttcctatgtgctaattgttgggaggaagccaaatgttgcctattttcgagtttttggttgcaagtgttatatttaccgaaagggtgttagactaaccaaatttgaaagtcggtgttgtgatgaagggtttcttctaggttatgcctcaaatagcaaggcataccaggtctacaacaagaacaaaggtattgtggaagaaaccgccgatgttcaatttgatgagactaatggctcccaagaggggcacgagaatttggatgatgtagatgatgaaggcttgatgagagatatgaagaacatgtctattggggatgtcaagcctattgaagtggaagacaagccatccacctctactcaagatgagccatctacttccgcttcgccaagtcaagcttaaattgaagtggaggaggagaaggcacaagatccacctatgccaccaaggatacacaccgctctttccaaggatcacccaattgaccaagtgttgggtgatattagtaagggtgttcaaactcgatctcgtgtcgcttcgatttgtgaacactactcgtttgtttcttgtcttgagccaaaacatgtagatgaagctctttgtgatccggattggatgaatgctatgcatgaatagctcaacaactttgcaagaaacaaggtgtggactttgattgaaagacctagagaccacaatgccatagggacaaagtgggtctttaggaacaatcaagatgagaacagattggtggtgagaaacaaggcaagattggtgacgcaaggtttcacacaagttgaaggtttggactttggtgaaacttttgcccccgtggcaagactagaggctattcgcatccttcttggatttgcatcatgctttgatataaaactatttcaaatggatgtgaaaagtgcttttctaaatggtgaaattgccgaacttgtctttgttgaacaacctcccggttttgaagatcctaaaaattctaaccatgtttgtaaactctcaaaaggtctttatggtttaaaacaagctcctagggcttggtatgaaagattgagagattttcttttgtcaaaggatttcaaaattggaaaagttgacaccaccctttttacaaagatcattggtgatgatttctttgtgtgtcaaatttatgttgatgatatcatattcggttctactaatgaggtattttgcaaggaatttggtgatatgatgtctagggaatttgagatgtccatgattggagagttgagcttcttccttagacttcaaatcaagcaactcaaggatgggacgttcttgagccaaacaaagtacatcaaggatctactcaagaggtttggcttggaggatgcaaagcccatcaagacacctatggtaaccaatgggcatctcgaccttgatgagggaggtaaaccggtagatttaaagctttatcattctatgattggtagcttgctttaccttaccgcatctaggccggatatcatgtttagtgtttgcatgtgtgcacggtttcaagtcgctcctaaggagtgtcacttagtggccgtgaaaaggattctaagatatttaaagcattcctcaattattggcttgtggtacccaaaaggtgctaagtttaagctagttggctattccgattcggattatgccggttgcaaagtggatagaaagagcacatccggtagttgccaaatgcttggtagatcccttgtatcatggtcatccaagaaacaaaactccgtagccctctctactgccgaagcggaatatgtttcagcgggtagttgttgtgcccaattgctttggatgaaacaaatcttgttggactatggcatatccttcaccaaaaccccactcctatgtgacaatgatagtgccataaagatagccaataacccggtccaacattctagaaccaagcatattgacattcgccatcacttcctaagagaccatgttgtcaagagtgacatagtcattagccacataagaaccgaggatcaactagccgatatctttaccaagcctcttgatgaaacccgcttttgcaaattgaggaatgagttaaatgtcatagatttctctaatgtggcttgagacggtgcaccatggttgcttcttttgcatattgtatatttactctcatttgcttttatgctttggacttattgccatttggttcttcattgagaaaatggagcatgtcacattaagggggagttttgcactcttgcatgtgctctacccctctttgtctgtgagcaaatcaactagtggtgctagtagtattttcaaaacgcccaagtcaacataagtcaaaacttttgcaaaatcaatgtaatttgaaaatgtttcaaaaggtttcctatatgttttccaagccttacgttgcaagaaaaatgatttttgaatgaaaatgccattttggccctcttttgaagaaactagattcttagttttggccaaaatgagatttatccccaaaataagattgagaaggaatttgagaaaagtttcaaaacaaagttggtagagaagaatatttgaaatgtttttggtattcaaacctatttcaaaaaccaaatatttcaaaagttgtttgaaaatcaaattcgcccaaaaacccctatagaccataaaaggtcacctcctagcactcaagtgagttttgttgcaaatcttcataattttcaaatgttatgaatggttggcaatatttcaactcacacatttcaaaattgctccaaaaattgctccaaaaatctcgtctgaccggcctggtggaggcggtctgaccggcctctagggcccggtctgaccggccgcatatagccggtctgaccggcctgggatggtgggcccaggactttgtcctttcttcctctttcttctcctacccgacccctcctcatctgtcgggtcccaaaactaatgattcagaaaccaacatgtttagactgtatcaagccctggatcagtagattgatacaggttcaacaatctggatcttcattgcatacatttgatcaaggttttaaaggagattcctttacataaaataatagggtatttacaaacttttggctaactattacagcagaagctatacgatgacacaactctagtgttttgctatagacttaaaccatctatctaatctatacttgagaattaagttaggatgagactaacttatatgattgaactcccggcttcggcaagactccaaattaactctgaaaaaggtggggttgaagtaagggtgagtacaacatactcagcaagctattatattcaataataaatgtatgaaatggtaatatttgagtagagctaggtttaattgcagaaagctgagaataaagaagtagaaatcctgaaatatttgatatgcaacagtatttaataaagtttgaaattatgtttctaaccaagatgccattgtgagtcccaatgcttgataaccgtgagcacggctatttgaatagttttaataatattcatactgcagtagatgtacgctttacccgcaatccatgacatgccaaacacattagctttgtcatggcaaagcttttcggttactaacatcagtggtacctgttccatgaactctagtccccatgcgctctgaacgtaatgttatcagcagcgtaaggagttttggcgttcccgaggtttttagagagaactagttgagagaccccgtcatctcaatcaggttttcataattcacacacacagctcacgagataatcaagatatttacctgcgcctcggtacatatcacaatcgccctgcttggcgtaagtttgcctcctgcgcgaggacttaagaagaaccactatacagaggtaccacctttgctagataacttaatcagctaggtctatgcccatacgagaattgtggtcgtactcgtatgttcttcacatgtacttggcaatcttatgtcggttggaacagtagtagccacccggaaatcaaccatttctaccgtactgtcccaatctaagttcattatgttttatgcagtctaactaggcagggctaagcaaaagctagcatatctagtttgctatgttcaggttatgcatttgaaatcatgtgtgactaatgcatagaatagagatatagaatatagggtatttatgctcaaaggagaggaataataacttgccttgctccaacgcagataaaaatccgatataggcaacctgattatctgatccttgaaacaccacaggttgccatccaaaatataatagactctactatagaagaggaagatccaaattcaataaaagccatagaataacaagaaaacgacaaacggttaagaggctagggtttagggtagggtataaggattattaggctaatattttatatgcaggttctaaagagttggtggctggggtggaaagggaattaagaggctaaggtcacctatgttttatgtgcagactctgattggttggtggatagggagtacagtggataattgaattggttgagcagatatgtgactggtattggctgataataggtttgggtaggattatacttagggtttggttatatttaggccgattgaggagtagggaaatatatcggccaggctctatattttatgtataggttctgggtagatggagagtaggtggctaagatatggcggataagtaatattgtagtggatgtgggatttggatggtaggctgattaaggtttcagttgtctaagccgatatcgaggtacgataaatatcggctagggtttgggtgttcgcaagtcgtcgctaaagcatgacgactaggtttggtgtcttctctagccggtgtcaatagacaatataacagccagagggatgggaggtttgtacaggtttagcgaggcagaagtgttactttgacaaccgtgagtggcggcggagcggctaggatcacacagggcccgagagctaactgtgcggcgtgctatggaggtcaaggaaatagtgaagctccgaccactgtacgcatcgaggcgtggggtgccaggagcagcacttcgaccttgggtttggttttgccgggctttacaaccaatggttcgacgtcggggccaatagaccgcaaacgtccccatggaaggtgtaaagttccaaccgacggctttttagtggctaaagggtattttgggataaaagaaaatatttaaaaaggcaaatataaattcaaataaaatagcaaattgggaaatgaagcatttgaatttatatgaatttaggtccaggtttcactgagatcggatctacggtttaagagatatgagcttctaaagaataggatttgaattaaatctagaaaatatgaaaggttactattcatgggcctacctgtcagtgtctattcccttttctcttctttctcttcttcttctcgtcttgttcttcctcctgcttcacagagagccgagagaagggagaagagagggagaaaggggcgctggtgctccggtggtcgagaggctgcgacgtcggcggcaaaacatgttcctgagcgacgcgcatccagggagggtggtagctagctaaggtggagagtgagatggccggaacggcgacggcaggagctcaaccatggccggcatggatggtggcggtgatggcttgtggtggtggctaaaggagaagggaaaggagaaaaacggattcatctcgccgaggcaaagccgatggcgcgagggtttgggttgtgaaactatggtgaaggagatcggccgacggtaggcggcggccggacatggcaggagagagaggaagagctcgaggctctgatgatgtgtgggggagaaagggacggctcgcaggtatttataggcggcagaggtcggttgctcaagtcggttcgcagaggaggagaaggaggacatggcgacggcggcgtggaaaagacgatcacggcgtcggccttgtctgttgattggtcgatgatggcggttcgctccaggagctaacgtcggcggtgtgaggtggcggatgacgtcggcaacggttgcttggtgtcgaaggcaagctggcgccggcggtggaggagggcaaggcacggcagcggcggaggaggagagagcgacgacaccgatttcttagcggcgacggaaggtgttggcggcggcgtgcgcacctggaagaggaggagagaggcggttgcctcctgggctagctgggccactagagagaggagggccgaaagagagaaaagaagatctcggcccataaagaattatttgtgaatttctaatggaataggatttgtatttggagggaatttgaatagggaattttgaaaggaaattatatttggatataatttccaaaagggatattttctagtttgagtgcaatatttttggaagtggaatatgggcaaatttatattgatgcactcaattgtggggagagggatatatgaataaaagttgaatatataattgggaatgtggaaagaaaaataggtggaggaaaaagaatagaatttgaaccctaatatatatggcatgggtttcaaggaattgcttgaggctaaaaggaaatttaggtgacaaggatataatttattttcttagcacaagagcaattattcacaatatttgtaataatattattcttgtgccgagaaggaaatcaagccacaagaattaaattagcggctagatcaaaaggaagaattttgaaaaaggggactaaggataggtttggaatcaaaggatagatttaagatcaaaggatgggtcgacaattaattccaataaaattggaattgtttggtttaggttctaggacaatggtggagaatttcttggaccataattcataaaaatagaaaggggttttcaaactaaatttgaatgaaagaattttagtcaaaagaaggttttaaaccaaatcaagaaatacctcaatttaaccaaatatatatttttaaatgaaaaacacaaaagagattaaatactgcataaggattctgtgcaagttagttttaggaggtccctctaattatattgtcctaagtttaagaagttattaaaaacataagaatcggcatgatgcaggattggaaaatggcacattttcaggatgttacatcatcccatctcatctcttcacttctccaactcaaaatttcttctcctctctcctctcccaaaccctaaccacctccctacaccaaatccatccggttcaaccgtcaaaatcactccggttacaccgtaagtgattctcctccgcttcctctctctattccatggattgatttgtgttttgattgagtttttgatccatggcatggaaccctaggtgaaggaagaggtgttcttcgatttacaccaatagagggtagtttcttggtgtgattcaactccttcaaccggtaaatcactctccctcttgtgcattgttctcaaatcggtctatttcaatctctagggttaagggtagttttccccctttgttccaatcttaatgaaatagacctacaccttgatatccatgctcaaatcatgtacaatcttgttgtagcaaatatttttagagtcatttgtatgtgatggtgaaagggatttacttttgcacttgtcagaggtggtctgaccgggtaccagccgccggtttgaccgcgctcggccgtcggtctgaccgacatatggacggcggtctgaccggttgttggccctcggtctgaccggccgttttccaccggtctgaccggccgctggacttcggtctaaccgtccctgacatgcagtgtgcagtttccttttcgcctaacatagtgtcttctaaaaattgttgcttatttatctttttttatccttgtttctcagctatgcctccccgcactcgccgtggtcgtcgtgagcccacgcttgatcccgtcagtgagaatgaggaatcaaacggagatgagtatgttcaaagtgatgatgaagttatggaaaatattgagggggatgaggtggaagtaagtggttatgacaatggtagtgatggtggtgatgataatggcagtggcgatggtgaggatgatgaggcaagtgatgatgggagtcctctcgatcccaccatccaatttgtgctcaatttgaggaatgcctagcaatacactatcctccgtcatcacgatcaattccggaggcctaatgattgcaatgatctgagattccatacacggtatcaaaagtccgtgtatgagcaagtatatgcaaacaaagccttcgccgaacacaagtggatttcttggaggcacattggtgagacaccggagtttttaggtttgcaagagatgttcaagcccgttggcattgataagattgtcaccatgaagcaacgttttgatgaagacctcatccggcaattctatgccaccgtgtaggtgtccggcgattgtgatgccatgaagtggatgtcggggacccttcgatgctctatcaactgccgtgcattcaaggagctcttgcacattcacttcaacaacagggatgacctccatgatgagcaaaaccacaaccccttccccattgatcacttttctcagttttatgaagaagggaggaggcacacctatggaaaggtggtgagtttgagggctatcccaagtctgatcaaccgcatagtgagggccaccattctcccaagatgtggcaacaatgatgacatttgcggcgttgcatggcatgtcattgaagccatcatggatggtcgtcggtttggtgtcatcaaccttatgatgaaggagatagccatttccaaggggactattggacaaggagtttactatgccccctacataatgagattgattcaaagcaagttgagacaaattggtaacaacttaaaagaacacaaagactacaagcctcatctccaactctccactcctagagctcctcgtgtgcgccaaccaacatttgatcaaggtgcaagctcaagtgcagcccccctcctcctcatgggtatgatccaagtgccttcttccatccacaatatgcatactttggaatgcaacccaacgaatacttcaatccggtgcttggggctattaataccctaagtgaaagcattcaacgcttatccaccgggcattaagcattgcatgaggatgttcatggcttacgcaccgatgttggagatttgaatgcttccgtgggaagattgcacactagggtgggtgtattggattcttgagtccaaatgttggagagcacccaagcttttgtatatcatcgccgccgtgatgctcctcatccttcatctttggcacgtcctccttctcctccacaagaatgaagacctttttggtactttatgccaaaagggggagaaaaatatccttaggtgtgctttatgtcttgtgggttgggactagtggtagtgaggttagttacatcatatctaataggttaaggtggtttgggctatattatgtatgggtatgggctattactctatattgtgtgttctttatcattttgttgaactctatgtcatttggacccttcgtggttttgtaatagcctatgtttatttgtgagcccttttaggatgatttgtgacttatgtgttttgaatggttaagtgatgtgaacttgtgcgatgatggatggtgtatgtgatattgatatatatgtgaccatcttatgctcatggatgaatatttcttgaagttcacattgagatattgctcttgtgtttgtgatttgttgaaatgtgcattggctccatatttgctatttgtgattgttatgcacatgtttagggggagcttttgcttttcattgcaatatatccatgtgatttaaatttgattatatatatttgtggtgtttgtcatcaattaccaaaaagggggagattgaagcatctaggcccccggtgttaattttggtaattaatgacaagcactaattgtggactaaccgttcttttgagctatatttttaagttaggttcacattatgtgtgcgtatgggtgtctacctatggattaaaattgacggcacaaagctaaaggaagagaagacggtaaactaatgttttcattttaaattgatcgaggcgttgggcgatcaaattgtgctagtttatttatagctttgccgtactattaagaggggtaatgacctagcaaagagatgattttaaattgccacattaggtgatttgcatttagacttgtgctcacatttcatcacacacagacaaacactttgcctctcactgtcgggcctgactaggggcggtcagaccggccacatagtggcggtctgaccggcggccctcgcccgtctgaccggccagagagcagcggtctgaccggccaggcagtggcggtctgaccggcgggtgtcggccggtttaatcggccggccatatggccgggatgttgtctcggtgtgccgatcccgaggcgccggagccgtattcggtcagaccaagctggtggcggtctgaccgagctgaggccggtctaaccggtcaccccatgtcggtttgaccggccggggcagtggggcccaatgacagccctacaacggctagaaaactagctgttatagagtagcacggtctgaccggccacatacctccggtcagaccggcagagcacagagttaggggatttcgcccccaaaggctatttttggttggtgggagtataaatactccccctccagcagcaagaggactctcttggcacccaattcaattgcatacaccccttgcacctctctcacacacctttgagcttagtgttcgtctattgtagtgattgaggttgtttgtcacatcctgatttttgtttcaggatttataaattatttaataaattaataatagaatttatattaaatgttctttaatttacaagtgaagttaaatgtgggaaataaaatttcctaaatctaaggcatggatggatttaatttttattaaattctccatgattaagtatactctctgaaattttctcggatttttctaagctcaattcctaaatgatacaaagaacagttcagtaattatttgatcaataatgatctaattatatttgttaagagcttttcttgtttaaaaaatccttaaattataaattgttgttaaaaggaattattagaaatgattttaaaagtctaaaagagaagatctaatttttaatttgttaaatctcaatataaaattgggctagataaaatttcattaaatactttgcttaattctataattcctagatttttctgggatttatttgagctaaggaaatatttttaataaatagaattgcatttcatgaataatttaaatagaaaaatgtctttaaatcctccttttggctttgggccgaaagtcggcccaaaacctctctttctctctcccttcccggcccagtcggccaagtcggcccagtccgccgagccgccgctctcctctctctctcagccgctgacaggtgggtcccacttgtcggggtcgtcgtcctcctcgcgccgccgccgtccgaaaccctagcgcaagccgccgccgtctccttccaaattcggccgcgtctttccttctccggtgaaatctttagaggggaaatgatcttctcgatctcctcttccttttctcttttggaatcatcgcctaattaggtttggaaactcgtggattcgagttcgattcggatcggcctctttcctccgaaccccgacctttccttctcgccgccggcagccatgggccttcgccgccgcctccttgcccctttaaaaggacccccgagctctcctctactcgtcacctccctcgcctttgcccaccgccgtctgtagcgccctagccccgtgagcttttgcgccgccgtcgccgccgttcgtccagccgtgcgccgccgtcgctacggtcgtcgtcgtcactcgggaaggccatcgtcgggatcgccaagtcatcgccgtcctcgtccgccccttcgccgccgccgaagaccgccggagcaccgtcgccgtcgtcgacccgatctccgccgccgcttcttcctcatcgccggcgctgtccgttgttcctccgccgcttctttggtcaccggtgagttcgccgcgtcgccctctacccgttggtgtcctccgtttgcgtcctcgtgccgtcgttcgccggcgagcttgcgctcccgagccgccgccggtgctgacgtcatagctgccgtcatcgctgacgtcatcgtcgtcgttctccgtgagccgcggtggatccgtttgatcccggccgtccgttttggataggttcgatctcggccgtccgttcccgtgaaccgttgccgtgcacccggtccaccgcaaaccctagccgctgacgcaataatccttcttttccttttcaaaaataattcattattgcgtcataattcaattaaaatccatataagtgttttaatccgatttaatctttaaaaattcataactaattcatcttaactcagtttaaggtggttcaagttgcaaaagttgtataaaataaagatctacatattaaaattttccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtcttttccttgttttgcgtgttagcttgtcgtttccgtcgttgcgaaggttcgcgagtgcgtcggaagtgttcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataatttgactagttgagctttatatattggttcagctagatattagatatgattgcttagccatgcttagaaacattagcacattattgggataacttatgactcattattattttatgatggtttaatgatagttcacgatggtcaatcgtgattggttaattaattacttgtcaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgcatagcatgattcattgcggagcaccagactgagaagtggcggagataagcccacgggggtcgctgtggagtccatgccttgtttataagggggtgattatgatccagggaaggtgcgctgcagtggattgtgttatgcaaggggtattgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgggttgagcaatgtttttcgtgattagtctcacacctctcacaataattattgatgttataactggtaataatttgcttagctcctggtttggagattagatctgtacagccgggtatggttgtttaggatggtcgggcctgtgcagcatgggtgtgctgttcagtgttgattaaaatttctgattaactactctactgttttatttctcttaaatattttgctaaacgctgcttttgcaaatgagcctatattatgccatccttttgcaaatgagcctatattatgccatcctttggtatccttgtgcacttgcatatttgctatgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcaattttcttcttggtgaggactaagtgcctcttaagtaagtatttatcgttttagttaatttgatgaatctgtatattaaattgtcagtttgtgtacctcgactgattcctggacgaggattttatgcacaaataagttcggaaattactagtgaatttccgggcgtgacattgttctagccaagagtcaagtgcattgcttccatttgtagagctagtgtggcacttgatcatctccacgccgggtcatcgcttgttactcttggaggttgccgcctcctagacggcttgtgaaggagttgcccggtgacctcttgtcgcacccggaaaaatacattttccagaacgctagtgtattaatccccgtcccaggaaaagccggggtacaccacacaaacaggatacaaaaggcacatctttattatatcgataatatttacattattacaaagtcacttcagccctgacaaacaaaaataaacagcagcgaactagcgggcctacggctccatcttcacaggcgctaaactggggtataagtcaggactccacctaggacttcttctccaaagcttcttttactgaaggggggaaagattgagcaagaatgagtacaaccacagtactcagcaagtcacaccgggagatgcatgattaatgtaaaggggtacaaggagtaataataatagagttaggttttgcagtaaagagcattaaaaaaacacttagttgctcaaagctattttgtaaacacgatcctagagctacacaatattattaatcaaggctgtgaaccctcacaaaacctaccttaacccaaggcctacgatgattcggagcgaactggcaacctgacttgggtcccagctcgtcccaagccaacccaggccaacaattccatattttagttgttaagcaaattttaagaattaaaccactaacttgggtacattactaggcttgcccatatccgagggcacggttattcgaatagattatactctgattagagatgtacatctttacccacaagacacgcctttactctgcattccattgcaattgaaacccatcataaaaaacgtgacataaccctttacccatcctagccgtgaacaaaagtaccgacccaaccctgcctacggccagtatcccggacaggcaggccaggattgagcccctagcaacatgatctagaccgggtgcgccacacatgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagtgaagctccggctccactcccacaggcagctcaactggggtataagccaaacgtcttctccttctggatcctttttcttcaactgaggatgattgattattgcaaggtgagcatatgacatactcagcaagccacacagcaaatatgcaagtgcacaaggataccaaaggatggcataatataggctcatttgtaaaagcagcatttagcaaaacatttaagagaagtaaaacagtggagtaattaattagaaattttaatcaacactgaacagcacacccatgctgcataggcccaaccatcctgaacaaccatacccggctgtacagatctaactccaaaccaggagctaagcaaattattaccaggtataacatctataattattgtgagaggcgtgagactaatcacgaaaaacattgctcaacccgcccataaccgcgggcacggctatttgaatagttttactctggccagaggtgtaccactgtacccacaagacacagcctcaacatcatgtctaccatgcgttgcgatactggaaagtacccgaatagaggctgtgacaataccctctacacaacacaactcaccacagtgcaccattcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaatagtagctcgcgaaccgatccttaattgtcatgagcacgactctcaaaaccatgtgctcacaacccaccattatcaagttttagttggcaagtaattaattaactaatcacgattgaccatcgtgaactatctttaaaccatcattaagtaataatgagtcataagttatcccaataatgtgctaatgtttctaagcatggctaagcaatcatatataatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaatattcggtcttcaattaatcttcttgaacacttctgacgcacttgcgaaccttcgaaacgatgggaacgacaagctaacacgcaaaacgaggaaaaaggctaataaaaaccaaataaacaatacatataaagtaaacaaacatgtagatcataattttagatgaattatgagacttgaacggcctcattctgacttcatatgaatttattatgaattttacaagattaaatctaattaaagcccatttaaaaagaattaaataaatttaattctatttatcgataattttaatatgtagatctttattttataaaacttttgcaacttgaaccacattaaactgagttacaaagaattagttatgaattttcaaagattaaatcggattaaagcatttatatggattttaattgaattatgacgcaataatgaattatttttgaaaaggaaaaggagggattattgcgtcagcgggtcgggttcacggtggaccgggtgcacaggaacggtctacggaacggacggtctagatcaaccctatccacaacgaacggccacgatcgatccagaccacggcggtccaagagacacagcgacgatgacgtcggcgatgacgtcatcaccggcggcggctcgggcggcgcatgctcgccggcgaacgacggcgcgactacgcaaacggaggacaccaatgggtagagggcgacgcggcgaactcaccgagctcttggacgacgacaaacgacgatggatgacgacggcggcgaggttgaagcggcggcggtcttcgggtcgacggtgacggcggtgctccggcgtgctacagcggcggcgaaacggtggatggggacggcgacgacctcgcgatcccgatggtggcgacggcgaccgacgacggaggctgcaacggcggcgcggcgcggctgaaccgacggcaacgacggcgacggctagggctacgcggaggcggcgctagacgcgacggcgggctaaggcaaaggtggcggcggatagaggagagctcggggatgcttttataggggctagcgagcggcgacggaggcccacggcgaccggccgcgagatgaaaagctagggttggaggagagagaagtcgatccgaatcgagctcaaattcgtcgatttccaaacgaaattgaccgaagtttctataagagaaaaggaagaggagatcgaggagattatttcccctcgaacgatttcactggaaacggaaaggatcgaccggattggaaagcggcggcggctagggtttcggccggcagcggcgcggggaggaagacgggcctgacaggtgggtcccgcctgtcagcggctgagagagaggagggaggggcgcggcggactgggccgactgggccggggagggagagagaaagagagaggttttgggccggctttcggcccaaagccaaaagagacttttaaaaacctttttcaatttaaattattcatgaaatgcaattccatttattaaaaatactttcttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttaaggatttttaaacaagaaaagctcttaacaattataattagatcattaattgattaactaattactgaactgttctttgtatcatttaggaattgagctccgaaaaatccgagaaaatttcagagagtgtaattaatcatggagaatttaataaaaattaaatccatccatgctttaaatttaggaaattttatttcccacatttaacttcacttgaaaattaaagaacatttaatataaattctaataataatttattaaataatttataaatcctgaaacaaaaatcaggatgtgacaacacacataggggtgagaccacccacgtactagtcccgtgccatgacatctcgactaacggacaccggcccgtgtagccttaatttgcctagacatctcgattaccgagccgcagctcgcgtagccttcatttgcctcagagatatccatcatcgcaacgacttcatccatctctatctgtatccttttgttcaggactagactgagcaccgagttaagccttacccattagacatgtggttagtacggtagtgctttgcaacagaggcctgagcttaatccttttattggccggggtgttacttcccacaactggcatgcacccaaaccccaccggaaaacaggttttaggggttttgaaagaggaagagaggggtatgtccaattccaccataagccaaccattccatagtgtccaagtgatatgagaattcccaaagtctaaaattataaaaccacctaatattgcctaattaatcaacgaagcatctacctaaattcatactagtggaaccatgaatggagtgcccactagttagggttttgttttcctagggtaagcaaggtgataataacaattgcaatgataaggctataacaaggattaataggtagtgcaaaataaaacagtgataacgcgggaatttaaataaagcagtaatgcaataattcaaatcaaaataattttataaattgggattcaatatgctcaaggatgatgcgacttgccttgctcagagaacagccttccgaaccttcggcgacgaccacgaaccacgcttcgggaacctccgcaacgacgaaagctacgcgaagcacacaagcaaagctacaaacctataaagaagcaataacaatacataaaaaacaaagcacatggttctttaggttataacaaacattaggagacttgaacggatcgattgggagttcgtatgaccaagatatgatcatccgaagattaatgttgttacatggagatttacggattattgtaattaggttttgcaactataaaacatttgtaagcgctagcctggaaaagacaggaaggttgcgctgttgacatgcggaccccacatgtcaacctaaagggccacggtagaccgagtacacagagacggtccacgggtcgacaaaagcggaccccgtgtgtcaactgaggcaagtggccgacaaacggactccactagacaccacgcgggctgcacacatggaaaccacacggcaaccgagcaggcacactaacacggtcaccacacgcacacacgaacaactaccgacacctgtacataggtaccggggtcgacaaccgcacaacgggcacggacaacaccgaaaggacgaggacaggggcagcgaaaggacggacccttaccaccactcaacgaggcgtgggaacgacgacggcgaacgggcgcggcggagacggctcggggacgacggaggcgaacggcgagggaacgacttcggcggcgatccttggacggaggcgagacacggccggcgcagggcttgacgacgcggagccgaggacgaagacgacaacggggctgcagcagctcacttgacggacgcggacgagaacgacttgacggaggacggacgccacgacgagcgcaaccaggaacgacgagaggacgacgacgaccgcggcgaacgccggtggggaggcgaggacgacgtggaacacgccgctgtgatgccgacgacagaggcggcgccgcgagacgacgagctgacgaggaggaacggccgaccggaggagacgtcgacgaggacaaacgatgacgacgacgaagatcggcggggttcgggaggaggggaggcgaggccgaggatgaccttgccgctgcgatgccgaaggtgatggtgacgacgtcggccggcgcaccgacgaggaacagaagccgaccagaggatgggaggtactacccgccggcgtggacacaactccagcgagcttcgggcgaggagatggtgaggccggggaggaggacgatgctgcggagctgagggaggcgacgacacagccgaccgatgcttaggcgcggcagcagaggcggctggaggcggtgcagtggcagcaacgccactggacgtcgacgaggacgcactatcggcggtcaccgcgcgaaacggagggcaggccgggggagaggaggcggccgcgacgctgaggatggcgacggcacggcctaccggtgcacgggcgaggagggggaggcggctggatctggccagcggcacgggagagagaggagggcggcggagagaggcggtgcggctacggggagacgcgagaggaggctaaaacgagagaacggaggaaggggattccattttataggcgcggggagggagccggccacgggaggagcgggcaacggcggcggaaaactcggccggcggccatggaaagcggccggggaaggcgcggccgttccgggaggttgagagcacgaatcaaggggaaaaataagggggaaataaagaggaaggaaaggggattaaaagcccccaatcaattttggaatcccatgcttgaatcgtgcggatttgagggaggaagaagctagggttttcacgggagagagaagagccgagcgggaggaaggagacgcgcctggtaggcgggtcccactcgggaggcgcgcagtcaacgcttgtgcggcgcgcgtgagggcgtgggcgagcgtggctcggcttgggccaggaggcgccccgggtggaagggggcggggaggcttgggccaaggcaggccgggaggaaggaggaggagggagttggccggctgggaaggagggaagaaagaaaaagatagggagggaagagagacttcggccgcaggccgagggagagagagagaggaagactttggcttagactcagcccaaagaaggaagggggatttatttttagtttttctttttagtaaactttgttaattgttgttgttgcttaataaataattccgttgctctgaaaattcaagtaaaatttgagagctccttttagaccaaagagaatttaacaaaaattctccaggccacattcgaatttttctagtacgtattttagtgtttgccaatttcttttcaaattttaattaattctattattccttttagagaatgatttttattttgggatgaatttatcaggacgtgacacctctccgagaagattgtggaggaggcccattgccggttttgtgagtggtttggagttcaccaccttcggagtgaaggaagaactactctagtgatcgaggcttgggtagtcctctccgtgggccggctcccgccttgcccaccccttgacgaagggggcatgcggtggtttcgtggttgagcggtggagttgggctcgcctcaacgggagtaggaaactggcgagtttccgaacctcggtgaaaaatctcttgtctccttgtctcatttacttgttgtatttatatttgtgcaatttacatttctagagacatactagagatcatttcaccctaggattgctaaactagacttaggaagtgtgatttactttcctagtgatatacttgagccactttcaccctaggattgcaaaacataaattagttgcttagttagtcttgtccctcaccgagcctagcaacttaggttagttttgattaggtgtcatttaattttaaatcacatattcacccccctctagtcgacttctcgatcctacagtgagcatcagggagactaaatcggggatccctacctggcgcgtgcgcgcccctggtgctagtttttggtagttagactaattctatttatcttagtctcttagataattacagtttgagataatgatggtagtagttagtattttttcgtgagatttttattaactaacaaattaaaaagaaatctatatctgaagtcaaaatttcaaaaatttgaaaactttcaacttgaaatttgaatttttcaagtcaaaatttgaaaactttcaacttttcatcttaaacttgaaaaactttcaacctagatttgaaaactttcaactcaaatttgaaaacttttcaactcgagatctgaaaacattcaactcaagatttgaaaactttcaacccacttttgaaaactttcaactcgagatttaaaaactttcaactcagatttgataaattttcaactcgagatttgaaaactttcaagtcgagatttgaaaactttcaaatcagatttaaaaaattttaactcgagttttaaaatatttcaactcaaaacattttgaaaaaaatatgtgggctaaagattagaaaacgtaataaaaaaaactggaaaaaaagcaaaaaaaaaacgccaaaaaaacgaaaaaggaaggcgtggcgtggggaggggccgcacgcgcacgcgcgaactagctctggtggattaaatccagtcctatgtagatggaggtgaccatattttgcaaggatcaataatgggggcggtggtgcgagggagcaggggtggaggcctagcgtgggggccttcaacataggggactggcttgacacatgcaccctcgcctctcgagtctcgtacctcatcatgccttgtctcgagagatgggaggggtatgtggaaaaggaggtggataaatataaagagaggcaatagtaaggaagagaaatgagaagggtgtaaaataaaatagagattggataggtcggtggctgacatgtagggtttgcactatagttgtgatttgttaaatgattcaattcttgggctcaaatagaaaaaccaatgaccgaccccaagactcactgtaagcacctaaggccggtcacagtataatggtgtggcgtgtggactcgtgcgacacatcggagccttgccgtgtcgttatggcccatctccttattttgttgcttggctcttcagtaggaaacggcttccccacctgatctacaggcaacacaacgagggacatacctccgcgcccgcgttggtgaggtcatcttctcgctgcgtcgtcccctcgtgtgtttagctcactaattaaggctgaacctggcccatttgagttcatttgagaggtcacatgcactgtgggagctgtggacaaacgcttccctaagcctgtttggcatatatatagatgcatggcctgcaccgtgattggcatatataatagaatgaaacatctcgaccttcgctcaaggagttacaaccaattattacagaattcacataaaagaaaactcacacataaagttcacaatggcagaaacaaaactaaaagcaagcacaaactaatagacaccaacacaagataaatatcccataactactaaattctactagagaacctccacccgaaattggcaaatagttgcgtaatcgtcatctcaagtttatgacatgcatcatttattagcttgatatcttcattatgcctttgtaattgagcctatccccgaagccaatatgttcccctgaaaagcatctgcaaataggattttgatggtgatttatgaaaaaccatatcatttctactaagataaagagctcaacatacaggggaagctccgacaagaataagttttttgatttatttttattaacacctaaaagccaattctcaaacatatgagatatcctatacggataataaagtccaaaagagaattgtatagatctccaaagaaatttagaaaaatggtactcaaggaatagatggtaaattgattcattcttcatacaaaagcaacatctcaaactaccattccaattcctcctagcaagattatcttttgttaaaacaacccttttaaggagataccacataagtatcttaatcttaagaggcattttaagtttccaaatgatcttattcctctctatgtatccattattaattaaagttaaatacatagatcaaacagaaaattggtcattttgatgaaaattccatctaaaaatgtcatccttgtctgttaagttaacatgtacaatggaagcacacaaattatgccatataactagattctgaacagctactctactaaaagaaacattaagcggaacaaaacccataacactagcaattgaggcatttttccttctaattatgaaaacaacgacggatatttgtccttcaaagaataattccctaaccacttaattatccttctagaatcttactttgttcaccattattaataattcaggaacccatatttaaaaaggaattcttaaccttcatcagacctgaccaaaaatgggaatccccttgtttcctctcaacctgagttattgatttatcactaagatattttcttttcaataaatcttgctacacaccttgctcatttattaatttaaacaaccatatgcttaaaagacattggttttgaatttctaaactgtgaactccaagtccaccctaatcttttggctggcatataatgtcccatcttgtcaatctatacttttttttcaatgttcatcccctttccaaaagaaacaggatctataataatcgattttttgaagaacccctctaggaatctcaaaaaacgatatcataaacatagctagacttgacaaaacagaattaatcaaaaccaatctcccagcaacagacatgtttatccttccaaatactaagcttttttttcaattctgtgttcaattattatccaatctttattagtaagctttctaaaatgcataagaatgccaagatatctaacaggaaaatcacctaacttacatacaaaaatgtttgaatattgctcatgacactcctttgcctgactaaagcaaattaattcactcttatgaaaatttatctttaggccagataacttttcaaaagcagttaataacaacttcatatttttcgctttctctaaatcatgcttttgaaaaataatagtatcatcagcatattgtaaaatagataaaccatcgtccactaaatgtgggaccaatctagagatgtaaccatcatcttttgctctcttaattaatatagttaacatatcaacaactatatttccccttgctttaaaaccttaaaagtttgaaaatttgatcccacatgatcattcactttaataccaacatgaccacctttgaaaccaattcaatcacaccatttttgggaaaagcccttcattctcaaggtttgttaaacaaaagaccatttaactttatcataagctttctcaaaatcaatcctaaaaattacaccacccttttttttcgaagcaactcacgaatagtttcatgaagaatgacaaccccctccataatattcctcccagatataaaagttgtatgagtgggactaattactttctgagctaccccagagattctatttgtagcaagtttagtaaaaaagaaaaggaaaaagtacacccaagttccctcaaattgtcatcgaattacaaaatcgtcccccgaccgcaaaaccggatacaacatgtcccccaacttacaaaaccagtgcaaactaggtccctcggcgggtttgaccctggttttgttcgacgtggcagctgagtcagcatgggacccacgtgggccccacatgtcaggatgccacgtcagcaggccagcctctcccttcctctctctttcctcctcctcctctatctctctatcttctctctgtactctgggcaggccggcttcattggcggcggcaacgttgtcggcgccgccttgcacgactgcgaccggtgcagtgacgcggcaccggcgccagggacgacaagcgggcgcgacgaacggaggagggcgaggttgagggtcttgaagaacgggagagacttcacgtcggtagcgccggcggcgggacccatggcgggcggcgaggtccttggcgagaggcaagtgatgaggtcgcgcgcgtcggcgtcagcggggccgaacgacctcgccatcaccggctcggccatgcggccgaaggggtggcgcggcgtcgagcggcagcaagaatggtgggcggcggtaattaaatacaaatgataagttgggggacgtgttgtatcaggttttacggttgggggacaattttgtaatttgatgacaagttgagggaccttgggtgtaatttttccaaaagaaaatagaactgacattaagtaaacaaacatgcctatactgttgaattttcatagcctcttcgcacttaggcagtaaaataacagtaccaagttgagagagtaaagatttaaactaccactatgaaaatcttttaataaattaaccaggtcttatttaattacattccagaactcagctggaaatctgatgtgaccatagctataatggatacaaccgttgctcacatcatggatgaataagaagatatcaaaattaagtcctccaagtgctggaatccgattcggccacctgctatactgctgacttcgaacggccaccaaatctgcatacgccctccgttttcggtctgtgagtacttgatggaaagctctcggagtcctcttcccaatggatccagcctcatctccgaattccatcttgtttggccgcaatcacagaaaaaagttactgcatcacctataatgggcctatgggcttgtaacttcgtctgggaccccggcccaagtggggtgcgccctaacctgctagagaatgaccctagggcacccttggtcatcctcccacccctataaatagctaggtaccccttcagtgtttcttaggtttcgttagattaaagtttagtcattgctacttgcttgcagcgcgcgtgccaagaccgctcgtttgttttttcttcagaaccccaacttatcgtttatatttaattcctatttgcaatatcaaattgcttttatcttgttcttgcttgtttcttcgatttgcttgcagggataagattgatctgcaccggcaagatcaataacccacggaaaggtgtatcgatcactaagagcaagtttaatagtatagccaactactagctccaaattatctatagtcaatgtaatagccaattcatacaatagttacttactacactattaatacctagtcctacctgtcatacacacattacgtcttggagtccgtgctgcagctgactacagatctgtagcccactgctcttctctctcttcctttatctctttaaaatatgtttatagctagcttatagcatgctattgtacctgctctaaggcgcaacgcaacgtcttgtacggttatagtcagatcgtcaacatttctctcaaatcatagttatctacaactcaccgaaagatcaggccaatcctagccttgagtgtcgagtggaactcatggcacatcaaaatccatctggacccagagctttattatgttccatctgaaagattgcatctttaatttcattctcagtaaattcatcaactgaagcattacttttctaaagaagacacctagggaatatcacttataagactttcatctagagttaaagaagaaacattaggtggaccaaatagaccttcataatatgtggtaatatgagcaagtactataagcctttacatgttgcccctaaatctggg

SEQ ID NO: 27670 - DNA, 889 bp, Oryza sativa
tatgttatttaactatttagtctgagtaagatatatttccatctttgcgggttcattgtttagtattcatactaagtgctctagtactaggactctggataaagaaggaagttcctgtacgagtattagagtagtaattaataacttagacgtggtgtctaggttagagagtattagagtagtaattaataacttagacgtggtgtctaggttagagattacctttgttttgtgtatcccatggatttgtccgaggtaggcggcaggtggtgacagccctgaattccgtcccagtaatcctccacgtttggatgcatcatagagctatagataggaaattacctttgcttagcttagaaaattaagaaacatagaaagtcctctctagcctagcctacctaccatcagttgttgtccttggacagtcttagtcttaggtagattacacacgttccctgagttcgatatccttttggggtcacccgaaggtgaagtgctacagcgatattccgtgcacttgtggatttatctgtggtcgtacgaaataccaacaagcatttctggcaccgttgctggggaacgggtgctaatttatctgagtctaggtcatcctcatatctttatttttatttatttttcttttattcttttccttgatggagcaacccacaattcaaaacctttctgctcctcgggctgatctttgtgagccgtcctgttcttcaaaaccaatcctttctgatggctacgaaatcagtcctggctttatagccatgattcgagagcaaaccctctctggtagtatcggtgaaaacccatacctctatcttcgggatcctgagctagtgtgtttgtgcctatccatcggaggcatgacacatgaaactct

SEQ ID NO: 27671 - DNA, 977 bp, Oryza sativa
tcatcacttgcctctcgccaaggacctcgccgcccgccatgggtcccgccgccggcgctaccaacgtgaagtctctcccgttcttcaagaccctcaacctagccctcctccgttcgtcgcgcccgcttgtcgtccctggcgccggtgccgcgtcactgcaccggtcgcagtcgtgcaagcgggcgccgacaacgttgccgccgccaatgaagccggcctgcccagagtacagagagaagatagagagatagaggagcaggaggaaagagagagaaaggaagaggctggcctgctgacgtggcatcctgacatgtggggcccacgtgggtcccatgctgactcagctgccacgtcgaacaaaaccagggtcaaacccgccgagggacctagtttgcactggttttgtaagttgggggacatgttgtatccggttttgcggtcgggggacgattttgtaattcgatgacaatttgagggaacttgggtgtactttttccttttcttttttactaaacttgctacaaatagaatctctggggtagctcagaaagtaattagtcccactcatacaacttttatatctgggaggaatattatggagggggttgtcattcttcatgaaactattcgtgagttgcttcgaaaaaaaagggtggtgtaatttttaggattgattttgagaaagcttatgataaagttaaatggtcttttgtttaacaaaccttgagaatgaagggcttttcccaaaaatggtgtgattgaattggtttcaaaggtggtcatgttggtattaaagtgaatgatcatgtgggatcaaattttcaaacttttaaggttttaaagcaaggggaaatatagttgttgatatgttaactatattaattaagagagcaaaagatgatggttacatctctagattggtcccacatttagtggacgatggtttatctattttacaatatgctgatgatactatt

SEQ ID NO: 27672 - DNA, 684 bp, Oryza sativa
gtgagtgtcgtcggaccggctaggatcacacagggcccgagagctaactgtgcggcgtgctatgaaggtcaaggaaatagtgaagctccgaccactgtacgcatcaaggcgtggggtgccaggagcagcacttcgaccttgggtttggttttgccgggctttacaaccaatggttcgacgtcggggccaatagaccgcaaacgtccccatggaaggtgtaaagttccaaccgacggctttttagtggctaaagggtattttgggataaaagaaaatatttaaaaaggcaaatataaattcaaataaaatagcaaattgggaaatgaagcatttgaatttatatgaatttaggtccaggtttcactgagatcggatctacggtttaggagatatgagcttctaaagaataggatttgaattaaatctagaaaatatgaaaggttactattcatgggcctacctgtcagtgtctattcccttttctcttctttctcttcttcttctcgtcttgttcttcctcctgcttcacagagagccgagagaagggagaagagagggagaaaggggcgctggtgctccggtggtcgagaggctgcgacgtcggcggcaaaacatgttcctgagcgacgcgcatccagggagggtggtagctagctaaggtggagagtgagatggccggaacgg

SEQ ID NO: 27673 - DNA, 684 bp, Oryza sativa
  unsure (1)..(684): unsure at all n locations
nnnnnnnnnnnnnnnnnnnnnnnnnnnnnnnnnnnnnnnnnnnnnnnnnnnnnnnnncgcgaacggttgatggatctcgaccaggattactgattgaaaagatcgtgtacccgccgagataaaagttcttgacttcgatccatattctcgattacagcaagacgagagacttaggtcgtacactctatcgctttttgggagacatgagagattaagttatacataccttttcagttgccacacgaggttgactaaagaagaccaacgttatctctaaactcaccgagaacgggtacatgagcttgattacagcaactccaatgtctgcgcgcggttgagaatatgaattcattcatttgcatcaaaggcacgagctatggtcggggttatggataccacataactaatagacggttactaaatgtcggaaggatccaccacataccatgtcttattcggaaactgtcttcagatatggaaggagctctggataaggaaagacaaccagagttctacatggcaaccacaaggactactcggattatatgcatattgaattacctaggtctacttgcacaaagagacacctgcgggtattaatacaagcccccctaggacgacagggggtcacccatgatgtgaaacgatcgacacgatcaataaccgccatgggagaccacgaga

SEQ ID NO: 27674 - DNA, 656 bp, Oryza sativa
  unsure (1)..(656): unsure at all n locations
nnnnnnnnnnnnnnnnnnnnnnnnnnnnnnnnnnnnnnnnnnnnnnnnnnnnnnnccttgtggccattaccgggtactggctgagagacgggcttttgtctagctgaataagtctgacctgttacgccagcctgaccgtcggtccaatcgattcaaccggtactcaaagaagcgttataaactacttttttccgttttacagtagaaaactttctagcattgtctagatccataaaagatagggactatatatacatcatgtgatagattttttagcctcctatcatgcagatttcttaccctttagatgaacatctaacggatgacattaatatatacaaacaaaatacaaaacaacaaacgggccacgtggacaatctaaagctcacgtgggtataaatgggctcaagtagttttcagacttacatcgtaaatatactaaaattacatatataattttcagacttacatcgtgaatatactaaaattacatatgtaattatagtgtaaatacgatgtaattcagacaaaccctctttgcggcgcggatttcaaaatttcaacaagtaaagtgggccctacataaactctgatggacacaacatacagtgggtcccacaaagagaaaaaaaagtcccacataaccgtgaaagccc

SEQ ID NO: 27675 - DNA, 2413 bp, Oryza sativa
  unsure (1)..(2413): unsure at all n locations
nnnnnnnnnnnnnnnnnnnnnnnnnnnnnnnnnnnnnnnnnnnnnnnnnnnnnnnnccctcttgatttctccgctgcatgacataatctactatttacaatcatgagtactctttttgccctttgagccccgcatcggtatagccgatgaggcaactatatgtgggacgttacgccgggctcacttgccaagtcttgttattcctgctgagctagtgtgaaaatatgacttttagaaaaggactgtagcaacgggacatctcgaggtaattcgtaacaaatgcgattgtcaggcttggcagtgcaccgcgtcggacgaggacataaggcccatgggacatgtctcctccctcaggcctataaaaatgccacaatagcctttcccgggctatcgaggagtttccacagccgaccacttagaatgtgacttcgtgtcacttctcggaatagaccacgtatcaaacatcggatgtttggacactaataataaatattaaacgtagactattaatgaaacccatccataatcttgaactaattcgcgagacgaatctattgagcctaattaattcatgattagcctatgtgatgctacagtaaatattctctaattatagattaattaggcttaaaaaatttatctcgcaaattagcttttatttatgtaattaattttgtaagtagtctatatttaatactctaaattagtgtttaaatatagggactaaagttaagtccctgaatccaaacaccaccttagctatgctatagaacacaatacacatggttgttcccaagaagactaacatttgggcccatcttacaacagagccttgaatcagttcccgtgcagctaggccatcagttccacacacccacgagtagaccaagtcaccgtccccaagcaaccctgtgccaccgcctaggttttcgagtgtatcggcttcattgtggttccgtgagtcatgcagcgagagagtgcatggaccttcccgtgggattacaggtcattaaatggagactgtatagagcgatgctatgccttcacaatgaagcaaactggctaaatagagacctttggctagaatgtagatattctttatttcaggtgatattataatatattttttatccatagcaaagcacgaatactcaactagctagtatcgcgtaaaatgtactactggacatgattgttcgattggtgctctgcatgactgcataattcatttcatcgaattaagaatttaacttgtcatatatcccaccaactactggtccatgcttgcatgcaaatccatccaggaaaacaaaggaactattacacaagcaacttgcgtgcaactaaactatagcaagctatagctcacctataaatatcagacgaaaacccacaagcaaaccatcccaaactgacacaagctagagcagtctagaacactgagtgactgattaccaccggctcattcgatttcagacaaaattatggcttccaaggtcgttgcttctttccttgccctttcctctttgctgtcaccgcacacggctgcacacccaactgctctagtgagaaggtcatccctacgccacccgaagcagtgccggcgccattgcaccctggtgggcacagtgatcacgggcgttgcccgatcaacgccctgaagctgagagtgtgcgccaacgtgctaaagggctggtcgatgtgaagattgggtacggccccgatgactgctgctcgttgctgtcagggatcgccgatctcgatgctgccatctgcctttgcaccgccgtgaaggccaatgtgcttggcattagggtcaacctcccagttgatctcggactcatcctcaacaagtgtggcaagacctatccgaccgatttcacctgctaagcggcacagttataatattccagagtttaatttggtgtggttgttcgctattgtggttgttggctattgttccccgtgagtaagtctcttgtcgggtttgcagattgatgtgcggttttatcatccttgaatcactttaatttgattgttgtaagtcgttttttctttctaaaatccattatatatattgttatctcgagataattttaatggcttacatgttcgttttctctcagccctgcacgcataaaaaaagatcgatttatagattcgtatttgatatgatcatgtctgtttgctaatcgatctgcatttgtatcaaccttgaatcacatgattgttgtaattaagctggtttttttgtgagattgtaatatgtaaaacctgctatatatattgttatcgagaatatattttattggtttactacgtgtccactttctctcaccatgcatgcataaaaatagatcgatctgcaaatctttatctgatatgatcatatgtctataagctacaaagaggg

SEQ ID NO: 27676 - DNA, 15049 bp, Oryza sativa
ctttaatttgattgttgtaagtcgttttttctttctaaaatccattatatatattgttatctcgagataattttaatggcttacatgttcgttttctctcagccctgcacgcataaaaaaagatcgatttatagattcgtatttgatatgatcatgtctgtttgctaatcgatctgcatttgtatcaaccttgaatcacatgattgttgtaattaagctggtttttttgtgagattgtaatatgtaaaacctgctatatatattgttatcgagaatatattttattggtttactacgtgtccactttctctcaccatgcatgcataaaaatagatcgatctgcaaatctttatctgatatgatcatatgtctataagctacaaagagggtcaatcccggttaggaagggcccaatggagggtccccaaccagctctggattttcagcatggatgacggggactcactagtgccgaagtttagaacaagaactggtatgttcccccaagtccaaaaaaaagggagctgctcaaagcattggcttgatgaattgagcccatgctttgagcggtcccctctgagatcatgctcccctaatccccattatagaagacgaacaacaagaacacaaaatattcacaatcagtatccatcttggtgccagcactgctttgtggccgccactgcggatgtcagacccatcccttgcctcgccgctgcacatcccggcacggacgccatccctcgccttgccattgctgctgccgatggatcccaactacatgtctcaccagtagccacctcagaaatgttgcgtctcctacaatgggcaaacaccatggtcactggtgagcactggaagggcaaaaagaagaggcgttggagtgaggaagaagcatgcatcctaatggcaaaatagtccacaggatggtgaagacgctctgcttaagggtggaattttatccaagcccgttccagtgatggcattttagtgaagctgttttttatgttggtacatatacaaatttctcctgaaatacaaccctcaatcaaaaacaacaaatgtgaaacttagcgtagctagattaccaatccacggcaaagactttagtctagggatgataccctaatcttcgttatcttcaacctcgactcagaatggacgacaaacaacaacaattgggaattgagtacattcgtactcagcgaactactggaatatgtgtaaaatgcaagcttgaaaggaaggttgggtttgtttggcaattcatttattttaaacacttttgaaagttctaagtgtgggttattataaaacataccatctcgattcacccacgagttgcgatccaacaactcaagcaggaaagtcaaattttagttttatgcaacattttcttaaaaggaccttgttttcacttagaggaggggttgaatagtcatttctaaaagttatcacaactttgaagcgcaataataagcaatcggaattttatattcaaatcgaagttgccgatatgaaccggaaagtccgacagctgagagtaaaacaataattatgaaattttagctcaaacaaacaatatgtacatgaatcaaaaggtaacaaacaagatatataagaaagatataaaatcaccaagtagattaattaagcattcaaatatatctaagcacaatatgaacaaggcaataacggacaaaccaagagaggagacacgtgatttatttaccgaagtttggatctaccaatcctacgtctctattgaggggctacaaaggctgggtctctttcaacccattaccttacgtggttacacaaatacactactcgattttactcttgctttcttccaacacagaggtgaaatcgaagcctacacaaccttggatgctcactggcaacgtctagctatctaaaagactttaatatcaaagagtaataaacgcacacaaagctagcttacgaagggaatttgaattcaacatccataagtttttttttcatatcaattacttgagaattgagattttggttcaaaaagattagtttttaattgagatcatggcactagatcctagatacacttaaagaatcaaattattgagcatatgattttcattaaaatagttttaacggttgaacgaaaatcgaggcattgcattacttctggatttatttatgatagtggacacgattgaacgcaaagtacatatgaagaacatttttctaattactagttttgaattttggaattaaatttaataagtgctaaattgaaagtccaagactgctacagcatcatatttattaattttgaatttgtaaacacaacatgcaaagagttcatggtgcatgttttacttaatgcttctcaatacaacatatatgaccacgctaatataagccacgtagccaggtcggccggatacttttggttacgtcaaaactctcttaggataataaattagacagtgtaggtataaattactggtaggtaactttgttgaacaaatactggtgggtaattaatgggctagaccgggatgattaaagagattaatgggcatggtcagcacattatattgtggacatataaatcatattgtctcagcatattggggctgtttatacacatttgttgataaattttctgtcaataatttgacaggtacaaatataatataatcatataacattatatatagtgtatcttgcatttaaatataatgcaagtatatgtaactttaaaaagtcccatggtaacatgctgtttttacaaagtggaggtcaccggatcgaatcacctcacctatgcccgtgctgtatgtttttttcttcctagttgcacaaatcttgaaaaaaattcaatggtttaaaatcatgaaaaaattgtagttacatgattttattataattatatagtatgtttgataaattttaggagaaaatttattgataaatatataacaaaatcgtttcagatttgttcagacttcagaccagtcatgacttgcatgccttatttaaatttccagccagctgatcagcaagtcgcacacgcttggatgcattatatatactcctatttattataactggagggagtatactccctaggacggagaaataatgcatccaaggacggagaaatatatactccctgaagttattaattactccctaggacgaagaaataagctttcttacctgtttggtacagctccaactcctaaatttaactccagaagttgggtctggagtggagttgtggagctgcctaaacccagctctacaactctaattcattttgtgagagaactccactcagcttcactcccaattttggtggagctgaaactgtttggctgagctccagctctaggaggggtggagctagagctggagctgtgccaaacaggcccgtagtgtgcaagtataagtaacagagaataacatccgagacccaagaaactctgaaaaaacaatattatattgatagatccagaaattatgatatcgtgaaaaatgtacaaccgggcatgattgtttgattataattggtgctctgcatgactgcatagctctattcatcgaaataattacggagtaagaatttaacgtgtcatgtctctcgccaacaactactggcaattatcatatctcggtatctcacacatgcatcatgcatgcaactacatatacgaagcgagctcatctataaataccaggcgacaggcgacaccacaagcaaatcatccaaaagcgacgcaagccagagcagcctagaacactgagtcactgagtaccaatagctcactcgatctctcggatataccaatggcttccacggttgtcgctcccatccttgcccttagcctcctcctcttcgccgtcattgtgcgcggctgcacaccaaactgctccggcgagcaggtcgtcccgacgccacccactgcagtgccgacgccattgcaccacggcgggcatggtgagcacgggcgttgcccgatcaacgccctgaagctgagagtgtgcgctaatgtgctcaacaggctggtcgatgtgaagatcgggcatggccccgatgattgctgctcgctgctgtctggaatcgccgatctcgatgccgccgtctgcctctgcactgccgtgaaggccaacgtccttggcattagggtcaaccttcccgtcgatctcagcctaatcctcaacaagtgtggcaagtcctgcccgtctgacttcacctgctgagctgcacatttataatgctcatgagtttattttggtgtgattgttgggtgtcgaggtttgtttgcatgatccctcgtgaataagtctcctttttgtttcagattgatgtgcggttgtatcatccttaaatcactttaatttgattgttgtaagttgatctttttgttgagagaatgcaaatcttcaaaacccattgcattatctatatagatatattgttatgcggaagatattttaatggtttacattttcgctttctctcatccatgagccaaaaaaatagaccaatccatatatctgtatctaagatgatcatgtcctcaaactgtgtcacgcacaccaatatagaccttgcatcagagtttcagggcgttgatctggcttcagggcgttgcccggttatataaaattcgaccggttactgaagctagcccgtagaagaagatggttccgggaataggtgacttgcccggtgtagttagctatgttgtagactgtagaacacatggttgttcctgagtagactaaggttgcgttccgagatggaaattgagaactccaccaacccgcacgcaaaataaagtgatccattagtgtatgattaattaagaattaaccaaaataatcttgaaaatagattaatatggtatttttaaagcaagtttcttatagaacatttttgccaaaaaaaagtatcatttttgcaaaataatatggtatttgcatgaaaaccaaggagtggaggttagaaacgtctgatgccaaacatagactaagagtaggccccatcttacaagaaagcctcaaattaggtcttatgcagccagtccatcagttctgcgcacccacgagaagaccaccaagtcaccatccccgagcagccctatgccacaacctaagttttctggtgtctcggcttcatcatgattacgtaagtacatacaatgaaagggtacacacgcgagattacaagtcaaccttttccggagagggatgcactgacgcagtgaatgtgtaggcaaatttgttgcaggacatgtaaaaagcatataattagctgagggacaccgtaagaccacacatctgccgtagggcaccacaaaaaactcataattagctgctggtctctcatgacattattttattattttcagagaaaatagagagaaacatagattaaagagaagtttgcacatggctcaactaaatgtatgtgaagcacggatacgtcacaaacctcacgtatcagtatcagatacgtacttcgataaagacacatattagatacactccgatacatatccctttttttcataatttcaaaataatacaaaaaaatcgtcatcgggacgtagattcctagcaccaccgccagacacaatgcctcaggttcgttgtcgtcgcgaaccgtcagtgccgtcggacatggcgaccccatctctgacggacacggcacgccagtatctgcacctccataggacacagcatcgccgccaccgccgccagacgaaatggctctaggcccgcggtcgtcgggaaccgtcggcgccattgccgaacatggcgactccatttccaacagatgcagcacgccggtatctcgacctccacggggcgcaacaacgccgccgctggacattgcaacaactccatcttcgccatgctggctgtcggtcgatctccgtcaccggagccttgccggcaaaaccctcgcgccaccagctttgcctcgtcgaggtgactctattcccctagtttcctctttcctttagccaccatatcaagctgccaccgtcacctcccttgccagctagagctgaggttttcccttcgttgttctggcctcctctcaaagtccctctacttgccaccactttcctcggatgcaaagaaaaaatgaacacgttcaatcgctgacgttgccgtctcctgatcatcggagcaccagcgccctcctcttgtttcatggaagaagaaaaaagaatgagtagagaaggagagagaataggaaaaaaatattccctgacaggtggatcctagcatgggagtgaggctcgattgggttcatggggtaaaactatactttcatagttgtttctttctccaattcctctgaatataataaaatagtcccatgggtgtctaacagctaattaccacctttttacagtatactatagcataaacgcgtttttgcggtgtccctagttaattacacttttttggatgtcctgtaacaaattttgcggactatatatatagagggatgttatgccttcgcaacgatacaaactgattaagtagaataccttgactaggatgctgatattattttttaggtgatattataatgtaatttctattcatagaaaagcatgggtactcagctagcttgctagtatcgtgtaaattgtacaactggacatgattgtttgattggtgctgtgcatgactgcatagctctattcatcgaaattaagaattcaacttgcatatctctcgccaactactggcccatgcttgcatgcaaatccatccatgaaaaccaagcaattatcacccatgcatcatgcacgcaactatctataccaagcaagcgtactatagttcagctataaatagcagatgacaccccaagcaaaaatcaacccaaagcgacacgagctagatagcagccaagaacacttattcactgagtaacactagctcattcgatcccagacaccaatggcttccaaggtcatcgctcccttccttgcccttagcctcctcctcttcgccgtcattgtgcagggttgcacacccaactgctccggcgagcaggtcgtcccgactccacccattgcagtcccgacgccatcacaccatggtgggcacggtgagcacggccgttgcccgatcaacaccttgaagctgagagtgtgcgccaacgtgctaaacgggctggtcgatgcgaagatcggacatggcaccgacgattgctgctcgctgctatctgggatcgccgatctcgacgctgccgtctgcctctgcacggccgttaaagcgaatgtgcttggcattagggtgaacctccccgtcgatctcagcatcatgctcaacaagtgcggcaagacctgcccgtccgatttcacttgctgagctgagctgcatgattataatgttctggagtttaatttcgtgtgatttttggttgtcgattgagcctttttttcatgattccgcgtgaataagtcttgtttcttttggcaaattgatgtgcggatctatcatccattaaattactttaattcaattgttgtaagttgatttttttttgagattgtaatatgtaaaacccattatatatattgttatctggagataattgtggcttatatgtttgctatgtcacccacgaaagcatgaaaatagatctgtatttgatatgatgatgtcctcaaattgtgtcacgtataccaatatggaccttgcacctaagcaatggcgacgctgaaattcttgaaatgtaatatgaccgattgaatttagtcaaaatggcccacagtacatgggccaaactatgtactctcgtttaggccaaactatgcaatcccgttggttggattgccattccagcccagcgtgaaggggttactaaaacttagccctgagaataagatggtccacactgcattgcaaccactagatctactataagatcatcctttcctttataaccaaacaaacaacaaggcacataatcataagattatattatattgtatacaccgactaatttatcggtgtattttagaaattcagatccgaaattgcaaactctgctccaatgtgttctgcagtgtgattcaattatctagataattaattagcggaatgaatgtacatttgtaggctagttatttcaagcatttaaattttgtcttcaaatatattctatttagaatattaagaggtatttgcagtgataaaatgtacaagatatctccccatgtcgacaaccccacccaggtgtcagcaagaggataatgaaaggtaatctagattttcccctcccctgaattttcatgaaagaaattactgaagtatttatatatcttggaacagagggagcatgcatgtacttaattttctttatctaatgttatatgatgtgtgtcaactcaactatggtagttaataaatatagaaaaatacatgccggtccttaaacttgagaggtggtgtcacttaggtccgtaaacttaaaaattgcatatttaggtccacgatcttggtttaatgtattacagcaggtccaaacgacatttgactgtgtctgactgctaaggtcattcccaacccaataactaggatggtgtccatagcattaaataagttgccacctaggacaaaaaatgatgttgcaagtgaataaatgaggaaagagaaggaaaccatgtcttgcatgagacatggtttctacacaacatccaagacatagcattaaattgaagtatggaatagtggtgtttgtattggaagagtagtgtttagtactagtttcttgatgatgtggagtttatggaaatcatgtctagtgttatgagttgggactgtcctaacgtggcgcttcatgtagacaccaaatttacatccggccccctccacaacacagagtggcagtaaacttacacttagacccttcgaagtacatcgttgtaatataagcaagcggatggcctcatggtgaagacgaataactgatggagctggccggcgcgattgtctaacacaacaagcggcttggaatggtggaggttcgcttcctcctccgcctcatctccggcgtaggcctcggctgctggacctacgagctgcggagcttcgtcgacggtcacgaagagctcgctgcacagcgggacgcggtcgatgagatggacgctttctacgacagcgccatccgggagctcctcggtaggactgggttctaccccattgccaacgtgctcatcatcaacattatcagctagcttcttcctggagccatgcctctcgtccatgttgggaatagtcccacatccctaatctagagggagttgaaccaacttaaaagtagagggagctcctcacctcttgagctagcttttaggatgtagcaaggctttctcccggttgggccaacgtcttccggtttggggctaacaagtggtatcagggccaatccaacaatctctagtgcttgtgcacactcaaggcggtgtaagcccaaagcccagtggaccgcgggtgtgaggcccgtatgtgcccgtgtgtggggctggtcagtggaccgcgggtgtgaggcctgtatgtgcctgtgtgttggaccggtcagggctaaggggtaccaatgttgtgacgggggagattgttgggaatagtcccacatcccgggtgtgaggcctgtatgtgcctgtgtgttggaccggtcagggctaaggggtaccaatgttgtgacgggggagattgttgggaatagtcccacatccctaatctagggggagttgaaccaactttatgttgtgacgggggagattgttgggaatagtcctacatctctaatctagggggagttgaaccaacttaaaggtggggggagcccctcacctcttgagctaacttttggggtgtagcaaggctttctccccgttgagccaacccccacctcttgagctaacttttggggtgtagcaaggctttctccctgttgagccaacgttttccggttttgggctaacactccaggactgtgtgaggtggtaccgcatgcgcgaggacgtcacggcgtcaaacctctccgggatggggttgcagcgccaggctggtcccgttggacatcgcccaaaggccaaaatgccatgtgtgcgcggttgctgcgaccggtggtagcgctcgtagtctcgacggagtcactggcgccgcactagcacgccggcaaggagaggactatgatgttgttgcagtgcctattccgatgcggcagcacggccgtgctgctcagcagcgacgatcaccgttgtcgcgccaagatggaactccgtcgcctggtgcgcgccaccaccgcggcactggcaagcgacgatgcttactcctgcatctgcagcaagaggatgacgacggactcctcggtgccagcatcaacaaggccctctccaagaccgcccttcgcgcattcgctgccaacctgcagcgtcttctgcacttgcatacacatgttgaatggcctaagtgaaagtttaccactattttgtgttgcggagggggtggatgtaaatttggtgtctacgtggagtgccacgttggcggtcagatacagtcaaatgtcatttggacctgttgtgatacattaaaccaagatcgtggacataaatatgtaatttttcaagtttatttacctaagtgacattagctctcaagtttaaggaccgaccatatactttactctaactagcatggtggcccgcgcagattgtgcggctagtatcattatattttctatcatataatagcatatatgttcttattatattattcaaatatattaaaatgacaacataattttaaattttgcaataactttacaaaactactaatgtgtaatattcatattgtattttatatacgtgttagttattaattatttttaatatcaaattttagttatttgtaaattatatatattcctatatggactgtagactcgtcttttaatatttctttttttttaatttcgaattttctataaattgtatttctatatagactctatactcttcttccaacattatttatttttatttctgaatttttattatttctaattgtatttctatgtgaactctaaactcatatttcaatattctttaatttttaatttcgaatttcctatattgactttaaattcttcttcccatgtttttcttaatttcaaattttagttatttgtaaattgtatttttatacgggctctaaactctaattttaattttattatatttatttcaaattttagttagttttaaattcctatatggactttatactctacttctaatgttccttatttttaattctgaatttcagttatttcctaattgtatttctatatggactctatactctacttctaattctaatgttccttatttttaattctgaatttcagttatttcctaattgtatttctatatggactctatactctacttctaatgttccttatttttaattctgaattttagttatttcctaattgtatttatatatggactccatactctgcttctaatattccttatttttattttcaaatttcagttatttcctaattgtatttttatatggactccatgctcctcttctaatattccctattatttaattccgaatttcagttatttctaaattgtatttccatatgaactctgcattttctttttctccgattaatgtgagaatttctaggccatgagagcgaacgtggaggctcactctaaacttatctttcaatattatttatttttaatttcgaatttcagttacttctaaattgtattcctatattgactttaaactcttttaataatataatagctacttctagtattccttacttttaattccgaatttctattattttctaattttatttctatatggactctatactctacttctaataatccttatttttaattccaaatttcagctatttcctaattgtatttctatatgtactctatactctacttctaatattccttatttttaattccgaatttcagctatttcctaattgtatttctatatggagtctatcctctacttctaatattccttatttttaattccgaatttcagctatttcctaattatatttctatatgtactcttgtctcgtcttctaatattccttattttttaatttcgaatttcagttatttctaaattgtatttctatatggactctagtctcctcttctaatattccttattttttaattccgaatttcagctatttttaaattgtatttctatatggactctgtcttttctttttctccgattaatgtgagaatttctaggccatgagagcgaacataaaggctcctttttctattcgtttaataatataatagataaatataaggtgcttgatctacgacttagctgaatttaattactttgggccaatcaattaagctttttttttccaagaattgaattaacttcgggaaggaagaggttaggaacttctcccagcacatgtcaaacggggtgactaattatgtattaattaactaaaataaattttaaaactagattaatataattttttaaaacaactttatttgctatcgaaatgttttgaaaaaaacacatcgtgcttacgaacatatataccaaccggaataaacatatatacatagacagcaaagaaaaccgaactctttgttgaaaaagacaataatagtcgatcgatggagcgattgatattgcgtaaaatgaactaccggacttgattgttggcttgctgctctgcacgtacgaatgcatggcggctaaaattaattaatcaatttagcaactagctatatatgtgcctatgtcctccatggaaaaatcgtatcgtacttgtcgcaagcaactagcccattccgcagcaaatccaaatcttccatccggggacaaaccagtgcgtgcagatacatcgtgcatgcatgcaactagcagccactaacacaaacctgtctatttgtaacggctcaagtatcatctgtaacagctcgcccatccgtaacaaacaaaagatacggatgaagaaaccatcttttatcccgattaacaaaagatcacgggtgaagaaaccatcttttatcccgatttgtaacctcatatagttccaggatgcaaaccgggatcaagcatccggaactaaagatgacgatctttaatcccagttaaaatacactggtggagaaactatttgtagtcccggttcgtaaccccctttaatcccagttgtccaatcgggactacgaatccgggactaaatatagctatctttagtcccgagtaaaataaccaggactaaagatcggtgtaccattttttttatttgcatggcgctgttttctgcatggtatatatatctatatgtatatacatatatatatctacatgtatgtatatatatgtatgtatatacatatatatatatatgtatgtgtatatatatatatatatatatgtgcatatgtgtatatgtataaatacatatattacacacatatgtataatttaaagtacttaacattttatgtgcatatatgttaccaaaatatatattaacactaaagtaaatgtgtacatatataaatatatatatacatgcatatatagtacaattcatttgcttgctagctatagctacgatttcgacgccggtgttatgtcagaagaggaaggaccgacgttatggattgtcgatccgtcatagtagaattcaccatcaggattgaggacttcttcgttgatgaatcccatcagttgttcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcaagctctcgtgtggtgcatatttggtttgataggtagtgggcatactcgcatacgttgtagccgcataagtaagttccctggtcctgctttgcacactacatgagaaacgatgagagatttaatatactctttatattaactgtaattagagattcaatataatataattttgtatcatgcatgtactcactggaaaatgaaacctccgtccaattttttctttccaagtcccgcggaccaattgacggaaccgatcccaagccctacatatgcagttgtaagctatgattaattaattattacccgagatcaacataatagcaatagaatccccgcgactttggaatagatggcattatattacctgtctatcagttggaagaccttgtcaaaaatcttctcctctttattcattgagtcgtacacagtgactctgcatgcgtgagatgagatatatatgaaaatatacatgctatatgtatgggaacgaaatttgttcgaacgacaataaatactcactctgctgcgttaggagatggatgagattgtcctctgtgtctttctcgtacttgtcgatcatttcggtgttgattttccgagggtcgatgaacccagtatcgtaaaacccccgccatcgggccctgtgaatctccattctacaatgataaaatgaaattattattgtttacatatatgcaaggagctagttattgtacgaaacaaatcgaactcaaagatacttacaaaatccatgcgctcagaagagagacgtcaagggcgtccagatggtacagatcgaagacatccttgaaatggatccagagaacatcttctccttgcaagaagtcggggtttctgatcctcgctccgaacatctctttacccttggcgttcatttccatgtaccattcatggaatttgtacatctgtgtcgggggactgcagctgctcaggcgtgacaagcggtttaccgagttcaaacttgtatgccacttccgccttcgggattggtgcgattcccaatcagctgatccatagttagaccggtgtctgaaatgaaat

SEQ ID NO: 27677 - DNA, 3920 bp, Oryza sativa
  unsure (1)..(3920): unsure at all n locations
nnnnnnnnnnnnnnnnnnnnnnnnnnnnnnnnnnnnnnnnnnnnnnnnnnnnnnnnnatcctgctgcgttaggagatggatgagattgtcctctgtgtctttctcgtacttgtcgatcatttcggtgttgattttccgagggtcgatgaacccagtatcgtaaaacccccgccatcgggccctgtgaatctccattctacaatgataaaatgaaattattattgtttacatatatgcaaggagctagttattgtacgaaacaaatcgaactcaaagatacttacaaaatccatgcgctcagaagagagacgtcaagggcgtccagatggtacagatcgaagacatccttgaaatggatccagagaacatcttctccttgcaagaagtcggggtttctgatcctcgctccgaacatctctttacccttggcgttcatttccatgtaccattcatggaatttgtacatctgtgtcggtagggactgcagctgctcaggcgtgacaagcggtttaccgagttcaaacttgtatgccacttccgccttcgggattggtgcgattcccaatcagctgatccatagttagaccggtgtctgaaatgaaatccgttatgccaaaatcttcacctgtcaccaagggctcgacctcttggtttggttgttctccaagctgagggactggtttggacttcttgtgataggctttctgaagtgttcggtcatagtccgatagctttaaggcctccttgtttgttgtggacattcccttgaagaagtttttcacgctcgggtcaatagttatcttcttttcaggactccgaggcttgagttgcctctttacttctcctgccacataagcatcaagctcctcttgactgcaatcgtacggcggctccctgtttttggtggcgtcaactttcgccttcttcgttgcccttgtgcgggcatgcggtggagcttagcgagaccttgtcttgggaggtgcaggcggacacggtggagatggaggaggcggaggagccagaggagatggtgcaggaggagctggcggaggagccggaggagatggtgcaggaggagctggcggaggaaccggaggagatggtgcaggaggagatggcggagccggaggagattgtgcatgagacgccgcttgtcgccaagggaggatgatgtactgcttgcgccatagtataatggcgtggcttgtgtctcgtagatgcgtctcaccgtctcctcctgggtagtccaactcgagatcctcgtacgcggcttccaccagctcaacctcgaccctcgagtatcctgctggaatcgacctgcagtggtaagtccctgaaatgtccgttgggatggctatttccgacgccaccttcacgtgatgagaggttatctattagtaatcaacctaagcagaaccttgcggaatgtacaagtcaaaaatcataaaactacgagcataccttgattgataagttcttgaagggaatatgcagctcacatggtgtccgctgagtgatgtcatcaacggggcaagtggtttcatcctgggtttgcatggcgtccatgctctgtgatcctacctgccccgttgaggcgcaactgctacgattgcctgatgggctaaccattgcaggaggaatgtacggctggggattctgggaccgatgtgcggccatgcattcatccaccttccttgccacctcctcttgcatgctgagctcgtagctcgataccctgtactcaagatttgcaatcttcgcctcgatatctctcttactcctcatccaactcctgtacgtgtggatgtcctccttgaatctaatcttccagggaatcacgcctttccctcgtgttcgtcctggatgctcgggagtctgtagggcgagtgacagctcgtccttctctctgtcgtgtcggaatgtgccctgagaagaggcttccactgcgtccgttagttgactggtagcctcgcatatcagatcgctaaagacaagggagccatcaactgggttaagcgttccaccgtgagcatagtaccagaacatcgatcgattcgcccatttagcggtggccggttcgatactcctctcaatcaatcttgcctccatctcctcccacttcggcattgcgacgctatagccgcctgaccctaagtggtgatggtacttcttcttggcggcattttctttgtttctaaccatcatcggttgcccttgttactctgtcttgtaagcaacgaactcgtcccaatgatcccttagctttgggaatacgtcgaagttcggtgttagtcccttcaggatgtatttcttgtagagatatcccttgaagctctggaactattctgccattttcttaagagtccactgtttcactatgttctccgtacccgcagggagcgtgaacgtctcgagcattgtggtccacatcatctctttctctgattccgggacaaagctgtcattatccccgcgtgcccttgttctacgccagtacaccatgctgacaggcacgttatccctcacaacccaaccgctgtggcgtacaaaattcttggctgcttctgccggggcactaggtcaaccgtcttcgtccacctcagttatgatgtgccgaccctctatcttcttcacggcacctcgttgtccgcgtgccctcttctgtccagcggagggatgacttccactagcctcctcctcctcattcccctccgcatccctctccccgttcccctcctcattcaagtactggtttggaacctcgttcccctcttcttcgatccaatactggctgcttccctctgcgattatatcatatagtatctgttcctcattgcgatcagccatctgttcgtacaagaaatatttgctaagtctataggtcatatttgctaagcgtaatattaaaactctactaatcttatattaaatctctaataatcttatattaaaattgtaataatcatatatgctaagtctaacaatcttatattaaatctctactaaacttatattaaaattgtaataatcatatatgctaagtctaacaatcttatattaaatctctactaatcttatattaaaattgtaataatctatatgctaagtctaacaatcttatactaaatctttactaatcttatattaaaattgtaataatcatatatgctaagtctaacaatcttatattaaatctctattaatcttatattaaaattgtaataatcatatgtgctaagtctaacaatcttatattaaatctctactaatcttatattaaaattgtaataatcatatatgctaagtctaacaatcttatattaaatctctactaatcttatattaaaattgtaataatcatatatgctaagtctaacaatcttatattaaatctctaatacaatatgataagtctaataatctaataatctctaatactcacatttgctaagtctaataatctaataatctctgacactcacatttgctaagtctaatacaatatgctaagtctatcacgaatctctaacattcacatatgctaagtctaataatctaacactcacatatgctaataatctaataatcttatattaaaactctaataatcttatattaaatctctaacaatcacttatttacatcacttgcctgcgcgaattccttcgatggctagctaccacttcggcttgagggacgacgacgacgtcttttctataacattactaggaaaatgtattagtctaaacgcaaaggaacatatatcgtatttcacgttttcaactatatatataatcgtatatatatatatatatatgctaggtttaataatcgtttaattatctcgttcgtacacgtttcgctcccgttcgttctcacatttttagtacaagtgcattcacgttcgttcgtgtttcgtt

SEQ ID NO: 27678 - DNA, 2876 bp, Oryza sativa
agtcggcatctgcaggaggcgtagtcggggtcggggtcagccgcgagcgtcgacgttggcggcagcatcggcaacgagctaggcggcggcagtttggagagagagagagagaaagagagatcgagagagagagagagaggcagtggcggctctcacccaagagatgtggcggcggcttcagcggcggaggcggcgaggaccgcaagacgacggcgagagacgacggcggcgtcggcgtggggttgccctaggcagtggcgccgaaggagaagctgagatcgattagaggaaaaacttctaagtgttggtggagaagacgagggcgcaccgggaatatatatacccctagatctttagtcccggttggtgagaacatccgggactaaagatattttcccgctatttccaaattctttttaaacccgattagggttaagaaccgggactaaagataatagcactgaattttgaatttcattacatatgtgtttctaaaatagtaaataatgcattacaattatttaaagtcaaaaaattaatgacaaaaccttcgaaaaattattgttatctgtagtaaactaagtggataatatataataagcacatgaatgatttaaaattgttaaaaattttaataatcatatataattagcatatgcatgatattaaattgttaaaaattctaattaacatatgtaaataccacatgcatgatttaaaactaataaaaattctaataatcatatataattagcatatgcatgatattaaattgttaaaacttctaattaacatatgtaaataccacatgcatgatttaaaattaataaaaattctaataatcatatataattagcatgtcatgatattaaattgttgaaaattctaattaacatatgtaaataccacgtgcatgatttaaaaattctaataatcatatataactagtatatggatgatttcaatttgataaaaattctaataatcatacataattaacatatgccatacaacaattgatttgtatggatattcaatacatccaaaatagtttacatcgtgtacacaacaattacggcaatacatcggcggtgacggttgaccgcacgtactttctcctcactattgttccttccttgtgatcgctacgtgagtaaggggtgtcttcatttgataggaggatgctagggtcaatcgtcaccgtgaaagggggttgcccatcaaactgatcgtaatcctcgtcagtcttgtcctctactccgacaatttttctttttcctgggagaaccacgtggcgcttcggctcgtcaggctctttgcccttttttcctttgctagacatgtccttgatgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatgtcctcgatggcaccgtaatacgtgctagttgtaccatcgtgtcccatggcatcgatacgaacaacactgttctggctcgtgctcttcatgtcttgggctctcgtgtagaatgtgtacccattgatttcatatccctggaatgtcgcgatcgagccagatggtcccctcgccaggaaggccagttgttggttaatcgtctcattacccatgagatgttgtcacaaccacgcggagaaagtatcaatgtgataccgtgtaatccatgcatcggacttaccgatgtttctagcacgaactagagccaagtgctcctcgatgtaaggagccaccaatgaagattgttgcagaatcatgaaatgggctttacggaataaattgttgtctaccgtcattattgctttccttctgagagtcccctttccccgtagtctcccttcatggcgtgattcaggtaccccgattgggcgaaggacttcaataaattctacccagaattcaatgacctcctttgtttcataccccttggcgatgcttgcctctggacgagcacggttacaaacatatttcttcagaacgcccatgtacctctcgaaaggaaacatgttgtgtaggtacacagggccgagaataccgatctctttgacaaggtgacaaagcagatacgtcattatattaaaaaatgaaggtggaaatatcaactcaaaggtgacaagacattgcaccacatcattctgaagggcttctaatctatccggatcgatgaccttctgcgaaattgcgttcatgaaagcacatagttttgttattgttgcccggacattgtctgggaggataccccttattataattggtaacagctatgtcatcaacatatgacaatcatgagactttaggtttgcgaacttcttctccttcgtgcttattattcgctttatatttgtggagtatcctgacattaccttgatgctctccaagcattcaaacatactttccttctttgccttgctaagagtgtagctggctggactcaagtaatggcttcttttctcctttggttccgggtgaaggtcgccgcgttgttccatatgcttcagatcattacgtgcttccagtgtatctttcgactttccatatacacctaggaagccaagaaggtttacacaaaggttcttagtgacgtgcatcatgtcgattgcgtggcggacgtccaagaattctcaatagggtaactcccaaaatatggagttttttttccacatcgccgtgtgaccatcttcgctctctataggctggctgccaggcccctttccaaacactactttaagatctttcaccatagcaaacact

SEQ ID NO: 27679 - DNA, 10493 bp, Oryza sativa
  unsure (1)..(10493): unsure at all n locations
nnnnnnnnnnnnnnnnnnnnnnnnnnnnnnnnnnnnnnnnnnnnnnnnnnnnnnncgatgttttggcttcgtacggcggtccgccgtatgttcaaagtgcttgcctttcttccgtactaggtggtttgctgcaaggaatcgacgatgacccatgtacacaaccttcctacagtgcttaagatacgtactttctgtttcatccatacagtgagtgcaagccttgtaccccttgttggactgcccggataggttgctaagtgtaggccaatcgttgatggttatgaacagcagcgctcgtaggttaaactcctcctgtttgtcatcgtcccacacggggacaccttccttctttcacaacagtttaagatcttcgaccagtggttttaggtacacattgatgtcgttaccaggttgcttggggccttgaataataatcggcatcattatgtacttcctcttcatgcatagccaaggggggaggttgtagatacacatcgtaacgggccaagtgctatggccgctgctcatctgtccgaaaggattcatgccatccgtacttaaaccaaaccgtatgtttcgtgcgtcctttccaaagtgtttaaattttctgtcgatgtttcgccactgcgaaccattggcggcgtgtctcagcatcctgtcctgttgacgctcttcagcgtgccaaccaaacaccttagccgtggtattatagggaaataccacatcaccttagcaggaattctcttcttcgttagctgcccgtcaacttctcctggatcatctcatctaatcttgtatcgtagtgctttacaaacagggcatgcttctaggttctcgtactcctcaccgcgatataggatacaatcattcggacatgcgtgaatcttctgaacttccagtcctagagggcagactatcttcttagcctcgtacattgtctcgggcaacttgtttccctccggaagaatgttcttgatgagtttcaataaatcgccaaattccttgtcactaataccattttttgccttccattacaagaactctagagtggtatccaactttttgtgcccctgctcgcaacctgggtacaacgacgatctgtggtcctctaacatcttgtccaatttatgggcccccttttaactttcgcagtcctccttggcgtcctgcaacatctgaccaagatcattcgcaacgtcattaccatcagcatccctttcctcctcgcccgtttgatttccttcgaatccagcgtactgaccgaagtccggaatattgtcgttttccacttcatcttcttccatttcaaccccttgctctccatgagatgtccaacaaatatagcttggcatgaaccccgactcaaacaagtggaaatgaatagtcctggatgtagaatactccttctgattcttacacttattgcatggacaacaaataaaacccttatgcctgttagcttcggccactctcaaaaaataatgcacgccgtcaataaactctttggaccgccggtcagcgtacatccattgccaatccatctacatgaaatgaaaacaaatcgtacacaaataattattcgtacaataatgacagccatacaataatgataaaatcattacaaactctgtcaacagtcataaaataatgacatatcattattcatacaaaaattataaaatattacatcaaataattcttatttactatttctaaagttttaaactaatattaatttgttgtagttcttttaattttcattttagtttgttttctattatttaagattaactttcactattttttccttctcaactattttataaaacctttcaaataaactaaatttctatatattctttctttcccatacaaattttctctctcatcaacttacaacaaaattttggagacaaaaaagtgtacaaaacatagctccaaatgtaatatgacaaaaaaaacattagaggatgaagttgctaaccttttagccacctccgatttgtatataatcaccaaaataaattcactcgaaattttggcatgacctcttctcttttttgaagaaattttgaagcttgctcgggctggaggaggaagaaaaggggtgggactttagtcccggttggtgttatgaaccggggctaaagatcgccgggatctttagtcccggttggtaacaccaaccggtactaaagttatgatctttagtcccggttggtgttacaaactgggactaaagatcccggggggcctgacaagccctgatagcatttgaaccgggactaaagaggttggtgttaccaaccgggactaaagatcaaatatgcccgttaccctttttaaccgggactaaagatcatctttagtcccggtttttattgtaaccgggactattgtggaattcggccgaccgacgaaagatggtttctccaccactgatactatatggcctacctgtatatggcctacctgtatatcaaaactcaaaagtggactacattgcctaaatgtcgtggtcgtggtcgtgggtgttacggaatattatctcccagggagataaagatcctttcttgtgaaccaatctgaatcggagtagagataaggtctatctcatcctaagacccctatatatacaggggcagggtgtgacatatgaggttggcttgtactcagaagagatctataatgaagagagagctccaccctatatctgtgttcattgtctatttctgcaatgtttttaagggtaaagggatgggcgcgggtgttctacatcatctcacgcctctactgctatgggagtaacaggaaacggatccggtgatccgctaataggcgcgttggtttacaacacgttatcaacagctctccgttcactggtttgttgctccaatctgttattattattagattggattttaatgattgattaatctcttgatattttcgttgtttgcatgcactaccgcgagaggtgctaccgacgtgatactggtcggtcatcgcgttgcgctatgctaagaggagttgccgtccgtggtcggcggacgtccgtggtcggcggacgtggttggaggacggcgttccagccctgcaagacgcgagccgtgcgcgcctgccttcgccgtgggcgtcgattctcgccgtcgtctgcgagacttcacgtcaatccagtcggcaaaccccacaactgcatgctcgtgcgccgctgggcgatcagccgatcaccctgtgactcgcgtccgccttcacgtacggcgttggcagcccgcgtgttaccgtgccggcagtgccgcacgtagcggcatgcaggatcgatctatatgcatgccacgcatgaacgatcccatccatgccacgcatggcctgagtcggacgggcctgcaccaagcgggcaagcggccaacatgcatgatgcatgcactagtgagcagcctagcatgcatatgctagggtttgattgcatatcgttacgtgcacccgagacatactaccaggagatgaatacgtgcttccatcaagcacgctaatcacggtaattagtaagattggtttctaaactaatttactaattcatagatacatccgggcatgcgtctattaaggtatgcggtgtttttataaattgattatattttctcgtttttcatcatattatggatgctttgcttgcagtagatttgattatgctcttgatctagcggtagattaatttcctgcttttgatctatatgcatctattttatctgatgaaaactgaagaaacccgtgtgagagaaatcattaaaattgatgggataccctggactggagacgtgccaaattcggctgggccgaaccaaccgtctcgcccaccctccctcgcatctatctgtttctctctttctctgatgacgccacgccggaaacacggcgacatattctcagtctgtgcagtcggacttggagacatgttggccattgttcgctgtcgctgttgggtacgccatcggccttgcgtcgatgccgtcgcgggaaacagccgtctcagaaaaagccctaaacccatgtcgttgttgccgctggagttaatgctgaagtgaggcgccgccgccgttgacctcccatcgacgctgccgtcgagccgtggtgggaggatgatgggtcattggttgcctactatcggattaatctccgccgagacgatatggccggatgcaatttgtttgctgttgttggggtctcagttgctgtaacgccccgacattcgttagccataaacacagctaattcacaccgaggtgttatgcattacctgtgatatagtaccagtcccaggatacactagcttttacacgcagaataactgtggaatcaaagaaaactgttttattacatcactgggtagtagtccttacataagttgccaccatggacaggtccatagatgagcaacacaacattacagaaaaccataaaagcgacgacgcagaagcgaacagcgcggagaactaagcgactagcgaatagcgcggagaactaagcgactaagcgactatgcactaggcaaagaacctaggcaactaacttattccacaggcgagctttggggctaggcacgaaacatctagaagtctgttgacggttcttaaatcataatatctgaccgtcattacctacatataatgaaataaaacatggtatccaacttagtggtaggtattattactaatcatttccactagtgttggtgaaatatgtgtatgcaggtattttgagaagaaaacacatccgtcaagcaacaaactgcacctccgcgcattcaggatacatttacacggattggaggccccataagtcaagtaaacaactccaaatgggcccaactatcatgccaataggctgagggtctcaaaattagtgtccacgataaaaaatgggccgaacggagccgtctcgagttcggcccgaacactttttgtggccgttgatcgtgagattcgatgtggatggccctgatctcttcctaatgatggttggagggtagtttggtcgtttcccatacctgtaaccgtcatatggaggctataaatagagctcctctcattcattcacaacacacaactttgagctgaattacaagaggctcttttgtatcttttctacattagaataaggtagagagtgagggcaagctctggaggagtgcccggaagtttggcgctcatccgacttctacctcgacgagtgtagcttcctaggaggaattctggaggagtaccggagctgtcggtacactctgctccgggttcggagaaccttcttctattaagtaagcattcgtgttcctttcttatgttatttaattatttagtctgagtaagatatatttccatctttgcgggttcattgtttagtattcatactaagtgctctagtactaggactctggataaagaaggaagttcctgtacgagtattagagtagtaattaataacttagacgtggtgtctaggttagagagtattagagtagtaattaataacttagacgtggtgtctaggttagagattacctttgttttgtgtatcccatggatttgtccgaggtaggcggcaggtggtgacagccctgaattccgtcccagtaatcctccacgtttggatgcatcatagagctatagataggaaattacctttgcttagcttagaaaattaagaaacatagaaagtcctctctagcctagcctacctaccatcagttgttgtccttggacagtcttagtcttaggtagattacacacgttccctgagttcgatatccttttggggtcacccgaaggtgaagtgctacagcgatattccgtgcacttgtggatttatctgtggtcgtacgaaataccaacaagcatttctggcaccgttgctggggaacggttgctaatttatctgagtctaggtcatcctcatatctttatttttatttatttttcttttattcttttccttgatggagcaacccacaattcaaaacctttctgctcctcgggctgatctttgtgagccgtcctgttcttcaaaaccaatcctttctgatggctacgaaatcagtcctggctttatagccatgattcgagagcaaaccttctctggtagtatcggtgaaaacccatacctctatcttcgggatcttgagctagtgtgtttgtgcctatccatcgtaggcatgacacatgaaactctaaagtggaagttgtttcctttttctcttagagataaagcgaagcaatggtacactatgtctgtcaagaaattccacggtgaatgggaggagcttaagtgcaatttctgccttactttctttccattaacccgtgtaatcaatcttcgattagacatcctttctttccgacagaatgagaaggaatctctcggtgcagcctgggccaggttctcattgttaactcagtctggcccaaacttgtgtttacccgaccatgtgttgttacaacattttcgatacgggttagacaaggagtctgctacaaatctcgatattttcgctggaggatcgttcgcacacaagacaactgccgaaggaaaagaactcttagatctgatcttagagaacgattctttcggccaaagcgaagcatgcccggagatcgagattatccatgagtatcctctgcacgtggagtcggaacccgactcaactgtcgaatcctcattccagtcgctggagccggaggaagaagaaattcatcctccgaaaattccattccaattcaggggtgatctttatgaaaattatgagaacaccctgaattattccagcgaaaagaaggctcatcccaagcatgagccgttcgagaaggtgatgtttgtatcttcgttcgtttcttctgaatctatttcccatcttcatgaaactgaacgtccctcatcaccctcgatcaagcctaagccttgtccctctggccctcataatgatgttctcgtttatcatcatgaaacaacccaattcttgcacgatgtatctcttgagaaggaaaacccttaggccacggacaagcttgagacattgactctggaggacgagagaaaacattccacatatgagcatgaaagtttctctttcaaaaccccccaggattcatgctcacataaggaatccccagagtcctgttctgtggtcgtaagaaataccaacaaagtcttcatactcggctaactcctggagatactcctcggcggttgggacgatgtcttcatcttcatacactatagattattataaggggcaagggtgagtacttaacgtactcagcaagccaggggaaagaatgacatgtcggtttaacaaggaggctaggcttttatttgcgaaagctgcttttttggcaaagtgatttatttcacaaaactcctaatgagtgagtcaagttttagttgtcgggaggaggctcacgcctcgacccatttcacaagttgctttgcaacaacttgtcacgattaacgaacaacaattaatttgtttcttctattagcttcttctcactttcacaacaacacatagtccacacagacatctcagcacaacaacgccatcaaggccctaacaacacctcggtgtcggacgacaccccaggtcacatagacccgttgctaaccacccaggttagccgtctgccacacaggcggactctggaaacgttacccttcccaataaccacttcttcacaaacatttgtcaaacaaatctacgctatgagaaacaccttacacttgcccttgaccgtgggcacggctgttcgaacagttcattaatctctgcagaggttgcacgctttacccacacgagacgaaactgacatcgtttacccgtcggcaatgaaagttcgtgataaggcctttccaaagctaacccatgaaaatcgcatgccacctagttgggctaagatccatagccgagtatcaggcaatgatagccgtcatccactcaggaaatactgaggatgcctcctactcctactggtaccacgccacaatagaagcaaaaagacacccatgatgggcaaaaatgtgtaacacttcgtctcctcatcctcggcatcccacaaccattggcacaccaactcccatgtgataacaatttacttagccagaggcatcccataaatacccgtgtggtcgcactgtaacgtgtttggatggatttcccaaaggaattggtccttaacgacaatacgtagccaaaccacaaaggcatgactccgcatcatcaccactttcacaacacattttatttcacaactactcagtacaacgtaccggatttttaaacatgtatttggaataacccaagtttcccacatggcaaaacctcggtaatcgtataacaataccggcacaaatatttgtggagctatcaaatgtatggaatcatcaacctatgaaatataagtacgactactaggttggtccattggttgaataaacaatccgaggcctaacatgttaatcgtgtaaactaaataatgcatttttgcaaacaatgtatcattgaaaatataggggtaatgtgatcaaagaggcttgccttgcacagggtgcgggtcttctccctcgaaagcggcgtccgaagcttcctcgtacttaggctctaaacgtggaaacaaagctaattaagaaaagccaataaatctagctcaaatcagagaaacaatagtggcactgtgtagatttcaattttagaaaaatttaggaacttgaacggggtcaatcggagttacggttgattttctacgaatttctaaagaataaaagaattttctggaataacaatttttggacggtaagggaatattccgttggaatattccgttagctgggacggcagaagaggggacccacctatcggcgatggatgggaggaaggatgcgcgggcccggcttgtcagtgggggatggaggtaaaaggggcatggggtcagcctgtcagcggctcggctccgccttcttcttcctcctctgctcttttgctcggctcggtctgggatggcgacgcaccgcggcagcgagtcccggctcagcgaccggcggtcggggaggcggcggcgaactccagcgaggcaccgccggcaacggcggcgctaggaggcgcggcgcagcggctctaggcggcggtacatagagtgaaatcgtgagaaagagatagaagagagagatggtgatggtgtggggagaaggagctcgggctgcttccccttttataggcgggcgacgaggtggcgagctggcagtctaggcgcggagctccgggcgtagacggctagcagctagggcgggatttcgagacggatgagatggtgaggcgacggcgatgcgacgacatggcgtcatgcgctggtggcaatgcgacggcgaaacgaccgcgacgcgacatgaagtgacgcgcggagagcgggaacggctgcgagacgtggatgacgtatggccgacgacgactagggccgggatttggggcggtagggatagagaggggtgacgcatgcagtggtggcaatggaacgcgagagagagggagagatgcagccacgtcttagcggataagctccttcgcgtcgaagtaaacgagaacggataagcaagggcgattggataagagaatgactcagcctagggttaggggtgacgaagggtgaggtcgcggccgttatctgttggcgtcgacgcaacagcgaagggaaggcgacgcgatggatggagttaaaggcgacgggacggggtgacacgaggcaacgtggctccgtgtctcccggaaagaaaccggagcgaggtcgggcttggcgcgacgcggatttggcgcggcgcgggtgccggctcggtgcgggggtggtgtggcgcgggtgttggcacgacgcgcggcgcacaggagggtgttttggtgcaatgcgagacggacacgagggtggaacggtgcggcgactcgagttggcatttcgtcgaacactttgtgtgcgtgcactggctggtctgaggaaggagaagaacagtgtttgggctgggccgagtgggccggcctacttcgggagaaaggaagaggagagggtggagaggagttgggccgagggagagagaagggaaaggagaggaggcccaacatgaataggtgagctttcacatttttcccagggattttgagttgaattttgagaaggatttgaaaggaactcgaatttgaatttgacctagggtttcataggaatttgaaaggatttctatagaggatgatttgaaatctattttggcacaaaatcaaataagaaccaaattaactccaaatttttaaatggcaaacttttaaataaatgcaaaataaaatatgggtgctacacttgccgtcggtgagttcggctcgcggcgtcatgaggatgcgcgggttgacgcggagcttcgtcgtgtgccacccagacgtcggcgcaccatatggccacacggagtgatgt

SEQ ID NO: 27680 - DNA, 12172 bp, Oryza sativa
  unsure (1)..(12172): unsure at all n locations
ggagagatgcagccacgtcttagcggataagtcccttcgcgtcgaagtaacggagacgggataagcaagggcgattggataagagaatgactcagcctagggttaggggtgacgaagggtgaggtcgcggccgttatctgttggcgtcgacgcacaagcgaaggaaaggcgacgcgatggatggagttaaaggcgacgggacggggtgacacgagcaaacgtggctccgtgtctcccggaaagaaaccggagcgaggtcgggcttggcgcgacgcggatttggcgcggcgcgggtgccggctcggtgcgggggtggtgtggcncgggtgttggcacnacgcgcggcgcacaggagggtgttttggtgcaatgcgagacggacacgagggtggaacggtgcggcgactcgagttggcatttcgtcgaacactttgtgtgcgtgcactggctggtctgaggaaggagaagaacagtgtttgggctgggccgagtgggccggcctacttcgggagaaaggaagaggagagggtggagaggagttgggccgagggagagagaagggaaaggagaggaggcccaacatgaataggtgagctttcacatttttcccagggattttgagttgaattttgagaaggatttgaaaggaactcgaatttgaatttgacctagggtttcataggaatttgaaaggatttctatagaggatgatttgaaatctattttggcacaaaatcaaataagaaccaaattaactccaaatttttaaatggcaaacttttaaataaatgcaaaataaaatatgggtgctacacttgccgtcgttgagttcgcctcgccgccgtcatgaggatgcgcgggttgacgcggagctccgtcgtgtgccaccgagccgccgccgcaccatattgccacacgggagtgatgtcgtcgccgccgtcctgccaatcaggtagtggacgggtcatcgatgacctcctcgccgtgtgccgccctaactcccttcaaagtcgacagacgacggcctccgacgctgccgccgtgctcgaggggccggtgcaccgggcggtggacaccgttgcagacaatgaatgggaaaggggaaacccaaattccccccttctcttgctcggtcatttaggcttaccagttgggccggtctacctccgcctgaccgaataaagcccaacagtaacgagacagcccaaacaaattaataaaaataataaacttggaaatcctcatgggcctagagtttcggaaattcggcccattaggcattttgggctacactgtgcttgctagcccaaataagatcatggcctgaacggtaattcggcccgattaatttcggtttattgacaacttgcgtttaagcccccagagtgctgggtttttacgctatagttcactgtttaatggaattttacagtttgaaccttataattaacaagagattatattaattttatttgtgtggctatgtcttgttgcttaggccctgtatagtttggttttgcatgtgggtctccggactcgtaaataaccatgtaatggtgttttttaagcattgctttgcttttaaaattgatgcaattccaactaaataatctggagatggttttctaggttatgatgcttccataaattgtgttcatatagtgtagaattcaacccttggaagcattatgatgggtttattttcctgcatttatgtgtgatggttttctatgtggtataaatattgggaatataatgccaaataagaccaagtaaataatagaaaatcacttaatgcatggaaattctaggaaattaaatatccatggctatggataagaccactctttactgatacactcctccatacataaatggtgatatcgatgtgtctacaagatggagtcacgtatacttgttgttgagatccatgcttttgccgaattcactgcgcatatcatctacttgcgtgctgcgttctctgagaactgcatgaaacgatttggatgatagtgtgggtgatttcatgtaaaggccttcaatgactattgtatggctttgggcattaatatagatcactctatccctatgatcacactcaagaatgggattctgagtcattgaaatgtgtggaataagacaatgtgtttgggattcattgtgcctttcccctactggcttaacatctcaatcagagtatggtcggactacggtcgacattttgctttcccaatggttgagagcacgcttttctgatttggagataaatgattatacctcaattctctagcaacgtggagttgcgaggttcaatagtttgagatatttttcactcggtctagtgaaagatgtaaagtgttttccaggtggtggaatgacactgttcgtatggttgcccttggtgtgcacatatcttctcactattatttggaacctgatgtcttgcgaggacaccggaaaattggatgcaaatctagtggaataagcccgagggtagatgctgtgaataggcatgattcccactccactatagcgccaacagctaaacttgggtgttgacccagtcttggtcctcgcatggatctagcgctaatgaccacctttggttgatgccgatggttggtggtgtctgtctaataagttgttctgacaacgggagttgtattgctagtttagagcatgtcctaggagaacattggtcgactatactgttgccaagcagtttatcttttgcttagtttggaactttgtattagatcaatatttctcagataaatagcgttcttggtctttcctgttctattctaaagcttatcttcatgctggaattgataaaatgctttagtttagaataacaattagtgtatgatccgaggagttacaaccacttacacagttcagcgtaactgtatttcaaacaaatgttggctatgcactattgcgttttatcgcgctctcgtagttgatgactactccctggttgtgttggttgatcacccatgggttgatgaccatgcttgtcgcacactggcgtttttcgcgtgtggacatgtgcgagtcatgcaaaggttcgtcgtgttgcatgcgttgagcttgttatgccaacgacggttgcaccgacacattctactatttttgtggatatgtctgaatataatggttttattgtgaatattaccattgttggaggtattgattatctcccaatggctatgtctaggggatattagcaaatgtggtttgataattcgctcgtgcatcatacctaatacatgctgcttaactataacccaattctagagtttggtatgagtaattggggtcaaacttgggcattaaacaaactggacattaacccaactctgcaccacaaaaatctgcttggcagcgtaggctagtggccgtgcatttttgctatcatactccttgtcgagcgcatcggaatgcgttttgccaccataggttgccttcttaagcatatgacatgggatgtctaatgcacgtcgatccggaatcgattgtgagtttgaatggcacaaggtgagcattaatccatggagattgcatatggctaaagtatttgcatgttggttgcatatacatttggtagcaatagtggtttttgcagacttgtatatcctaactaggaggttgaggataacccttcggaggaaggaagaacactgtagtcatgccactgtattggtatatatccaggctcactttaatgcaaaaatctctccgattaaagtgcataatatttcccaaatatatcgccaccgtagcatacattcatgggagaacatttgtgatcgaggtgaaattcctaaatcctatgccacgatatggggattggtagtatgctattgtaagatatctcggcattagggggagagaattgcccattttggaatgcatgtacatttctttgagtgaacgcactaaatgagctgaatttgtatgtttagttcatactcctggttgcttggtgcacggagtttttgccaacaaaatcatatgaggaacaactggatagttgttaaaaagagtaatgctcccaattatggtaaatgtggatagacccgggaataatatcgtatccatataagacttatggaatttgatcatgttatgtgaggacgcctgctaacacgatccgtgggccttagtcagagcataagagttctcaccggatgtgagcatactcctctgattctcctagtggagaattcaccttcggaaggtgatatacctcataatgatgttcgtcgtggagacgacattcctagcaattcgcacatattatggtgctaggaatatggaacaaccatggatcgatcgttttgggaaatgacgaagatctggttaaatgtgtaagtgggaataaatgtgtcgcctcttgctaatgattctctgtgagagaacccggatctggaaaaagtccatggcatgagcatgcgatgctcaaatcgggtcaaatggaaatgcaattgaggctgaaccgaatcactaagtaaaagtcgcgaatgttgttcggatttttagggtcattattgagataatgaggtggtgatgtgcaatggttcaagtaggtccttgatgagacctctcccacgtaagttgaatgttccgctaaataaaggtattggcaaaatggcatgaaattaaatatgcagttaacggatttaggaaatccgtgaggtcttgaatagactccgtagtgaagttgcagcatgtaaatctcgtaccaatgggtattctgataagagtaccatttcccgttgggagaaaatctcattgatggatttttctctgaggggagacctcattgatgaatttttctctgagatacaaaataattagtaagtctgaacacaccatattgtataatcccttggagggattaagacccatttatgacccggtaagattgcgatgaggaacctgctaaggtatacttagtgttgttggctatgtgttatctcccatagtgcttaaattttcagactagctagttactctgatagttacaacatatctttggaaggcttgtagttgatcttgtggatctccaattgttgttgacatcgtcagagaaagttgcaatgatcaagagatgtgtttgcttggcacgtggcctaccgatgaataatgcggtcgagagatgtgtttgcaatatggggcgagatgttgccacaggcagcctagctagctagcttacgaccggcaccgtgcccgtgcagcagccgcaccgcgtcatctctcaaatttcggaccacgaactcgaaggcagccgcggctcctgtgccgcggagacgtggagacctggagaaaaacggcatctcgtcgcctccggccgccacgtgaattggctcgatcgcggcggaatggcgtacacgccagcgcgcgcggatcaggcggtagcagagcgctttctcgtcgcccggcggcactggcgggcggcgtcgagtggagtggaccgattgattgcggcagcgactgatggcatggcttgggtcgtgcctgtgacggcccgccacgaatagaggccttatcgcgctttcgtcccgtacgtgcttgggcctcgttcctcaccgcacggcccggaccattttctatcttgtgcggcacaagagtgccctgtatgtatacttgccacggaattcattcctggaacaaattttactttcgcttttccctttctcttttcctttgcgaaaacaaaaggagtagttattcgatctgtgatctgtgacgtagagccagcaacgatcgaatgcatatgcatcgatgatcattcgccgatcgcttctttcccgaaaattcattggcggatcgcttggctctcaagtaaaataatatagtactatttagtactccccgtttcaggttataagacgttgatcaagatcaaactgttttaattttgattttaacttagtcgaacttgaaacatcaaactcaaaacttcaggcctgttcaaattgtaatcaaaataaacattaccaaattttgacaatattaccatcctagcaaaattttggtatcctagcaaaattttggcaataccgaaattttggcaggatttcttatgtaattactaaatttggcaacaaactaaacgtagatatttttttagcaactttgccaataaatggtataattgaaaatgacaacaatctgaaaagcaccttcttgtaacctgaaagaagggagtacaagacaatacaccatgtacctatagtacgtatatagcatatgaaacgatcaaatgcctatatattgttgcttatcctattgctaccatatgatgcatcaatcaaacaaacaatactacgctttcaggttaaatatttctctcacacttcatttgattactcgtttgttgatctcaaataatatattggatcatacctgtctaacaaatttgccggtcaattcaggtctttgaccaatgggtttcaatttccatccggtgaacgacagcgactggttgatcagggcggcgatgctgctgagcttcaccctgcaggtgatcctcgtctttgtcgcgcccacgcgcaagcgctcctgccacccgcttccccacctcgccgtctggtccagctacctcgtcgccggctgggtcgccgtcgtcggcctcggcctcctcctcaacagcctcagcatcagcggcagcaacaatgggtcctcctccatcttcgccttctggacgccattcctgctgctccacctcggcggccccgacaccatcaccgcctactccctcgatgacaacgagctctggctgcgccacctcgccggcatgctgttcgtggtcttcgccgcattggtcgtcttcttcagctccgtcacgagcaaccccatggtcacggccaccgtcctcgtcttcgtcgccggcgtcatcaagtacggcgagagaatctactcgctctactccggaagcgtgagaggtttccgcgacaagatgctcggcgagcctaatcctggccccaactatgccaagctcatgacggagttcgagtccaagaagaacgccggcctgatggtcgagatcatcgtcgtcgacggcgagcacaaggaggcgctggagcaggcggaggtgatgaagaacggcaggaagagcgtggagacgatggcgtacgagctcttcgccatgttccgggtgctcttcgtcaacctcgtcctcagctacaaggagcggaggatcagccaggcctacttcctcgacctcggcgacgtgatgacggccgccgcggcgttcgaggtggtcgaggtggagctcggcttcctctacgacatggcgtacaccaaggcggccgtgtcgagcaccaggagaggctgcctcctccgcttcgtcgccacggcgtgcctcgtcgtcgccgtcgtcctcttcgtgctcatggacaaggccggcgtccgccacgtcgaccgcggcgtcacctacgtgctgctgcttggtggggtggcgatcgacgtggccgggtacctcatgctcctctcctccgaccggacgctggcattcctcgacggcaagccgaagctagcttggcttgcacgggtggccagggccgtgcggctgccgacgaggcggtggtcggagcggatcacgaagatgaacctcatcaggtacagcctaagcaagcccgaggaggacgccgcccgccggtgctggtgctgcaggtgcacgacgatcccgcgcgtcgtgcgctgcctcgcctgggtagccgacatggtgggcgtgagggagatcttggacgacttcttcttcatccggcacgagccggtgagctgcaggaagatcaaggattccaacaaggggaagaagtccatcgacgtcctcaactacgtgttcgatgggctcaggaagacggccaacgaagtaaggtactccggcggcaacgagatggaggaggtctgcgactaccgcggcggcgaggggataatcaatgagctcgtcggcgacatccagctgatggagctcaacgtgaacgacgtcgtgcgcgaaagcgtgagaagggagttcgacgagtgcctgctgctgtggcacgtcgccacggacctgtgctcccaccgccgccgcgaaatggaagtgccacggaacggcgacatccagagcttgatgtccatcagcgagaccctgtcggagtacatgctgtacctcctcgccaggcgggccggagatgctgcccgcagcgacggcgacggccgccgtcatcgggctgctccggtaccgcgacacgcgcgccgaggcacgccgcctcttccggtcggcggcggcgtgggaccccacccaccacgacgcccagaggatgctgctcgaggtgaacacgtccaagaagccggcggttgtgaagggcgacgagagcaagtcggtgctgttcgacgcctgcatcctggccaaggcgctgctgcagctgggggacgacaccatgtggagggtggtggccggagtgtggagggagatgctcgtccacgcggctggcaggtgccatgggagcacgcacgttcggcagctcagccgcggcggcgagcttatcagcatggtctggttcctcatggcgcacatggggatcggcgacatgtacaggacccaggtgggggacgccaacgctaagctcgtcgtccttgaccagtagacatgcatgcctgctgccgcatatattttaatactccctctatttcaattcgtagcaacttaaaataggattagatccattttaggactacaaatctcgacatatatttattcagattcgtagtcccagatctaatcacattataagtagttatatattaggctagagagagtacatcacttacaagtgaccttccgcgaggcagcttgattcgttcttgttgtcttaggttttttttttttggtgtgtccattgaggatcaagtagatgatggcgactatgtgggttgttactaccatctggattgggaagattgattgatggcagttgaagtcgttcaactgtgttaaccgattgtaccgaaatttttacaatttggctcttttaaaaaactagttaaaaaataagccttttgctcagcgccaaccttaatggtgttgtgataaaacatctcagcggcataaccattggcgctgagatcttattcaaggtggcatgatttcgccatgtaatcaggcctcagtgccaatttagttggcgcggacctcttgacattttaaataaaaaaaaggccatgtataaacctcaacgctgctagcctggtggtggagcccttgctttgcatctggcaggtttcacattcaaatccctagttctactttttatttcctacctgccctcctatttttctttttaagaatttggaatgagcagatttgatgatttaaattattgcatttgtcttagtaaaatatttagcttaatatctactacgaatttacaacaaaacatgtgttttcttttaaaaaaaatggagaacaaaaacctaaaatggtaaatattatataagtgaatttcaattttcaatttcaaaaataaaatggattttgaaaccatgcaattttttaataaaaaaacttaagcagaaagatgataaattgagcactgggtaagtgagaaaaaaataggaggctatggggttcgaaccttgaacatggatgaagcagcaaagtggacttacaactgagctgtacccttaaatctaaatactatagtttgattctgtatacttatatagttcatcccactaagtttagttaatactatttctatcttctctcattaagccacatcaccctaattatttttagcatttgaatgatagatttatagttcaaattgtctcttctttcttctctcataaaactatacaatctcaattatttttagactcaaaattcataagtatcaaaatttattttagtttcaataatcatatcacatcttatttgtacatattaggcaccttaatttcccgtagcaacgcgacgaggtattcatatagttatctatatattcatacactaaggtcgtgccatctcaggtagaatgttagcaccaatggtaaacatctcagcgccatcatggttggcgttgagtaaacggctcatttttgcaattagctttttatacgagttattattgcaataaattttttaaaaggatcaaattgtcaaaatttcggctgattgtgagtgcatcactttggttgtttttggtgtgtggtaggtgcatttgatgctaccggcaagcatttgatgaaccgattgtgagtacaatggcgaagattacaaggtgaaaagattgatccattcatcgagattcgacaacaccgcactcgtatgtcatcctcttattagaggtgttatttcaggttttggatgaaaatctagatctatcttcatatagcaacagcaatacaacacactcatcaaatccttgttgaacacctagagtgagtgatgtgaaccattcctactatggataaaactattgttcacatcatggattaacaaaaagacataaagatcaattcgtccaagtgctgaaatccgattcggccacctgctatattgctgacttcaaactgtcaccaaatgtgcatatacgagctccgtttttggcccgtgagtacttgtcaagtcatcttttcaacagatctagcctcatctccaaattcatttctgtcggctgcaatcacagaaacaatgtgttgcatcacctataatgggtctatgggcttgtaacttcatctggacctagcccaggtggggctctcatgtggggtgcgccgcaacatggtggagcatgaccctatggaccccttggtcgtcctcccacctccttaaataggtaggtaccccttcagagtttcttgagttttgttgattagatttagcaacttgctacttgtttgtagcgcacgtgttggataaaccgtttgtctgtttgtttttggaaccccgccatattgttatttcagagtaaaaccttcatatctatttgttcttccaattcggtgtgtgttctacttgttcttacttgtttttcgattgcttataggatgagtgccctcgtgaccgggttgacgcgcaccgcaagatcgcggcgaccactagagacagtattgttgacggtcgttatagaccaatttcgaccatcaatacttctagaaataatggagacctagcaattcttgcatgcatttttatttagaaataatctggttccacttgtacttggtaaagtaattgtatataggagatcacttcataaatggaggagaaacgatggaaattcaccgatcaatcaatcagagcctgacatgtggtagacatatggatggatgggcccacaaacccattaaaacatttgtaaatgggcccaaccaacatgccactggccaagtatccatcaaacaacgtccaagaggaaggactgggccaggaggcctgccaaaggtcggccgaccccggcctggctccgttggcccatgcccaaaccaatgacggttgtaaccgatttgccaatggcagttgtaccggaattaacgcccacaaccgtcattctcaaccactattccaatacacaccaagaaagattcaagaagaagaagctctcttagtttactcactttgctctagtgctagtagagttagaattagaatagtctccttagttcttcaagtgtaacatcctgaaaattcctgacattaaaaatcactaaaattttgaactttttaaaactttttgcatcatgctggaagttatggttgttattgcttgccaaaccataaatcgacgcaatggaaaaaaatcaatctaaagatttacacccgagcaatagttacgatttacaacgatacgatatttattatcaatcccataaatatttatgcacatgaaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcacatgaaatataagtacacatgaaatgatgatcacatcaatggcccgatctataatagagtttctcactagaatatataattaatatttgaaacaccttatcaagctcctcatagcatgaaaatcactcatataa

SEQ ID NO: 27681 - DNA, 21152 bp, Oryza sativa
ctgcccattgctccccacactacccccaccacctcccctcccttttccctctctttcccatccccagcgttgccgcctcattggaagccgccaccgccgccgctgagccgatgcgccccgccgccgcgatgtgcctcgtcgccgcgccgtgctccgccgtcgacctcgccgccgcgtctccgtcgaccccgccgccgaaccggtgagcctccccctcccccaccgcttgccgtcgcgccgtgccgcccgccggttctagccgaggctgtgagagagagaggagaaaacagagaggagagagagaaaagagaatggaggagagaggttagagtgggccccacctgtcattaattccatccaatttcccttagaaaaataattctgtagaaaagaaaatcaagaccttgaccccacctgtcagtcactatagcttgtggataaggttgtattataaataaatgaattaggaacagtaccatttcgcaattattagaattaattcaaatttgaatctttacactagcataacttattcatttcagctccgatttgagtgaaacttgaacctaaattcataagctttccaatgatatataattcactatttgataaaatatatttataaatattaaataattaatatcaagatgatgcataatagtcaacttaaaaatatgctaataaataaaattagtattgtacagtagagtggatgtaataatatttgtctctaacatgtcttgccactgtaacaaccacacaaactaattttatgtgatgtctcaaatgaatggatgtagaggaaaatactagtacttatttaatattcgatggccatataattaaatccatggcttataggttatttaaatcaagtatagccttatgattatgtaactaaaatataaacacacatagatgaatctttaacctgtttaggagaataataacagagctagatgtggaggaatcactaagtaaattaatcgatgcaataccatatagaatagcatatatatgcctaaattgattaccacttattagtaactcaatagaaccggtgcttaaacttgtcgcatcacatatacaatatcactcatagaaactagctaatgtataattaaactacaatatattcaggaatcacttggagcattgggtagtacactttctaaataagctcatgtacagtaggcgaccaaaaccttatacgttgttgcacacatatattgtacatcccattatagttatacaattaatttatctttttcatatattaaactagggagtatataagaaacatgaatagtagataagtactaattataaatcttgacctcatatgttcatagttcaattgtaactccggattgttcattaagagataatctgtaactataatattataaacttcccgaatttaacatatagagcatggataattattagcccttttataatttataatggcaagtaaaatatgttcataattaaagtaaagcttccatcaataaaataataatacaaataattcactataattgtttgattgatcctaaatccatctaacaacagaacctctagtatataaccgtcctatttagatagatgcatacatagccataatccttccatagccatttgatagactaaaccaccgattagccaaatatatatgtatcccataaatgctatgttggttaactcctaaataggccacgatgacaatagaaaaattaagaaactttagccttagcatgattgggatccattagcaaacacgaatagtacattttgttgcgcatatttgattgttgtttgaatattggtttttctcgcgtattatagaccttgtgtatcgcttagtcgtgaggcaacgtctgcaacttccaggaggtgaaggttgatcaagattatatcaataataaggattatcctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggactgagccatgaagttaagcatgaaacaaccccccgtacaaccgtacttctcgaatgggtatagacctagcggattagatagccgagcggaggcagtatccctgcatagatggttcacccctgagtgaggcaggtgcgctacgatgggacagccgttgaggtagggctgagaggcgtgccctacatcggtgtcaccattggtaggactgccatgagtgtgtgagagagagaacttaacttgaaccataatttaatatgtgtgagacttctctttctcgggagcgccagaactcctcacactgctagaaacatggacgcctagagtgcatgaggatttaagttcatggagcgggtactggcaatgcgaggttatcgaaaagctttgccatgacgcgtctcatgtgttgggatgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttgtggtggcttgctgagtacggttggtactcacccttgctattcatatatcttttagaagagtgtttaagaaaagcccttgtcggtacgcttgcgtatccaataacatgatcggagtgcggtcttgttctaggtctcgttccccagtcgactgcctgtggcatgttaaccgggcccttatattattttgtgttccgctgttgttctctgatagttgttggcctacctggccctaatgtaagtatttaactcttttagcctgaattcattcgtgatatgttgtgattcaactatgtatgtgtgtaccaactattgatccagggattggtacggataaacacagatgatttccgatttccaaaatcgggggtccacatcaagtcttctggagaattcaagtatggttctagtaactcttccctctttatccgataatgaaatattcttctttatataatttggtcctttactatatttgcataattatttgagtaccaactttggtttacacttatctcgtattaattatgcggctagcttaccagagatatgcaatggtattggcttagtgttcatttatttgattgctctatgttatctgcagaggtgtagaatagtacttagtaatgtaagcatggtgcttagattactaagtatcattaaatggttctatatgccacggatctgtagaggcaggacgctgatgttgacaactcagtacgagtattcgtcgacgtgtgtatatagggctaagcaagattcatggtgcgggtattcctctgtatctttaattggttgaatagccataatggattgtcgtaaggaactcggcaatcaggggtggtttcttgatataccaggtgggcatagttagggggtattagccacatagttgtaccatagaaagtgtatactaaaatgactatatatattagaagtacataaatggtgcttttattacttcttctctgcttaacctagacttatattttagtaagagtattttaaactgaaccttctatgtgtcaaatctatccttatcctcaactgattaacccatgcataagactttgatttacataagtaagataagaatttatagcatagtactctcttaccatatcttcccatggaattaaataaatacgataccttggaaatacttacgggtgaaatgctatagcggtatatcgtgcgcttgcggatttatttctgtaaccataagaataccgtctaatatttctgccaccattgttggggatcatattcctagtaatgtcgttaagaaatatcaacaggtataaatatcaacaggtatatcggtgaacgtcgcctccatccatcaatcgagttatccaccacctctcatcgaaagattgggaacaaaccttcacgggttcatatcagtgagcttccccaaggtagctgatttgttcttgttatcttaatttattttgtttttgtttcatttttttggtatattcttagtaaacatagagactaggttaatttcatttttttatgaaatattcctgttttttttaaaaaaacaaccttgtcatgttatcttataaaaaaggcaaccttatgttatcaatatgatagttcctcaaaactagaatgtgaaagatggacaagtccttaaagtggcctcattagcagaaaacgtgtagtagatattatcttcttataaagttgatgcccactaacttctaaaactcaacatgcaaatgtgtcacatatcatccactatcaattattatccagagtattttaaatcacatgtgtaaaatcaaaggtgtttttgattattattctgtgatgaacaattggcataggagattattggttttgttatttggagtttatttacgaagtggttttggagatgattggatttacaggtgaatcacaggtttatcattttatgtggaccggtcagaccgggccggtgcggtcggtcagaccggcgtgtaatgcgtggtcagactggcgtgtaatgcgcggtcagaccggcgcagcccgcggtctaaccggtcgacgctgtgtcggtttcggtttcgggttgtttgtttggatatccgtgattatttcatgattatgacttctagatggatactatacatatgtaatactattgtttgctactaatgagtgaagttggagatagcttggtctcggaatatggtttctttgtttatttcatgtgcaggtgactcgatgcctcgggagagtatttgcggtgatggaccgggagtcggcttggggataagacgacgtccgtggtggtcagagatcatgcgggatacttaggctagagttgatgcacgtggttgatggagattcgatatggcatacgatggaggtattgtgtgcgtatgggatgcggagtcgaatttggaaggagtccaaatttgatatgattggttatgtaaagtttgtttcttgtactagagggtttcctaaggtgtttaggactcctagtatgagtttggttcgtggctttagggcgcctacctcgggtataaatagagggggagcatgaggcttccagttatcgctttttagagaatttgagttgagttttgagttagggtttagagtttagtcgaaatttttgtaagtagtgttgttggtgcactatgtaaacgcagagagaagtaataaagtcgtcatccactttaagagttcttcgatttgtttttaccgggtttcgacggtctaaccggcgatattatgatggtcagactggcggcaagcagcggtcagaccggcggcatacgagcggtccgaccggcggcggcgacaggtgcggcaggcatctcagcgattcaaccgatcgacctacatcggtcagactgacgttcatcaggcggtcagactgcgatccgtcgaattagagggtaacttttatttccgctaaaagttttcgatttttgggtataccaaccattcacccccctagttggcttagtttttgttatttgatcctacaagtggtatcagagtcttgttttcttctttggatttttatcggtctagagtttttgccatggctactcctgctaggttttcaactaagaatcatgttttcgatggaacggatttttctcattggtgtagtaggatgcaatcttacattatggctgaagattatgatatttggagaaaagtttctcatccttatgtgattcctgaagctattaatactgctgctgaaaaaactgcttttgaacaaaattgcaaagctcgcaacattcttttgagtggtatttctcgttcggattatgatcgtgttacgcactttcgaactgctcatgaaatttggaatgttttgagtaactttcatcaaggaacaaataacattaaagaacttcgtcgtgatattttcaaaaaggagtacattaaatttgagatgaaacctggagaagctttgaatgactatctttctaggtttattaaaattttgagttatcttagatctgttgatttttcttatgatactaattatccacaatctgagatttctcgtcactttttgaatggtcttgacatgtctatttgggagatgaaagttacatctattcaaaagtctgttaacatgtctactttgactttggattcactttatagaaaattgaaaacacatgagatgaatgttctttctaggaaagttgattctaagtcaagcgctttggtttcttcttcttcttattctttggatgttgatgctttttcatctaagccttcttttcttgctgtttttaatgtcacatccgatgatcaactcgaacaaatcgaggaggaggatttggcttttgttgctaatagaattctcgagctacgaataatgccaggaacaggaaaagaggtggtccaaatcgttgctttgaatgtggttcaattgatcatcttcatttgcattgtcctaagcttgggagaggcaaaagagaagacaaagatggtgagaagaccaacaacaataagccgaagggttcatcccaagggaggaaactagagaatctcaggaaggcttttcaacaagtaagcgccgccttcgagccacaaaatgatgtagatggtgaaagtggagatgatgataagggaaagaacatctccgatgtttgcttcgtggcgcgtggtgaatctgacacagagtatgaagataatgaggtaagtgcttttgaggaagctattaatgttttgagtgaaaaaaataagaagtgtgagaagatgtatagaaaacaggaatttatcattgaatctcttaaatatgaaattgctagattaaaatctcttattcctaatgatgatgattgctcaaattgtgaggttttaatgaatgagatttcaaaaattagagatgttaatattgcacatgatttgaaaaatagatcttctcttgcttgtagttttgctttgcacacacgcactttggatgagttgtttttaactaaaaagttgttgcaaaaatatcaaattgcttttcatgctaatttgaatttaacatgatttctgctaaaaagttaaaacaacctcatgatgttttggattgctcaacatgtaatttgaataagttgaaattgaaagatgctttaggtcgtgttgagttcatggaagatgttgtgaaaaataatgaagtgctttcttgccctaaatgtcgtaaaagcaaaggtgtcatggtagattatgcaaattgtgctaatttggaaaaagaggtttcttatttgaaaaattctttgttaagattttctgatggtaaaaagaacctcaatatgattttggatcaatcaaaggttagcacacataaccgtggtttaggttttaatccttatactcataattctagacaccctcctgttgtgttaggtgttggtgctagaagtggtgagattttggttaaacctgatactaacaaaactgtgtttaaatctgctggtatcatgtctaccttgaatgcatcttcttcaaaatccaatgttgtgcatgcaaattctcctgttgttgcttgtgttgctaaatcttctaatgtttccaatgtgtctaatcatcgtgaaaaatatacttgttctttttgtggcaaagatgtacatattgttggtttttgttttagattagctcataaacagaaaaaggagagagagattgcttttgcaaaatcaaagtggcaaaaatctggttttccctcgaggaaaccggttagaccgcagtgggtcccgcggtcagaccggcccccggtcagaccggccactgtacttcggtcggaccggcctcgaaggaatttttctgaaaatcctaaaattgattttgcacgtggatatatgcctattggatcttctggtcgtgtgtctcagtactggattcctaaatttttattatcatctaaccccagtactgaggcttcgacttctgcttgtgtgtaggctttggtggcaaggaaggagaacgtgtggattgtggattccggttgttcgcagcacatgaccggtgataaaaattggttctcctcactcaaaaaggcatccaagactgaatcgattatctttggtgatgcttctacaagtgccgttctcgctacaggtttggttaaggtaaatgaaaaatttgaattaaagaatgtagctttggttgaggacttaaagtacaatttgctttgagtttcacaaattgttgatgaaaattttgaggttcactttaagaaaactggaagtaaagtttttgattcttgtggtgattctgtgttgaatatttctcgttatggaagagtgtttaaagctgattttgaaaatcctgtttcacctgtcataacatgtttggttgctaactttgataaagatatgatgttttggcatcgtagacttggacattttggtcttgatcatctccctatgtagagtcgtctggatcttgttcgtggtttgcgtaaacttatcaaagatcttgatttggtttatacgccgtgtcatcatgctaagatggttgcttattcacatgctcctattgtttctatgatgacggatgcacctggacagctattacacatggacactgttggtccagctagagtgcaatctgttggaggaaagtggtatgtgttggttattgttgaccatttttctcgatattcttgggttttctttatggcaactaaagacgaagcttttcaacactttcgtggtttgtttcttcgattggatcttgaatttcctagttctttgaaaagaattcgaagtgataatggtggagagtttaaaaatgctttttttgaacaattttccaatgaaagaggtcttgaacatgaattttcttctcctcgtgttcctcaacaaaacggtgttgttgaatggaaaaatcgtgttttggttgagaaggctagaaccgatgtggatgaatataaaactcctagaaaattttaggctagggctattaacactgcttgttatatttcaaattgggttttcttgagatccaaacttggaaaaactttttatgaacttcgatttggacatcaacccaaagtttcacatttgcgtgtttttggttgcaagtccattgtcttgaaatctggaaatttggataagtttgaggcacgttctaccgatggattgtttcttggttaccccgcacacactcgtggctatcgtgtacttattttggagactaacaaaatcgcggagacttgcaaagtttcttttgatgaggcttgtccaggtactagacccgatattgcaggtacactgtcacaggttcagggggaggatggtcgtatttttgaagacgagagcaatgacaacgacgacgacgaggtcagctcggccggtcagaccgccggcacacctccggtcagaccggcacaggaggtacggtcagaccggccagggtcgtcggctgaggattctgttgatgctgttcgagatggtcctccgtagattacaacttcgaccagtactgacacagaacgtggatcaactttagaagtcgcttctcctttgcacattcaacgacgacatccactggaacaaataattggtaatataggtgagcggactacaaggtctaaggtaacgactcatgatgtttgtgcaaattctgcatttgttgcttcttttgaacccaaagatgtgtcacatgcattaactgatgaatcgtggattaacaccatgcatgaagaacttgaaaattttgaaagaaacaaagtttggactttagttgaaccaccttctggacataatattattggaaccaagtgggttttcaaaaataaataaaatgaggatggtttgattgtgagaaataaagctagacttgttgctcaaggttttacccaagtggagggtttggattttaatgaaacttttgctcctgttgctagaattgaggcaattagacttttgttagcttttgctgcttcaaaaggttttaaattgtatcaaatggatgtgaaaagtgcttttctaaatggttttatacaggtggaagtttatgtcaaacaaccaccatgttttgaaaatcctgattttcccaaccatgttattaaattgtctaaagctttgtatggtttgaaacaagctcctagagcatggtatgataggcttaaaaactttttacttgtgaaaggttttacaatgggaaaggttgacaaaacgccttttgttcttaagcatggtgataatcaactttttgttcagatttatgtgaatgatatcatctttggttgttcgactcatgctttggttgtagattttgctgagactatgcacagggaatttgagatgagcatgatgggtgagttatcgtactttttgggattgcaaattaagcaaacacctcaaggtacttttgtgcatcaaacgaagtatacgaaggatcttttgagacggttcaagaaggagaactgcaagccaatttcaacaccaattggttctacagctgtgttggatcctgatgaagatggcgaagctattgatcaaaaggaatatagaagtatgattggatctttgttgtatctaactgcttctaggccagacatacaatttgctgtgtgtttgtgtgcacgctttcaagcttctcctcgtgcttcacatcgtcaagcggtcaagtgaataatgaggtatttgaatcatacacttgagtttggaatttggtattcaacttcatcttctatatgcttaagtggatattccgatgctgattttggaggttgtagaattgataggaaaagtactagtggaacatgtcattttcttggtacaccattgattgcatggtcttctaggaaacaatctagtgttgctcaatcaactgctaaatctgaatatgttactgctgcaagttgttgttcacagattctttggcttttatttactttgaaagattatggtcttatttttgagaaagtacctctcttttgtgataatactaatgctatcaatgttgctaagaatcgtgttcaacactcacgcacaaagcacattgatattcgttttcactttttgagggatcatgttgagaagggagatgtggaattgcagtttttggacacaaagttgcaacttgctgatattttcactaaacctttggattctaatcgctttgcttttctttgtggtgaattgggcataattcatccttttggcatggtttgagggggagtttgtacttcatggttttatcaagcaataatatgacaatgagaaaaattgagaaaagagagctttgtttatgcatatggtattttcttgtgcatgctagcaatactttgaaggtttatttgtctctagcatagcttgtatgtattctagtcttttcatgagatttagattttgcttttaagggagatgatacatgacatttaaattctatacttgaattaagcaaatatacaatgttgatgctaacatatggtttgatttctaaatgctttatatatatgctttattgaattgttattcctcaaatagctttaattggtcattgtgaaaagagaataaaaatatgaaaaaaaatgaataccgaatcattggaaacagtcttgaggacaagaacgtattcgatatgagcaaaataatgggtgccgaatccctggaaacagtcttgacgacagggacgtatccggaataaaaaagaaaaaatatgagcaaaaaggctcaagaaaagaaaaagttaaaaaattctcttggttattttgtgctaaaggttatttgagaaagagtgataaatgcaataggtatatgtgtttagtgtttattcttcaacctatgtgcttgttaagatgttgcattataaatcatatgaaatcatgaattttgattgttgattaaagcttaattataaaatctttggttcatggttatactttaatgcatgcttgttatattacacatgacatgatatgctatatgtgttagggtcatggatatcacatacctaatagtagttgactaaatctcggcaggatccaccacatatcatgtcttatacggaaactgacttcagatatggagggagttctggataaggaaagacaaccagagttctacatggaaacgacaaggactactcagattgtatccatattggtttccctagttctactggacaagcggacacctgtgggtataaataaaagcccccctaggaagacacgaggacacccatgatatgagacgatcaacacgatcaacaaccaccatgggggaccacgagacaatcaactcccaacacaatcaacatagaagcctagatacgccaagacaaaccgccgaatatcgacatcagagatacgcctggatcgaccctatccggtaccttcagaggccggccgtagggatctagcactgtctctgattccgtcgggcgcgagctcgaggaggaaggctaccctgttgtcaactatgagttagaccttcagaccggcatgtcgacaacagttagataggctaccccacatattgtactggtatgattatggtgaataaaaagcaacatcggctccggccaacaggatgtagggctattacatgatagctcaggggcccgaacctttataaaaatcctcgtctccatctcttttacctcagtctcgcgtataccctagcaccgacgatccccatactgtctaaataccgtagtcgcgacatcaaacgtcaacagtggcgcgccaggtagggggattttggtgcttcagaatttcaacgagatgggttcaaaagacggattctccgacaacaagctactcgacgactttgctgtggggagatccaacccgaccagagtatgtctcccgatatgatcggaaccatcgtcgtcaacaactcgatctctcgagatcgaccaaacttcaagacgttgccgccgcggagaacagtgacttgatattatcaactaggaggtctccgatctccatctcttcagaagcgacatcataaactgatttttggtaacctcggtaatgccgctgcctgctcagaacaccggccatcgaggaaccaaaatcaacatctcgatctattcactagattcttttgggactcggatcgttctcacaccccgattaggatccaaattttggacccctgacgcatactgagaacatccatcccgacatcatgtgttcccgggattattgatcacggatgtctaccaagataaatcaacggccgcccgtgatcaggtatttagtagattgattttttaaaaatggtctactaatttcgtagatacatccagcgtgtatctacaaaggtacgtaatattttatatgcaatttatcgtacctattcagatgatacggcattgtcagatctataatttattatgtttacctagagcttgttttttatacaatatcaattgcgcggatgtttccgatgttaaaccaactacggtctaacgctgggggctcgctctattttcttctgtataaatcatgcttgtttacggtttacataatgcctaatatttacatctgctcgttatatcctaataatactagaacatccatgcagttttttgagtacatactcgacattatttgctatatatcttgccttctagaaaatatttttcaggaacaattgagcactcgagtaggtcatggtcgagtacaccgcattatcgagaacgatctcgacaaatgcagagtcgtcacgcccaacctaccaaagaagaccgacgacctatctcatagcaccagccatcgctggactactcgagaaaaggttgttaacggataactcctcacgaacaccgtcggcttgatcacccaacatgattgcaagaggacatccggatatgctataagttgggtatgtgagtcatgctggccacatgatatgcacatgtaataaaccaactttagcgcccccataagtgattaagagactcctactcctggttctcgaaccaggaagacgtagtgatctctctcgcctcactttaagtggtcgagttacgactactgcctggtcctcgaccagcgatgtagtgtttctcccacaacttccactttaagtggtcgagttatgactactgcctagtcctcgaccagcgatgtagcgtttctccggctacttccacttcaagtggtcgagttacgactactgcatggtcctcgactagtgatgtagcgtttctcccactatttccacttaaagtggtcgagttacgactactgcctggtcctcgaccagcgatgtagcgtttctcccactacttccactttaagtggtcaagttacgactactgcctggtcctcgaccagcgatgtagcgattctcccattacccctgcttcaacaaagttgatgtcaggtacacaagatcgccaagtgttttacccaaagatcccttaccacggtgacacctagcgttgaaacctatcctactgtccctttacgccgtcttgacaaggcctccgaggaacctgagggaactttggctgggaacgcccagagccgataaggccttgtcggatccttcagagacgaaagaccatgtaagatctggtcgtgtaagagttctcgccatgcgtattaactaagccgtgtaatcggaaatagattttccaacttcacggctgggggctaggatcagtgcttgttcaaccgaggcaggtcaaaggtccaagagctttatcatccgagaacgattctccgacgacaaggttgggggctagggagagtgtatgactctacaaactgactgatcaaagtcggtaggagagaagacgctcatacacaaaacattggtcagtaaattcaatttgtttttagttttccatacatattataacatgtcaccatttgagcgttcgctcgggggctatttctatttgatattcttttctgagtattgatttcaggaaaattctattcgacattgacgaagactccatgtctctatggttctacaccaagattgactaaggcgaatacgacaaatgttgacaaagctccgtcgcagactctacgccttctcgatcacttgagaacggttgctggatctcgacaaggaatacggaatgaagagatggtgtacccgccgagataaaatttcttgacttcaatccaaattctcgattacagcaagacgtgagacttagtcgtacactctatagtttctcggtagacatcagagattaacttagacaaaccttttcggtgcccgcacgaggctgacaaaggaagtccaacgttatctctaaactcaccgagaacggtcacatgagctcgataacagttactccaatgtctgcgcgcggttgagaatatgaattcgttcatttgcatcaaagtcgggggctatggtcagggttatggataccacatacctaatagtagttgactaaatctcggcaggatccaccacataccatgtcttatacggaaactgtcttcagatatggagggagttctggataaggaaagacaaccagagttctacatggaaacgacaaggactactcggattatatccatattggtttccctagttctacttggacaaggggacacctgtgggtataaatacaagcccccctaggaggacagggggacacccatgatatgaaacgatcaacacgatcaacaaccaccatgggagaccacgagataatcaactcccaacacaatcaacatagaagcctacatacgccaagacaagccgccggatatcgacatcagagatacgcctggatcgaccctatccggtaccttcagaggccggccgtagggatctagcactgtctctgattccgtcgggcgcgagctctaggaggaaggctaccctgttgtcaactacgagtcagaccttcagaccgccatgtcgacaacagttagataggctaccccacatattgtactggtgtgattatggtgaataaaaagcaacatcggttccggccaacaggatgtagggctattacctaatagctcgggggcccgaacctttataaaaatcatcatctccatctcttttacctcagtctcgcgtataccctagcaccgacgatccccatactgttcaaatatcgtagtcgcgacatcaaacgtcgacaatatgtatgctaagctcttgaacattaatgaacataattcctatgcttgatgaaatcattgtcaaaagggggagaagtaatgtgaaattttttggatttttgggagaagcaaggtgaatttctgaaagcatgtttttggttcaattgggaatttctttgtttaaaaagggggagaagttttcttttggctttttgagcacgatgtgtacatttgtacgaagtgtgctttttaccacttttgtttttatttttccaaacaccaaaacattttttatgagtttgctaatgtgttcatcaagggggagattgtaaaatcaaaggtgttttttattattattctatgatgaacaattggcattggagattattgattttgttacttggaatttatttacgaagtggttttggagatgattggatttacgagtcaatcgcatgtttatcattttatgtggaccggttagaccgggccagtgcggtcggtcagaccggcgtgtaatgcgcggtcagaccggcgctgcccgtggtctgatcggccgacgctgtgtcggtttcgatttcgggttgtttgtttagatatccgtgattatttcatgattatgacttctagatggatactatacgtatgtaatactattgtttgctactaatgagtcaagttggagatagcttggtcttggaatatggtttctttgtttatttcatgtgtaggtaacttgatgcctcgggagagtatttgcagtgatggaccgggagtcggcttggggataagacgacgtccgtggtggtcagagatcatgcgggatacataggttagagttgatgcacgtggttgatggagattccatatggcatacgatggaggtattgtgtgcgtatgggatgcgtagtcgaatttggaaggagtccaaatttggtatgattggttatgtaaagtttgtttcttgtactagagggtctcctaagttgtttaggactcctagtatgagtttggttcgtggctttaggctgcctacctcgggtataaatagagggggagcgtgaggcttccaggtatcgctttttagagcaattgagttgagttttaagttagggtttagagtttagtcgaaattttttgtaaggagtgatgttggtgcactttgtaaacacagatagaagtaataaagttttcatccactttaagagttattcgatttgtgtttaccgggtgtcggcggtctaaccggcgatataccggcggtcagactggcggcaagcggcggtcacaccggcggcatacgggcggtccgatcggcggcggcgacaggcgcgacaggcatctcggcggttcaaccgatcgacctacaccagtcagaccgatgttcatcaggtgatcagaccggcgcatatacttcggttaaaccgcgatacgtcgaattcgagggtaacttttatttccgctaaaagttttctttttttaggtataccaaccattcaccctacccctctggttggcttagtttttgtgattcgatcctacaacatgcaagtttgtcacatcattactcactagcaattattatatggagcattttaaatatcatgtcataccatttacaattttgttatatttctataactcaatatgcaagcaatatcaaatcattatctctacatcatttttacattatttaaacatgcacatctaccatttctataatgtataacatatattcattcacatatcccgtagcaaaacgcggggcatcaactaattggaaagacaagagtagccttcaatgcgggaagtagagatggcattagaatacatagctttaaagaagggcatttttgataatgggaatatatatactgcatcgagtagatcggatagaaatgatatttcaacgcattacatgtcaattgaagtaattaccaaggaagaaagtaggcaattgacaatgaaagaggaatgtatttgtcatcaacctattcttaattatcaaggtctgcctagagggaacactacctagtttgcaatgacagatccagcgtgggagggggaaactattctaaactctcgtggggatgccctttcattgtttgcatatcactcaaatggttgtgaaaaatattgaaaaaaaattgagaagagtattccgggcattacaacgaaagaaacaaattaaaccatagctagttaataatatgtttagtcccccccccccaaaaaaaaaaaaaagtttttccatggatccacacttgctgtctgtactaaagacatgaacctaccaatctacatacgctgcatttgttctattgtcataatatattctacttctaagacatcaattcaaaaggagaaaactgcaagtattacttgtgatttggtttattgttggtatttcttatgccctcacaaaatgtatccaagaaaacacagatttattggtgtagcactttactttagagtattttatggttatccgataaatagaacagagtttgtgaaacacagataaaaggaatctcacacctatctagttatgaagaaatctgagagaactattggagcctaacaagataaagccatgagcaaatctcggtaaagaaaaagaataatatgagtttacgatgctggttattttaggcacaagacataatccaccacgcagagctgttgaataggccctcttgacaatatcagcttcttattagaaagcttatgagatctagtttcagatatttttggtcccacattcaaattcatcctgagctttccaagatctaaaaaaacaagtgcctctttgagtcggagtctgttttggtattagcccttagttatttcggttttctattggctgctttaactctaaccctagctctatttattgcctggaataagatacgttttgtttgaaataaattgaatgaataagacagaaaagaaaaaatctctcttttggattcttggcattctacgcatcaattaccaattttttttcttggtcattgagattcgtgcataatttagtattgttttgggccttgaattttgtaattgagtcttttttttggtaggcccatgttatggtcgacctcctacccctgtgaactcataaatagataaccgctgccacctcaagtttagattttctttagattattctgtctaacaataatttataacgtgattatttgtataacattaatttatctgtaatttatttagattaccttcctccttgttcacatgaattttaattgcttgcaagatcaataatcatcgaggttatgtcgattgcaagagagcttggtcgataatgatgagatgtccaggtgtagcgcttgtgtggttgcgatcgactgatccgaagctgcaaaatgtcaacatcttcacatcgacaaatcaaacctaagatctagcaccaatttgcataaagggacccacaataaaattctcatttttagttccttgtagataaaaaattcgaacatgatactccatccgtcccattttaagtgtagccataagtttccgtgtccaacgttcagccatccgtcttatttgaaaaatttatgaaaaaattttaaaaattaagtcgcgcataaagtattattcatattttataatctaattacaataaaaatattaattataaaaaaataaataagacatacggtcaaactttaggcactaaaacccataactgcgtttattatgggatggagtgagtattttctaaaattccgcgcagacatccatagtttgtatcccctataggaataagttcactttaagtccctctatttgtcggtcagtctgactttcgtcccttgaccgtaaaaccgggtacgaaccgtcccccaacttacgaaaaacgggcaaacaaagtccctcggcagtatggagggcggttttggctgacgtggcgtctatgtggcgcctacgtggctcctttgactaggtcttcgtcccacgtggcattgacgtggcgattacgtggcaattttatctcgaaaaaataataaaaatagtgggacccatatgtcagctacacaaaaaaaattaaaaaaaggtggggccatgtggtcccatatgtcagcctccttctctctatcccccctctctctcccccctacattgccaggagagaagggcgagcggcggcgctgagggggcaacgggtggagcggcgacggagtggagcagcgacggagcgaagcggcgcgatggccggcgggagaaagcggagcgacgatgggcgacgctgcgacggagcaaagcagcgcggcggccagcggtgaacggagcgacggcgggcggtgagcggcgggagaaagcagagcggcagtggggcgaaatggagcggcggtgggcggtgggcggagcgacgccgacgccg

SEQ ID NO: 27682 - DNA, 14539 bp, Oryza sativa
cccgccgcccatcgccagccgcccaccgtcgctccgtccaccgccggccaccacgctgcttcgctccgtcgccccctcggcgccgccactcgccattctctcctggctgtgtgagagaggggggatagagaggagagggaggctgacatgtgggaccacatgggccccaccttttttaattatattttgtgtagctgacatatgggtcccactatttttattattttttcgggataaaattgccacgtaaacgccacgtcattgccacgtggaacgaagatctagtcaaaggagtcacgtaggtgccacgtagacgccacgtcagccaaaaccgccctccatactgccaagggacctcgtttgcccggtttcgtaagttgggggacgggtcgtacccggttttgtggtcaagggacgaaaatcggactgaccgacaaatagagggacctaaagtgaacttattcatcccctatatggctggaaaaaagctcgtggcccattatagctcgctcaacttgtggctgacttggctcattttgatttcctaacaagccaagctgttgtttcagctcgttagcgataaggatccagctcaaactggcttgcatgagccgcttgtgatgtaaacgagctggtagaaaagagaagctaacagccatataccaacttggtggcccagtaggaggctggtgcatggcctaatatccaaatggcccaaacaaaacattctaaaaccctagcccccaatttcccatcttcattatttcctcagttgcatattataagactttctagcattgctcatattcatatatatgttaatgaatctagatacaaatatatgtctagattcattaacatcttcataaatatgggcaatgttagaaagtcttataatataaaacggaggaagtagtagtgttctgcaatatctagttccaggcttccagccgccgccctcctgcattctgccaccaccagatcccgctcacatcatgtgccagatgcgagccaaaatccaagtacgccaccatagccgctcgctctcgctgctgcaggcagcgactgacttcgtccatcgaaccgtcctcgctgccatggcatcgtcggtcgccacgctcgcccgcacgatcttgccggtcaagaacaccactgctggctacggcgctgtgggctgcagcctcgtcggctgtcgcgctcacccgcatgggctcgtcgctttgtgtgcgccgctgtgggctgctcttgcccctgccgcttgatctcccgctatccctacgccttgtcgcatactcgcttgcgctctcgctcttctcattagacatcttgccctttgtagcttgcaaggtaaaacaagctggctcgagctacaaacgagttaggacgagctgcgttttctgctcgtttagataacaagccaagcttagcctactcattatctaaatgagctaggacgagctgagcaaagccagctcggcatctacccctaacccgctatattcgactacaaaatacgtaattgtacgtaccacccccccccccccccttcatggcaagcagcaacgctctcccctcgccccgcctccccatgagcaacagcagcagtgatccacatgacgactaaaaacaccttcctgatctctcccaccgcccccaaaaatactgtgggcttctggatctaagcaatggtggtgagaagacagcacctcggcctccagtgagcagcggcggcggtagccttggcctccgatgggtggtggtggccttggtctccggtgagatgaggcgatggaggcttccatgtattgatttgtgttttagtttttgtgatgaatgttatgtgtgtaatattctaggatgattcttacttattgttgtttgatgtgtgagattttttttttcattttttgtatgtgttcttggctctaagcatcagctctgatttgagccggtggatcaaactgactttttttttctcattgctagctccttcgattctccacattagtgccgctaatgggtgtcagttggaaaatccagcacttatgtgggtttctaaccaacacccatgttcacattgcaattcaaatgataggacataagctaagctcaagcctgctgggacactggaatttaatttgttttcttgtttcataattaagaaaggaaaaataatttctatgattcatgcagaaacttaagcgtctcatctctgcttgttggctttgtcagccaaaaccaatttaaatgttactcgtagaacttaatttagttgattttgggtattatcatggtatattttccagcctggattgaaccatgaacaatatgtgtgtgtgtgtatatatagacacacacacattttgcctatcaattatttttggttttcattcatatgttaacattttgcccatgaataatatagcctatccatatgaaattttatgcgcgttataaagggggttaattaatacgagtttgtggagcttaattaaaatgcatgcaactaattatgggaattaattgcaggctttcagcctacgtacgtttcgaataaaaagaaaagagagagcagaagatgcttgacgtgcccaccggcaatcatcagcacccctgctgaatatatggcctgcagtaaacaagaagagaggctgaagctgtgcgatgacgtagaattgctgttttgcatggtccacctgaactcgatggtggactcccaaataagggtatttgtaatgctggttcctcgaggagtactatgcatgcaacagcttttttttttttgtctcttcttttattttaacagaagggaaacagctcctccccttttcattaaggaaaagtatcagttcagctaaaaaaaacagaaaaaaaatcatccaacacacatttgtgtaacccccaaaacaacttagctgaaacaagttcacacaagagggctattgaacctgcgatgcttaaaaaaaaactagaatagttaaaggccctgtttagatcccatgataaaattttttaccatgtcacatcgaatatttggatacatatatggagtatcaaatataaacgaaaaaataactaattatacagattgcgtgtaaattgcgagatgaatcttttaagtctaattgctccataatctgacaatgtggttctatagtaaacaaattctaataatggattaattaggcttaataaattcgtctcgcagtttacagacggattctgtaatttgttttgttattagtctatgtttaatactttaaatgtatgtccgtagtgacacaccgaaactttacaccctaaatctaaacacagcctaaaccgaacagaatgtaaatgctctctgccgccgttttctttcttgacacttcaacttctttatatctccagctggaaaaggcggcaaaacttgcgacttgttttagcaagcgatcaccccattgcagctcgtttgttcttccctccgaattccgatctctgcaaaatggaccacgatgaaacacggtgacaaatctgatatatcagatcaatgggatgagaaatccattttctctcaaaacatgcattatttatggctttccaaatatatacaccaaagtactgctggaataccaaccgcaatcagggtttgtcctttttctcaaacttttggaaccagtcacccaacaaatgatgagtgttaaggattttctcaaattaaagccaaatgaactagccaccacattccaaataaatgtagtcaaaggacaagaaatatgatattcttagtcaacagccaggtaaaactctagctttaacagggattttgaaattccataatttcctaaaggggaagtttagacattgtaattgtgaattattatataaagattttacagagaaacattttctcttatccaagtcccacattaatgcaccttctcattgttaaggacaacattttcacaatccctctgtagcttaccccaggcaacagcctttccttctatcaggctttcctaaagggtaattttaccatccttgataaggtacctggaggtgccatattttctagtgtaaaatttaatgcctctagctactaatacctcaaggtactaaaaattttagtgtaaaatttaggtatcttaaggtattttctcaagaactgtaatttttttctctcctaaactgtagcctatccagcccgcccttaaaaactttatctactatcctaatttttgacaaagttatattgtacaattctagatacatctcaacaagtgatgaattctctagccacttttcctgccagaaaagggtatcttcaccattaccaatctttttggaacagaatttcataaaatcgtctttaatgctcatgaacccattccagaaaaaagaaacaccaggtttgaaaacacactgtttaagggtgtttttttttaagtatttagccttcagaagactttgcaacaaaccctcttcattcatcattttccatagccatttccccagcctccctgctttttgggtctgtaaactttctaaaattgaattagacgatatttcttaattctctgatcctcctgccagaagaatctataccttaaataatccatcttatttttcactccctgtggcaccaggataaaaagacatcatgaacatggaatgctacttaagctagagattattttagtcagtctaccaatgattgccagcatcttcccctgccagcaccctagtttctaattctattccatcttgttttcagcaggttttcaatccttgttatatattcttttgttatctattagtataccccaagtatttcataggtaatatgcccagtttacatgttagcatgttgctataaatttcacttttctcactagcgcttcccaaaaaaaacacactcttgttaaagttaatctttaaactagacatttgctcaaacatacacagattgaacaccgcggtgaacgagcgaggttgagcactatcctggcttccaagatcatgcaccatgtgatttcctaggtcaactaccgcccgccatgtctcgctcgattgatcttgatgggcacgcacagcataagatcgagcaccaggggagcgagacatgaatggcgtgcctacatgatgtagatccaccttccatgttcgaggagtcaaccgccaacccgccagtggtggtcgagcggaggctcccatcaagccaagactagtggtagttaacactaggagagggcagcggtgctaagagatttgagttgaggagaggtgagggcagtggcaacccttcccctttcctgctgtgttatcagtagaacattcattggatagcatcctatttcttttagataatggattttcattaattcggcctctatatccacgagagatatacacagccaaaaggatacaagagcacttagggtgtgtttggttgagctgtagcttttaaaaaagtagttgtgggctgtgacttttcgaaaagcagctgtggaatatgggttgtggcttttggaaaagctcgtttggttcaacagctgtggcctttgaaataactagtccggcttacaagcgggccccacatgtcatacacacattgcaaaagagggaaaaaggaggggaaaacagaggaaaaaaagagaagaggcagagcgcggtggcggagtcgggcacgcagcgtcggcggggaggaggagcgcgcatcagcggaggaggtcttggcggcggcggcggggaggcctcagcgcgcgtcgcgtgtgagtggttgcgagaaggggatggggaaaaacaaatcgaactgttttctcataaccagtggcaggtgggtaatttttttgctcaaaagccattgaaagcatgggtaggaggagctttcaatttgtactagagcaaaaacaaaagcaggttcaaaagcccaaccaaaggcacccttagactcacaccacatcaaagaggagaacacacaaaaacctacaaccttggtatatccctcctccactgaaatgaccaaaatcgacgagtgcagattgtctagtcgccaccgccctagtggattgtcactgcaaaccttcgctagtgccagctttatccacttcaagtgagatgacgccacttgccgtcagtaagcccaccttcctctatcgtcgtccagacagaacaagacgaccagacacgagccaaaaggatccgcttccgcttcagcggattacaaggcctacgccgcccataaggccgcctccaacgttggaatcctcctctgtctctcagacacccagcccactgtcacccctagggcaccacctctaccagagtcctctgccgcctccactgaggatatatatcttcttcctcccggactccgaggcctctggtgcccctagagccaccgccaccaacgggatccgactcctcctcgccgagatccttgcaccggcacttagaccgccgccgtcccgggccaccgctgcccctagggtcgttgctgcctatggaacacctccgtcggatccgccttctccttgccgaggactgtctgttgacgcttaggtcccatcactgtcctccgccgtagcatcctatggatagttggttagtgtatggtcattgcaacttgcaaggcaataggccctgggatcgattcttgcccctctctgaattatatttatatattcttttaacttttcaactccatttttactctaactccattgaatcttctgtccatatttaattcaaccccattggatcatcattcttctttcttccaatccattcttaatttcctaattttcttttaacttcattgaatcttcattattttttttagttcttgccctttcttaatttctattttcttttgatttttcaactccattggatcttcttaatttaatgttttattttaactccattgaatcttatgtcttttttaatttaacttcatttggatttttcattagtttttcttccaatccatcatcaatttccttttgtttaacttcattgaatctatattctttttttaactctagtggatcataaattaaatggtacagtagatgccaccttaccccttggatttttaagttaatggcatattagatgtcacatataataatttcttttataaaatggctgttgtaatatgcaagcctctctccattggatcttcattttaatggtatattagatatcatctatacttttttagaaaaaaaaacttttgcaaatcataagcctctcgctttcatcgtcatgttatgaattattggagaaatcttggcacctctaatacccaaatcctagcttctcctttgagagggtcgtgaaggacaaaagagagagggagaagacaaaagatacatgtaggggcgtacacgtatctattccctctatttcaaattataagtcattttgattttagtcaaaatcaaactactctaaatttgatcaatcttgtggacaaatatagtaatatttacaattccaaattagtttcactaaatctataattaaatatattttcataatatatttgtcttgggttgaaaatattactactttttttctacaaacttagtgaaccttgaaacaatttaattttgaccaaagtcaaaacaatttataatctgaaaagttgtttctaagaaacaataccatctgttcctttttaactgccaaaaaagaccggcatatgtggactcgatccattaaagtcgtgcattcgttgtgagacttggtagcgaagccaagcaaaccgcaaagcactaatcagaagtaccttagacaaagatttgatcactgactcgatgaactctatcatattggtagctacatatggacatggagaccggacctgaaagtgactagcgacaagaaagatcaatcactaagccagcatgcatcaaccaatcatagtagccacataatgtccttagatatttcagattacgataactaattaaacagtgtaacatttcaatgttacaaaacaatcctctagagaagtggcagggatcgaagaagataacaacattatacttgatcctgggagaatttctcatgggattgtcgacaacaagtcctgtatatctggaggcaataccgcaaagtcgttacagcacaaatcatttgatataagagcgcaacagtgtcacacaaacacgctgtccagaaactttattttattgaaacaacccataattatactgtataaaaatagaaaattgtacaattggtaaaaataaagttgctgcgcaatctatggacatacatgttgatactttcatgcctcgtcacaagccatatgattttcctcgtgcctcctatttatggaaaaagacttcaccttttatataacttttctagataatggagaatttcattaatcaataaaatcataccttttatataaaattataaaagtagtccacaataatgatataaaggagcaatatggtgctaaacctttatgttcaatattatagctgctttgaaattttataaatgaaattatagctaaggcaatttccaacaatatagacttcactatttacaacattatataccttacattgtggtctaaactatctaacgtgtgtactaccagtttgatgcaatatgggttttttctaacacaatactctctccgtcctatatgtcgcacactcgttttaaaattcaaatggcataaacttttactagcaattagtgataaaagtatagtattgtaaacttcatatttggatgtactttattgatttcactatggataatcatattttgagagcaattggcagttaaagtttaatttttgagaccgtgccaacacttataaaaaacaaagtttctatacgaggacgtaggatgcaagtgggtcataactagtgcgtctacaaaaatcgagcaatatttttttgcatacggctcattaaagacctgcatgtaaaaatatatttttcatagacagattactagagggactgcatgcaaaaaaaaataagcttatttccccatgcgattctcttaaggagtcacatgcaaaaatagattttcacatgtggacctcttaagtggtccgcatgcgaaaatacccgcctattttcatagatattttctcccctcctctctcctttcccactcaacacttcaaaattttccacttcacctctcccttctcgcactctctctttctatcttcttcatctctctcttcctctcctctcttctctctttctctctctcaccgagtgggagcaggcggcgcggccgacgaggaggcaccgagtccggcgccgcccagcgtgggacggtgggcgcggactccggcggtggaggccctccctcgcccccgatcttgtggccgccgccctcccctaccccgatctgccggcaaaaggaggaggacaagacggcagtgacggtgatgggaggaggacaacggcgacagcgacaggagacaggaggacgatggtggcggctagaggatgaggacgacggcggcggctggaggatgaggatgacgtcggcggtggctggaggatgacgatggcagcggcggcggtgtattttttatttttgaattttttttatgatttttccttttcgcatgcggtcagcttaagcgcgcacgtgcgaaaattagattttcgcatgcggttgcgctggcagcatgtaaaaatcatacattttcttccatgcggcccgcccaatcgcttggccatttgcaaaaaccgattttgtagtagtgcaatcaagttatattttcggatggatggagtatatttgaacttagatgatagtagcttatgcggtgtttgcatacttttgaatagttgaacgtactcttaaaattattatacaccagcatcaaatgtaacatgtaaataattaaagatgagtacataactgcatcacttaaccatctaattctaggccatcttatatatatcatatagaagatttttcatggaaatagtcaacggtttatatcatataggagtataagattttcatggaaatactcaacggttcaatcttcaggaacaggatactttgactttaaggggtaacgatagaaaaacctggatcctctaacttcgagggagtaaaggtaagtgtagtgtatgagtgtagtgctacagtggttcgtagatggcacagcaggcggtataaataaaacaaaataatataaacttattatattacagctcctatttcaatatacttatcatagaaactgaaactataccaaatattttttaaatcctgaataatatagagtggagttgacacttcgctgcctaaaaattaggctataaagacccgccgctcctcggctctactccacacccgaagtagaagccgtaccaaacgggtctaaaactaaacgacatttactaatataagagcaagtacagtagcatactattagccagctataaacatattttagtgagataaaagatgagagagaaaaacaacgggctatagatctatagccagctacagagtacggactccaaaacacaatgcgtgtatgataggtgggaccatatattaatagtatagtaatcagctattgcatgaattgactgttatatcggctatactattaaacttgctcgaaacggggatactcgtagctatcagctccaagcactctcccttcggagtaacgactagtaataatggttgacataaagccataagcacgcatgatcagtgttggatccaatgcaaacaaggagaatgattggtggcttgtagagagaaatgatcaatgctggatcctgtggcaaacagatcacgcatgattaacacaaaactgattattaccacaccatctgcaatgacatccggggttggaccaaagaatgcaactgcagtggcggtggggcccggctcagcagggagacaaatcgatgggtgggtcccacgtgcagcacttgagcaggtgagtgcagtctctgttcattcttctcgtaccctccaattcttctactacaatgcacggattacattggctaaattattcagagccgacactaatcactgagtcatgttgcttgcagctgcctcttgcaggggtgacatggagggtttccagaaaaataatcagtcttaaactgaaaaaggaagatatattactttccaaaggaaccgttggtgcagcaaagaaattgttcttttttcctgaggataatacttttgggttagttatatgtgatatactagtatgcgtctaatgcccgaaaagtatagatcgaaagtgtcaatgtgaagatcaggttggggtaaaatctggtcgattatcgtaaatttttttctctaattaatggtaatgacaaactaaacacaatcgtggtaaaatctggagtatttgattaagctccttatagtgaaacctattcatctgaatttaaatattagatttgacacaggtattcataattataattaattattttttaatggtgggttcaaaaaatatcatggctgcccgtcgttcgataatcttaacaaatctcgtcttagtttttcaaatgtgctcttgggtgtagtggtttgtaaaaaaatcatatggccacccgtggttcgtcaattttaagggttgctttgatatgtaggaaaaatatagaaattttggaggatttcagttctatgaaaaaattctatgaaggcctttggaaagtataaaggattgaatcatatcctatcttttaaaatttttatggaatgggtaatcctatagggattttggagaaaagttagcaacaagtccaacctctcgaaaaaattcctttgagtctatctctctcatccgattattgtgtttttctcgtggtacaatcaaatggtcgttcttgtgtttttatgggttttataatcctctgttttacacatatatttctgtcgtaatcctgtattttttatatccctccgttttctattcctactgctcaaaaaggccctaagaaatatcagtctagttgtacagagatgtttataagagtagtggttcctcaatctctatatacgtttggtccaattttggtccaatcttgtattatataactgggtccacgcacacacaaaccacaatgcatgtgccatggctaatcccccctctctgtcttttcccatttggctcaccatttgggcgtgggttactttgtcgctagtgcattgattttcattgtacatgcttttagttttgacgcaaatgaatacgtcaattcaacatgcgagttaatgagagtttggcccggctcgcgcacggtttataaccacaatcaattttgaattttatattttagaattattaacagtgtttttaagtcgattttgttacttatccttgtcattaaagtagagaggaaatcgtgttcttgttgttgttttcaatttcaatctgattgttactcttacttttccaattttatgatttttgctcatttgtttaactgaagcttgtgcttgggctccattttcttagacgacttaacagtgtgaaaagccaaaataggggtaaaattatgtcctaatgcttgatgtcaaagcaaatgaaaaggcataaagttataggaaagtaaggacaaatctacatagagaacatatttttggcgccattatgtactagtaacaaattgaggggacaaacacaagcttccataagaaatatatatatagctaaagaaaaggagtaacatcgtttgattagaaaacagagacaagaatacaattgcgctgaagtggctacgaaaatatttttattgtaaaactattcttattattatttggacctctgctttgttcgcttatagcctagggattgccaaaaccagtgtaaagtaccgtcagctagaccgaaaatgggagcttcagtggccagtttttcgactaataattgtcagaaagacccattatgatcggaaaaacataactcctattggggacatactgaaaaaatggaagaagtgggtcttgcgcgcatccgctcgatatctcaccacctgtgtctccttcctgctccactcgcctccaccatcacgtctagccagcctcaatcgctattgccacagttagaaaagcatggatccatactaccacggaaagtcctcaatccgcctctcaaccattggcgatccgtgccatagccactagaaaggcctcaatccatgccgccacaggtctcgatctatgctactcattgacaagagatcttgatccgtattgcttccactgtagaagactcgatcaacctcattgttgttaacgagggatttacccctcgtacctctacgatgtccactagtattgattcgctctgtcaccgccgtctccaccaatattaatccacgtaggttacacctgagcttttatggttgccgccttaattctgtatgggcagtgattttgttggaatttattgccaaattctactgcatgttaatctatttttattgttggtttttaatttggagacttttctgaaaatgaatgttttactggtcatgcgatttccaaacgataaggatttatatgtttcctggtaatttcgggagacacgaacaccaaaacaggcccttaaagggaaaaaaaagaaaaaaaaaagggatatttcaagctgtttgtacccctgccgacgagagtagatgaacggttaacttccaacttgcacctttacagaattacaatgcacttgaggttaaagttaagcttcgcctagacgacgcaggttgaggacttaagctttgcatggacgatccaagatactacgtccatctatctatctatcactggtggagaatccatctttactcccggtttataacctcttgtagttccggttttctaaccgggactacgaatacaagactaaaaatagcgatctttagtctcgggtgaaataaccaggagtaaagatctcccggttggtaacaccaaccgggactaaagagaggaatctttaccaaccggtactaaagagaggggcagtcccggatggtccattttctttttattttctcccaaatcgagtaagatgtatataccatatcaaacaccaaatcctcaaatcgagtgtcatgcgtatacccaaatccccaaattaaagtaacatcccaaatcattcacatcacaaatacaaatcctaagttacatcacaaatcttaaaaaaaaatttacacacaaatcaaatgcatcacggatcgattatacatctcagatctatgcaatgagtcacaatttacaaaaagaaattatacatctctcaatcacaaattataaaaaaaaatggagaggagatctggcgcggtgccgcccaccgctgctcgccacgggcagtgcctgccgccccgtgcacggccccgccgcgcgccttgctcactgcctcaccaccggtgtgcgaggccggctccgccaccacccggctgccgtgtgagggcgcctctcttttggaagctgccgcctgagaagtggggaggggaggggaagggatggggcggatacagaggagaggaggtagaggaagagatgggaggag

SEQ ID NO: 27683 - DNA, 11940 bp, Oryza sativa
gtccggacgagctccgaccgcgacatggtctgggaccggctcaagtcaaattcattccagttaagataaaaatttcagaaaaaaagatctggaattcttatgctgttcattacatttttcaatttgttgattgctgatatgaacatgttgcaggttggatgaggatatgatcgaggtgctattcatgaacaattcgacagccgtggcgcctaggatggacaacccgaagaaagtcggcatgccgcaatttaagcaagaggagagagttcttgaccccaagaaggcacagaacattgccatcctgcttcgcgcgctgaatgtcactctcgaggaggttacggatgcgcttttagatggtaagcaataattgtttggcctctgtttactactctctccgtccgaattttaactttttgcttttaatgtttgaccacttgttttatttaaaaaatttgtacaaatataaaaaacgaaatgttatgcttaaaatattttggataataaagtaagtcacaaataaaataaataataattctaaaattttttgaataagatgaatggtcaaacagtacaaataaaatgtcaaaatcccttatatcatgagactgagggagtatgataatttagataggaaaaaaggcatatcttactaagggcaagtaatactagttgttggattctgttgtgatctattctgaactgtcctcagaaaaaaatatcatttgaactgtagggcagcagaccagcagtagtatgagtaaggttactaggagtataaaatactactacatgctaatacagcaatacacacctctcagcgatgcagaattggataaaaactataaacactttgcatctaattccagtaaccatatgttgttcatctataaataggtaatgctgaatgtttgggagctgaacttttggagaccttagtaaagatggctccaaccaaagaggaagaactgaaactgcgagatttcactggggacttatcaaagcttggttcggcagagcgctttcttaaagcagttcttgatataccgttcgccttcaaaagagttgatgttatgctataccgagcaaattttgagaatgaagtgaattatctcaggaaatcttttcaaacgcttgaggtattgcagttcacgttgtatttgtctctatcatgggttactgcattaacatatattgttatatgccatcatttactgcataaaactaatactccataaaacatatatggactagatgcttgaatttggactgcaccatggtaaaaaattctaatatattacactacctgaatttatatatcatcaagctgtgttagttttgaaaaatttatggactctagtgcacatttgagttacacaaacatttaaaatttcaatccgaaattagtatgtggtacactacttaacataatataaagttctttcagagtttttgttcatgatttacgaatctttctaaattctttatatcatggaaaattttggcactaaattttttttttggtgcttattaaatcacatatactgcaataattaaggaacttgacaatatattcatgcactcgacaaaaatggggtctgggaacccttgggtagcaatgtattttcacaagatattaggaagtttggagatttatattgcagatggttggtcaatccttggccaggaacatgcgtgataactattgtgtgttaacaccattttagtttgtttgcttgcttttcaagcgtactaacttttaccatatacagaaattattatgaagtccttaaagtctctcactggctctttttagtagcttaacacttctacttgcttttcaggcagcttgtgatgatttaaaaggcagtagattgttcttaaaactccttgaagcagtgctgaggacagggaacagaatgaatgttggcacaaaccgaggtgaagccaaagctttcaagcttgacaccctcctcaagcttgcagatgtcaaaggcgccgacggtaaaaccacactgctgcactttgtcgtccaagaaatcgtccggtcagaggacgcaaaatctgaaaaggctccagaaaaccacatcacaaacatcgcgaaagttgaacagctgcgtcgacagggcctaaaagttgtgtctgggttgagcaccgagctaggaaatgtcaagagagcagcaaccatggacttcgacgtgctacacggctacgtatctaagcttgaagccggtcttggaaagatcaagtcagtcctccagctcgagaagcaatgcagccaaggggtgaatttcttcgcgacgatgcgtgaatttctcaaggaagctgagcaggagatcgagcaagtgaggcacgacgagaaggcggcactcggaagagtgaaggagatcactgagtacttccacggtaacgcggtgaaggaggaggcacaccctctgaggatattcatggtggttagggacttcctctcaatgctggatcatgtttgcagggaagtcagccagcaggacaggacatttgttgggtcagcgaggtccttccgtatatcagcagcaaatgcattgccgatcctgaacatgcaagggcagaaaggaggaagagagagtagctctgacggagatagcccgtctatgtaggaagaggtcagacttcagaaagggaggcactctgcatttttggaatgaacagaaccacagcaatctttgatagaagaatactttgccaggacagatgaagcacacatgtaattttggtgagaagaattataggtgaaatccttttgtataattatggatggttcgaattcttttttgtacaaaataaataagttcttgctgagtaattttgtttaattttttcgataatggaaatcaacccagcctctacatccaggatgtttcaggccatgctgattaatttttttagggctattctctatcgtttctggtctaaaatcaaattatattttggccgtctgataaaacagtaagaaggaatcggtctatagcttctcaagttgcgcgattaaattgcaccacccactcataagttgctctatggacaacccattttgcttaaaggaaaatactcacaatattgttaaatttgtgtcaaaattatgcatccaacttcacctgatgaattctttgtagaacgaagaaagatgagaagggcaaggaaagtatcacactgatttttctcactgggaataaagagagacgaccagggaaggacaacaaaactcaaaagaaatcaatgataaaaatagctcccagcaaagcctcgtcatcatcatcatcgtaatcttctgccggcctagatcaccctcatttctctctacctttttatctgcaagcgacatctttgcgtagaggtaaagaaaaccgaagcatatatgattactgggcatgcatcgcgtacgtggatcatatctttctgcagaaaagttcagttgagtcgctcattgtctccttctcttagtatattttgctttgcattgacgcatccaaagaaccaaaaattagtcttctatgagacactttgagacacggatgggagcagggaaggaatgaagaatttgttgtggtcagattcggccatatcactgcaggccctatccgggaatcggggcagtctctctcgaggcaggctctactgaaaaagaaaagctggagattttctctgtagcttctgtaagaactttcacagtacgcttaggtgtcattcggcttgagccaaccaggtcaaagattcaactccacgtcggtctctctcgttgccccatgaagaacacggagccaagttgagcctcaggttccttgtcatgattagcatttctcgtgctaaaatagtggcatcgtggatcatgtatgcttctaagggcttgggcctagctagcaaccgacgcctagcaagtgtagtaactgcactgctatctccatgagaatcaaaaccagagtcctacgctccttactatatagctgagtgtgtttaattcacgttaaaattataagtttggttgaaattgaaacgatttaatagaaaagtaggaagtttatacgtgtagaaaagtttagatgtgataaaaaagttaaaagtttgaaaaaaaaatttagaactaaactccgctaaaatcaaaaccttctatcggcgatcgtgggcgacgattatgcacgattgtcggctcaaggaattggtgttgactgatgcgtgaatcatcagctaataacactccttccctcaccctttttctcatttgtttgaattgtttttggaactgctgtttttttatacagtgctccctgattggatgaggtgaactggttgcaagctgttccacggtgatattgctgttcacatcatgcctgcacacaggcacacagcctacagcctagtactaattagggcctatttcaaacctccgtattggagtagcatattagcaacatgtaaaacgtgtggcccgttttattgaagtagtatattagtattatgtaaaatggacggctagtatataattaattaagtattaactattattaaattaaaagatttatttgattttttaagaaaacttctatgtagaaaatatttgcacatatcatattgtttagcagtttggaaagttacattaacaaaaacaaataaggaagtaatagtttggaagttgtagtttggagttgaaatttaggactcggcattggcccctctagcttaaattctcttcacatatgaattgacagaggtgaactcctgtgggccaaaaaaattctaaacaataaccattactccctccgtttcatatcgtaagaacttttggttttacctagatttattcattgatcaatgtatgtgttttatatatgcgtctagattcattaatatcttttacggaatagctatctgtctgtcgcatgatttttatgggctgtatcatgcgttttattggccctctgatatgtttgagattcgtgcactcttttttttttctattttctttgtgggttttttagtatttttagttgtgggccttgggctttcacggttatgttggacctttttttctctttgtgggacccactgtatgttgtgtccatgagagtttatgtagggcccacttttactgttgaaattttgaaatccgcgccggagagagggtttgtctgaattacatcgtatttacactataattacatatgtaattttagtatatttacgatgtaagtctgaaaattatatatgtaattttagtatatttacgatgtaagtctgaaaactacttgagcccatttaaacccacgtgagctttagattgtccacgtggcccggttgttggtttggattttggttggatatattaatgtcatccgttagatgttcatctaaagggtaagaaatctgcatgataggaggctaaaaaatctatcacatgatgtatatatagtccctatcttttatggatctagacaatgctagaaagttttctactgtaaaacggaaaaaagtagtttataacgcttctttgagtagcggttgaatcgattggaccgacggtcaggctggcgtaacaggtcagacttattcagctagacaaaagcccgtctctcagccagtaaccggtaatggccacaaggcctataagccataaggcccggttatttgttgcacgctcttggaataagttcagtttaagtccctcatgctcacacctagtttaagttacatcctcaaaaaaccacaataccagatatacatcatacgtatctcaacttgtaaaaccagtgtgcccaagattataagccataaggcccggttatctgttgcacgctcttggaataagttcagtttaagtcccttatgctcacacgtagtttaaattacgtcctcagagaaccacaataccagatatacatcacacgtctctcaacttgtaaaaccagtatacccaagattctaggtagtatagtgtctggttttggttttggatgatgtgacgagtgagggggtgtttggatccagggactaaactttagtccctttcatatcggatgaatttggagtattaaacataaactacttataaaactaattacataaataagagctaattcgtgtgacaatttttttaagcctaattaatccataattagcgcatgtttactgtagcatcacataggctaatcatgaattaattaggctcaatagatttgtctcgcgaattagtccaaggttataaatggcttttatcaatagtctacgtttaatatttataattaatgtccaaacatccaatgtgataggactaaaaagttttatcccatttaaacagggtctgagacccacatgtgagggttatttcttctccctccaaccactcacctctctctctcaacctcctattcttctgtctccatcaccgactctgctcaagcttctcctcttcggtaacgcgcgaccgcggcctcgccgatgggcgcgagtcccttcctccgcctcggaccgccccatcgtcacccagcatccgctcccccttcttctctcgctcatcttcctttttccacgaagccgcggctttgcatcaccgccgtcctaccttgctcttctgactgatcagtcgctgccaccaccacagcaggagccaaagcccaaaagactgggaatgcaatctcggcagcagccatgctgcagcgtctccatcgcccactccatgaaatttctagctatctacctagccagacagagaaataaattccaaagaaaaagaaaaccaaacatatcaatcagagatgatgccaccaacattttactctgatcaatgtcgatccagatgatgcaccgttctccccaagattcaacgacctaggctagaatacattttgcaagcagaaatttgattggtgtggggagacaagatccgggatcaccattgtcggttgtggggagcgaagcggagctccccgcggccagaacggagccgcaatcgcgcatcatcgatctctcgccaaagtcggttctcctcccaccgagtccctttgtcaccacattctgggagctcggtaaactccgtttcacctccgcggccgcggccaatttcgagcaagacggaaatgcccaatttgatccgccgtcgggcgctctccatccaatcccctccacctggttgtcaccttgtcagtcaccttaggccggccgtcatcatcgaagctccatcccgccgctcccgccttcccgaacgaggacgccgccgcgtcgggaccgtcagcctcgcgcgcgcgtgcctcctctccactgctggtttccttgccgcacagaggacggcctcctcagcctccggcgaggccgcggccgctcggcgccgacgaggagcgtgagcagagtcggtgatggagagaaaagagaatatgagatatagagaggggagaggtcggaggaagaagaaatagcccttatatgtgggtcccactcaccacaccagctaaaaccgagatactgtacagtgtggaatctcgagtacaccggttttattggttgagggacgtgttatatctggtattgcagttaaggacgaaatccaaactccgcgtaaagatgagggacctaaaatgaacttattcccacgctctttccatcaattttctagggaataagttcatttccattcccttaactagtgattgaatctgattcgtatccgttaaccacaataccatatatcttgacccctcgattattaaaaccagtgtaatttgactcgatggttttgaaggacggtttcgctgacgcggtgcctatgtggtagtgttgacctgatccttgtcccacgtgactgttgatgtggtgcttgtggcagtagaattaaaaaagtatacgtgggaaccatttatcatgcacaaaaaaatatcgtgggacccactaacatgtaggccccacatgtcctcctctttctcttcaatccttctccctctctcccttatctcactctctccctattccccttcagccaggagtggggcgtcgcagcgcaagcagaagaacacggcagcacagggtcataaggaggaggctggagatgatgtccgcacgttgcacagcaaagatctcatgctcctcctgcaggatgcgcgcggcggagctcgagaggcggaaccagggtggtagtgcactggcccgacggactccacaaaggtggcagggaaccaccacaggaaggagatggcgcgactgtcgggagtcttgactgagcggcggagcttggagaccgtggaggcgggggtcagctacggcgagaggaggctggcgaggaacacgagcgaccagaggtcccgcgcctgggacagcactaggatgacattgaatgacgcgtccttcttccaccgcatcttcacatccacgtacgccatggatcggacaagccctacgagtggcggaaggggtcgcccctcccaccgttgtatcacgacggtcctcttgttggagaagagtagatggatagagccacggcccgcctagagaaggttcgtacctatagttatctcaccggagtcatcctcaaattggcggtggggagtggcagcggggcgagctgctgccgctccggccctcgctgcttgccgccagccaaaggggaagagaaaggggagggagagaagggaaagagagagggaggaggaagaagggaaggagagagcgaggggatgatatgtaggcccccacatgtcagtgggtcccataattttgtttttgtcaatgaaaaatgggtcccactcctacatatatgtttttaattctaataccacctaagcgtcaatgggatgaagacaaggtcaacaccatctcataggcgccacgtcagcgaaaccaccctccaaaaccgtcgcgggagtcaaattgtatatgttttaataattattaaggggtcaagatatcctgtattgcggttcacggatacaaatcaaattcgaccacaagttaagggagtcaaagtgaacttattccattttatggccctttcctcccttatggttgcgcgaatgtaccgacatagggctaggggtggtaatgggtcaaggctcactactctttcacaacccacctcaactcttaaatattttgagcacaagaaaattattaaatttcagcacaaccctttttggcccaaccatcatattttgtaggtcaagatgttaagcccattaccatcccaacatacggcacgccaccctatcagtccgtcatcatgggtggtgactgccaagcccactggacctctttcgaccccacatatgaaaattcattttcgcaatctaaatcagcgaggctaaatctagcacagtgacaaaccaacgaggctaagtccctcagctctctctctctctcagctagtccatctccatcacacctactccctccctcacacatctcctagggcagctgatccatccctctccctccagacctcttggtggcagacaaggcctgccacggcatccggtggcatcagaggcagcgacgggtctctcccccattcccgcacatcaacaccaaccacacccgtagccgatcagccttgggaggccgcgttaggacatgtacaatggtggccacaagcacttatggtctcaagttgccacataggataaggccacacaaaaaccacgatgtctacaaaggagaccactgctaagtgtatgttgtgtttcagcccctaattatttatgtgttagttcttattatatttgttattataaaattatctattttagaccttctaataaaaaaagaaatagatagatacccctaatctctatatgggcccactgtcagcccctccaatcttttctctctcatttattttctctaccttatcgtcatcctctccagccgttcgtgttcctcagtctcgtcgcctccgctttctctcaaagctgccgctcctctcccctcaacgccgcctccacctccggcctctcccccgcggcggagccccatggcggcggcgccggatttggccgccggtttcttccttctcctccctccctcttctcgcatgatcgacgtaccaccggcagcggtggatgccctcccatccccatgccgcgacggtgaggggccaccggcggcggggaggaggagttctcgacggtgagtcccatggcggtggcggtgaggaggagttctcgatggtggtggggaggaggagttcttgatggcgcgggctcgccggatctgacggagggaaccacaacagcggcggttcctctcctcctcccttcttcgggcggcggggggaagcagcggtggcggcggatctggcgactggacgaggcgacgcacgggactccggcttcgccaacgcgtggcttcgcccttcccgagcccaggcgtggcgcttcgggcggttcttctgcaagtgccgaatcggcctgtggagccacgatccccactgtgactggtgctcgcgtccgacgtcgaggtttgagaccacaagtcagggtcacgcgttgtacatggccttacaagccagcaggcttagaacgctatggtcgctgtgactgcatatgaaccctgacgatgacgatgactacgatcgagctcggggaaagcggatccgctgccagcaagctcgggagaggcgaaccctccgccggcgggcctggggaaggtagacccgacaccgatgtgctagggagaggtgtatccagacatgccacgcgattccctaggtggctaggtggggcgatggtgctcagtggtggggtgtgttggtggtggtcgatgagcgccagtgttggtgggcctcagcaattgcatgacgacaacgtccgctatggcggttgcgatggagggtgccggatatggtgaggcggtacttgggagacctctccatgcatgcggtccttggcgacttcttctcaacgacggcgacgaacggcaacatgcgtctaggtggcttcgttacttggcgatgacaacgatgatcgcggctcaatggctttgttggggagctcgcgatggccagatcctgttagttgtgctattgatggattgatctaattggagatttttgaataatctaaatttgtgagtgtgtggatttgtgaatttctgtcagtgtcaattggatttgagggctactgataaacgacatcggttgttgatttttttttagcgctaaaatgtgtttttgcatgcggacgacttaacttgaccgcctcaaaggtcttgaattgcatgtgaaatggcctggccacctaccaaaatctatttttccgcaaaaaaaccattttttaagtgctaagagcatttacaaagcaaaccatttataactactagcctcgatttgttcacctgcatttaaactactgatatgcaatggatggcactaatacaaaagtgaattttctatacgaggccccatcatttttccatgcagaccataactagtggcgtctgcaaaaatcgagggtcattttcccatacggctgcttaagtggccctcttaagagggccgcatgcaaaaatgagctcattttgcatgcggctcacttaagcgaccatatggaaaaatcgattttttcatacggaccacttaagaaagccgtatgcgaaaataaaaattgaaaaatttgaaactagtgtatctcactcatatgaactccaaattagatgatctttttcctaaatgtttctaaaatcatgctctatcatgttattgtgttgttactggtattatattggctattttttcttgtgactttgttttatcaattaaaaatttgaatttcaaaacttcaaatgatattttgaagaagtaaataatttcatctgaaaaagtcatcaataagaaaattgtataactcatcaagatctataacttctattttggacatttcttcatccgatgaagaaatttataagattgttcataaaatgtacatgtcttat

SEQ ID NO: 27684 - DNA, 675 bp, Oryza sativa
  unsure (1)..(675): unsure at all n locations
acgcaaacgcgcgagacttaatcacttgcctctcgcaaagaacctcgccgcccgccatgggtcccgccgccggcgctaccgacgtgaagtctctcccgttcttcaagaccctcaacctcgccttcttccgttggtcgcgcccgcttgtcgtccctggcgccggtgccgcgtcactgcaccggtcgcagtcgtgcaaggcggcgccgacaacgttgccgccgccaatgaagccggcttgcccagagtccagagagaagatagagagatagaggaggaggaggaaagagagaggaagggagaggctggcctgctgacgtggcatcctgacatgtggggcccacgtgggtcccatgctgactcagctgccacgtcgaacaaaaccagggtcaaacccgccgagggacctagtttgcactggttttgtaagttgggggacatgttgtatccggttttgcggtcgggggacgattttgtaattcgatgacaatttgagggaacttgggtgtactttttccttttcttttttactaaacttgctacaaatagaatctctggggtagctcagaaagtaattagtcccactcatacaacttttatatctgggaggaatattatggaggnnnnnnnnnnnnnnnnnnnnnnnnnnnnnnnnnnnnnnnnnnnnnnnnnnnnnnn

SEQ ID NO: 27685 - DNA, 858 bp, Oryza sativa
  unsure (1)..(858): unsure at all n locations
nnnnnnnnnnnnnnnnnnnnnnnnnnnnnnnnnnnnnnatgataaaaatagctcccagcaaagcctaggcattatcattatcttaatcttctgccggcctagatcaccctcatttctctctacctttttatctgcaagcgacatctttgcgtaaaggtaaagaaaaccgtagcatatatgattactgggcatgcatcgcgtacgtggatcatatctttctgcataaaagctcaggtgagtcgctcattggcttcttctcttagtatattttgctttgcattgacgcatccaaagaaccaaaaattagtcttctatgagacactttgagacacggatgggagcagggaaggaatgaagaatttgttgtggtcagattcggccatatcactgcaggccctatccgggaatcggggcagtctctctcgaggcaggctctactgaaaaagaaaagctggagattttctctgtagcttctgtaagaactttcacagtacgcttaggtgtcattcggcttgagccaaccaggtcaaagattcaactccacgtcggtctctctcgttgccccatgaagaacacggagccaagttgagcctcaggttccttgtcatgattagcatttctcgtgctaaaatagtggcatcgtggatcatgtatgcttctaagggcttgggcctagctagcaaccgacgcctagcaagtgtagtaactgcactgctatctccatgagaatcaaaaccagagtcctacgctccttactatatagctgagtgtgtttaattcacgttaaaattataagtttggttnnnnnnnnnnnnnnnnnnnnnnnnnnnnnnnnnnnnnnnnnnnnnnnnnnnnnnn

SEQ ID NO: 27686 - DNA, 516 bp, Oryza sativa
  unsure (1)..(516): unsure at all n locations
aatttgctttagtcaggcaaaggagtgtcatgagcaatattcaaacatttttgtatgtaagttaggtgattttcctgttagatatcttggcattcttatgcattttagaaagcttactaataaagattggataataattgaacacagaattgaaaaaaaagcttagtatttggaaggataaacatgtctgttgctgggagattggttttgattaattctgttttgtcaagtctagctatgtttatgatatcgttttttgagattcctagaggggttcttcaaaaaatcgattattatagatcctgtttcttttggaaaggggatgaacattgaaaaaaaagtatagattgacaagatgggacattatatgccagccaaaagattagggtggacttggagttcacagtttagaaattcaaaaccaatgtcttttaagcatatggttgtttaaattaataaatnnnnnnnnnnnnnnnnnnnnnnnnnnnnnnnnnnnnnnnnnnnnnnnnnnnnnnn

SEQ ID NO: 27687 - DNA, 616 bp, Oryza sativa
tgatcgtgatcacccaccagatggaaaaagtgcttgagattgctgatgaggtaatcttattagataaaggtaagatcttaacatcaggcacgccatatcagatctttactaaccctgagatcatgcaaacaacatcaattgcactgcctcatgtggttcaagtcattaatgacttgtcattaagaaatccgatctttaaaaaactgtatgactacgaaccaagaacagttaaagatctagcaaaagtaatcaatgaagtaatcaagaactatgaaaaacgcaattaatgggtacatattaagtaattcagttgtccataaaactaatccatcaattaaattgatcatttttattgcttttgttgtgatcattttcttaccaactggtttagtttttcagttgattgtactagcaataatctcattgatcttcatgatctctaaacttccgtttagaatctattgatcgactttaaaaacgatcattatcatgttcttgttcttgtttttaattaactggtttacctatcggaatcctggttttttaaatatctcagtctgagctaacaataaccatagttacatcttaattggtgattataatgatcattcagtgg

SEQ ID NO: 27688 - DNA, 789 bp, Oryza sativa
cacaaccccaaagcctgcaccgtcgccgccgccgccggagccaccaactgggccagtctctgctcgccggctgctcagaccgctcccagcagagggccccagcattgtgatacccagggcgccagcaatggcggtgacaaaggacaacgacgccaccgccgccaccatgtcagtgcgaacgcggggtgaagccgccggcgacgagccccggccaaagctgaagccactgcactgggacaaggtccggacgagctccgaccgcgacatggtctgggaccggctcaagtcaaattcattccagttaagataaaaatttcagaaaaaaagatctggaattcttatgctgttcattacatttttcaatttgttgattgctgatatgaacatgttgcaggttggatgaggatatgatcgaggtgctattcatgaacaattcgacagccgtggcgcctaggatggacaacccgaagaaagtcggcatgccgcaatttaagcaagaggagagagttcttgaccccaagaaggcacagaacattgccatcctgcttcgcgcgctgaatgtcactctcgaggaggttacggatgcgcttttagatggtaagcaataattgtttggcctctgtttactactctctccgtccgaattttaactttttgcttttaatgtttgaccacttgttttatttaaaaaatttgtacaaatataaaaaacgaaatgttatgcttaaaatattttgaataataaagtaagtcacaaataaaataaataataattctaaaattttttga

SEQ ID NO: 27689 - DNA, 759 bp, Oryza sativa
  unsure (1)..(759): unsure at all n locations
tagtcgtaactcgaccactttaagtaaaaatagtggaagaaacgctacatcactagtcgaggacaatgcagtagtcgtaactcgaccacttgaagtgaaagtagcgaagaaacgctacatcgctggtcgaggactaggcagtagtcataactcgaccacttaaagtggaagttgtgggagaaacactacatcgctggtcgaggaccaggcagtagtcgtaactcgaccacttaaagtgaggcgagagagatcactacgtcttcctggttcgagaaccaggagtaggagtctcttaatcacttatgggggcgctaaagttggtttattacatgtgcatatcatgtggccagcatgactcacatacccaacttatagcatatccggatgtcctcttgcaatcatgttgggtgatcaagccgacggtgttcgtgaggagttatccgttaacaaccttttctcgagtagtccagcgatggctggtgctatgagataggtcgtcggtcttctttggtaggttgggcgtgacgactctgcatttgtcgagatcgttctcgataatgcggtgtactcgaccatgacctactcgagtgctcaattgttcctgaaaaatattttctagaaggcaagatatatagcaaataatgtcgagtatgtactcaaaaaactgcatggatgttctagtattattaggatataannnnnnnnnnnnnnnnnnnnnnnnnnnnnnnnnnnnnnnnnnnnnnnnnnnnnnnnnnnnnn

SEQ ID NO: 27690 - DNA, 599 bp, Oryza sativa
atgctcaccttgcaataatcaatcaacctcagttgaagaaaaaggatccagaaggagaagacgtttggcttataccccagttgagctgcctgtgggagtggagccggagcttcgctagattttattttccgctgcaattttcttcttggtgaggactaagtgcctcttaagtaagtatttatcgttttagttaatttgatgaatctgtatattaaattgtcagtttgtgtacctcgactgattcctggacgaggattttatgcacaaataagttcggaaattactagtgaatttccgggcgtgacattgttctagccaagagtcaagtgcattgcttccatttgtagagctagtgtggcacttgatcatctccacgccgggtcatcgcttgttactcttggaggttgccgcctcctagacggcttgtgaaggagttgcccggtgacctcttgtcgcacccggaaaaatacattttccagaacgctagtgtattaatccccgtcccaggaaaagccggggtacaccacacaaacaggatacaaaaggcacatctttattatatcgataaatttacattattacaaagtcacttcagccct

SEQ ID NO: 27691 - DNA, 687 bp, Oryza sativa
  unsure (1)..(687): unsure at all n locations
nnnnnnnnnnnnnnnnnnnnnnnnnnnnnnnnnnnnnnctctaacattcacatatgctaagtctaataatctaacactcacatatgctaataatctaataatcttatattaaaactctaataatcttatattaaatctctaacaatcacttatttacatcacttgcctgcgcgaattccttcgatggctagctaccacttcggcttgagggacgacgacgacgtcttttctataacattactaggaaaatgtattagtctaaacgcaaaggaacatatatcgtatttcacgttttcaactatatatataatcgtatatatatatatatatatgctaggtttaataatcgtttaattatctcgttcgtacacgtttcgctcccgttcgttctcacatttttagtacaagtgcattcacgttcgttcgtgtttcgttcacgttcattcgcgttcgttaacgtttcgttcacgttcgttaagcgttcattcacgttcgttcacgtttcgttcacgttcgttcacgttcgttcacgttacgttcatgtttcaatcacgttcgttcacgttcggcaatgtcggggcgcgcaacaatggcggcagcggagcgctggcgtggcggcgcggcggcggcgtttcgtggcggcgtcggggcgtctcggcggcgtggcgtggtccggccgcgtggggc

SEQ ID NO: 27692 - DNA, 817 bp, Oryza sativa
tgcaccaagcgggcaagcggccaacatgcatgatgcatgcactagtgagcagcctagcatgcatatgctagggtttgattgcatatcggtacgtgcacccgagacatactaccaggagatgaatacgtgcttccatcaagcacgctaatcacggtaattagtaagattggtttctaaactaatttactaattcatagatacatccgggcatgcgtctattaaggtatgcggtgtttttataaattgattatattttctcgtttttcatcatattatggatgctttgcttgcagtagatttgattatgctcttgatctagcggtagattaatttcctgcttttgatctatatgcatctattttatctgatgaaaactgaagaaacccgtgtgagagaaatcattaaaattgatgggataccctggactggagacgtgccaaattcggctgggccgaaccaaccgtctcgcccaccctccctcgcatctatctgtttctctctttctctgatgacgccacgccggaaacacggcgacatattctcagtctgtgcagtcggacttggagacatgttggccattgttcgctgtcgctgttgggtacgccatcggccttgcgtcgatgccgtcgcgggaaacagccgtctcagaaaaagccctaaacccatgtcgttggtgccgctggagttaatgctgaagtgaggcgccgccgacgttgacctcccatcgacgcttgcgtcgagccgtggtgggaagatgatgggtcattggttgcctactatccgattaatctccggcgagacgatatgccggatgcaa

SEQ ID NO: 27693 - DNA, 828 bp, Oryza sativa
cattgttaactcagtctggcccaaacttgtgtttacccgaccatgtgttgttacaacattttcgatacgggttagacaaggagtctgctacaaatctcgatattttcgctggaggatcgttcgcacacaagacaactgccgaaggaaaagaactcttagatctgatcttagagaacgattctttcggccaaagcgaagcatgcccggagatcgagattatccatgagtatcctctgcacgtggagtcggaacccgactcaactgtcgaatcctcattccagtcgctggagccggaggaagaagaaattcatcctccgaaaattccattccaattcaggggtgatctttatgaaaattatgagaacaccctgaattattccagcgaaaagaaggctcatcccaagcatgagccgttcgagaaggtgatgtttgtatcttcgttcgtttcttctgaatctatttcccatcttcatgaaactgaacgtccctcatcaccctcgatcaagcctaagccttgtccctctggccctcataatgatgttctcgtttatcatcatgaaacaacccaattcttgcacgatgtatctcttgagaaggaaaacccttaggccacggacaagcttgagacattgactctggaggacgagagaaaacattccacatatgagcatgaaagtttctctttcaaaaccccccaggattcatgctcacataaggaatccccagagtcctgttctgtggtcgtaagaaataccaacaaagtcttcatactcggctaactcctggagatactcctcggcggttgggacgatgtcttcatcttcatac

SEQ ID NO: 27694 - DNA, 512 bp, Oryza sativa
  unsure (1)..(512): unsure at all n locations
nnnnnnnnnnnnnnnnnnnnnnnnnnnnnnnnnnnnnnnnnagggcgacgcggcgaactcaccggtgaccaaagaagcggcggaggaacaacggacagcgccggcgatgaggaagaagcggcggcggagatcgggtcgacgacggcgacggtgctccggcggtcttcggcggcggcgaaggggcggacgaggacggcgatgacttggcgatcccgacgatggccttcccgagtgacgacgacgaccgtagcgacggcggcgcacggctggacgaacggcggcgacggcggcgcaaaagctcacggggctagggcgctacagacggcggtgggcaaaggcgagggaggtgacgagtagaggagagctcgggggtccttttaaaggggcaaggaggcggcggcgaaggcccatggctgccggcggcgagaaggaaaggtnnnnnnnnnnnnnnnnnnnnnnnnnnnnnnnnnnnnnnnnnnnnnnnnnnnnnnnnnnnnnnnnnnnnnnnnnnn

SEQ ID NO: 27695 - DNA, 354 bp, Oryza sativa
attgtgccgcacatcgccctgatcgtctcggcaatcgttaggatgatgtcctcgcggaatgccgttggttgctccaaggttgtttgcgcgctatcgcggtacgttgttgatcctctggcgacggaagcgttgaaaagcgcgatcattggctcgctttgtcgtccctttgcagattgtctgatgagcactaaggtggagagcaactcttttggctctgctctttgtgtcgccgcgcttgtgcaatccaacaactggcggtttgcgtctaacgagctggttaatgatgtctgcttgaaagtctcaggggccctagaggaggcgcatgctcagagtatcgcgcacttaaacttggtg

SEQ ID NO: 27696 - DNA, 607 bp, Oryza sativa
  unsure (1)..(607): unsure at all n locations
nnnnnnnnnnnnnnnnnnnnnnnnnnnnnnnnnnnnnnnnnnnnnnnnnnnnnnnnnnnnnnnnctgcattttgaaattggaattatcatgtggttgatgattgttgatgtgctccctaaggactcattttctgggttcaatagtgtatccttgtacctctcaatagaaaagaatatccttttgaagaagggatcttgtgaaccatttacttctaatgcagggccacacaagattcaaggaattggagctggttttgttcctggggtcctggatgttgacctcatcaatgaaactgtacaagtatgttatgcttctgtattaagttgagctgtagaaagacatatatataatttagcaccatgttttttttctctcacttgatccatagctttacttttcttcattcgaatagtagtcggtactagatctatattattcatgatgtcttagcaaatatctgcttcttttaatctggtatgaacgtttggtgcattgaactgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27697 - DNA, 878 bp, Oryza sativa
  unsure (1)..(878): unsure at all n locations
ctgaatttaggcggttccaaaaacaaaaatttctatgctataacatcgaatgtttgatacatgcatagagtatttaatgtaggcaaaaagaaaaaatcattacacatattgcatataaattgcgggacggatattttaagcctaattgtatcatgatttgacaatatggtgctacagtaaatatttgctaatgacggattaattaggcttaataaattgttttgcagtttcctgacggaatctataatttattttgttattaggctacatttaatattttaaatatgtgtccgtatatccgatctaacaaccaaacccaaaaattttccccaactaaacaagcccttaggtggtgtttggatccagcgacttaattttagtctctgtatttagacactaatttagagtattaaatatagactacttacaaaactaattacataaatgaaagctaatttgcgagacaagtttttaagcctaattaatccataattagagaatgtttactgtagtatcacataggctaatcatggattaattaggctcaatagattcgtctcgtgaattagtctaagataatggatgggttttattaatagtctacgtttaatatttataattagtgtccaaacatccgatgtgatagggacttaaacacgttgaacggtactcccttcctcctaaaatagaaggaattttgggtgatgtgacatactatcctataccttataaatctgaacgcaaatcctttatattttgaggcggagaaagtattactaattagtactaatatttcgttgcggcaacatactgacatgtacatacgcagcccgnnnnnnnnnnnnnnnnnnnnnnnnnnnnnnnnnnnnnnnnnnnnn

SEQ ID NO: 27698 - DNA, 557 bp, Oryza sativa
  unsure (1)..(557): unsure at all n locations
nnnnnnnnnnnnnnnnnnnnnnnnnnnnnnnnnnnattgcatttggcgaggaggcatatatatatatatatatatatatatatatatatatatatatatatatatatatatatatatacacacacacacacatattataccataatcattatgattatttgttttggataatgggtgcgtttaaccatatatgtgaaaattgatgtggtcaaattcatttgtgtaacatagtattatactacttttgtaattttatatttacgtaaagaattagttagagaaaaaacattaatcctctgcaaaattctgtcccttcccataaagagtatcttgcactctttcccataatatttgttttgtggggactaaggaaaaatattcttgtataatggagtagtacagttggcaataagtcttggaaccaattaattagttgaccagtcccagttaaaaaagtcaaagtctttatacaaatccaaatatcccatctacnnnnnnnnnnnnnnnnnnnnnnnnnnnnnnnnnnnnnnnnnnnnnnnnnnnnnnnnnnnnnnnnn

SEQ ID NO: 27699 - DNA, 550 bp, Oryza sativa
  unsure (1)..(550): unsure at all n locations
tttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacggatatcagaccagtcaacaagtacaatgggcatcgtattgcccgaacagataaagctannnnnnnnnnnnnnnnnnnnnnnnnnnnnnnnnnnnnnnnnnnnnnnnnnnnnnnnnnnnnnnnnnnnnnnnnn

SEQ ID NO: 27700 - DNA, 1691 bp, Oryza sativa
  unsure (1)..(1691): unsure at all n locations
gcgaatctcgagctcggtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggctcgacttgctggtcactcatgcacaccgatgtggatcttgtaaatgagaccaagctcgatagcgagattaagtcatggcttgcttttgctgcccaaaaagtggttgaagtgaatgcccttgctaaggcattggctggacagaaggatgaggtatggtactcttttttgccctttatctattctcacctcttaattagagcctgagcatagtactcattactcaatagcatttgaagaaacttctgctcatttatacatttgtgaacaatattgtacaggcttactttgcagcaaacactgctgctcatgcctccaggaggtcatcacctcgtgtgacaaacgaggaagtccaaaaggctgtaagtaccttctgtttttaggctgcatgcttgattctattcaacataacttggcctgtttttcttaatatcatgttatattgcttgtgcaggctgctgctctgagggggtctgaccaccgccgtgctaccaatgttagcgctaggttggacgcacagcagaagaagctcaaccttccagtccttcctacaaccacaattggttcattcccacagactgtggagctcaggagagtccgccgtgagtacaaggctaaaaagtgcgtaacagtccacatcaacgcttcaccgttttcccccttttttttgtctatattgctaattacaattcctgctacaggatctctgaggatgagtacgtcagtgccatcaaggaggaaatcagcaaggttgttaagatccaggaagagcttgacattgatgtgcttgttcacggcgagcctgaggtcagtatcctcgtgtactacttgtgtttagtgtttattactagactttacacttggctgtttgagaaaacaatattattagatttattgactcattaacaaagtttggtttgttctgcattgaagtaagctaactggcatgtattttacagagaaacgatatggttgagtactttggtgagcagctttctggttttgcatttactgccaatggatgggtgcaatcctatggatcccggtgtgtcaagccaccaattatctatggtgatgtgagccgccccaacgccatgactgtgttctggtccaagatggcgcagagcatgacctctcgccccatgaagggaatgttgactggtcccgtcacaatccttaactggtcttttgtcaggaatgaccagccgaggtccgtgcctgttgttgatgatgcaatgctaattattcaggttgcgattgagctttctgttgaggctgacattttcacacttgctcaggtttgagacatgctaccagattgctcttgccatcaagaaggaggtcgaggaccttgaggctggtggtatacaggttggacctgttctataattttgttctcaagtgaatacgcaaaacatgatcattttgcttacggctttttaattgtcctttacaggccattcaaaacgatgaaagctgctttgagagaaggtct

SEQ ID NO: 27701 - DNA, 689 bp, Oryza sativa
agggcgatctccaccacgtcctgttcctcgccggcctgtctccactccacgtccggctccacctcttcgtacactcgccgttgttccatcgccgccgccgccgctcgccggagttcgatgtgtacacgtcaactaagcttgcttttgtgacagcgacgtgttgtaataaacattatattacactttatatagatgcatgcaaatgtgttgtgagaatggaattagatagatagcttggattggttgatggagatggcaggagcatatgcaatgcaacctgggttaggttagctaagctaattaaggtagccatggatggagatggagtgagcttgacgccatgggtgacctccttccttggggcaaggacatatgcttctttgcttccaggggcggatccaacgtgaatgtaggggggactcatggataccccggagcaccccttcgattttttccccataaatgataaactaaaggtccctaaatagctggatattgaagaaactgtgtaattgagcccccccccaattttttttttcctggatccgcccctgtttgcttccttcatggcagatttttttttttttttgctacacctggtgtattggatcttgggtaataccaaaagttcatcatagttgggccaattgggccgcctatatgcttttcaggaatttcagcctatatgt

SEQ ID NO: 27702 - DNA, 4203 bp, Oryza sativa
  unsure (1)..(4203): unsure at all n locations
ttagtccctgtctttagacactaatttagagtattaaatatagactacttacaaaactaattacataaataaaagctaattcacgagataaattttttaagcctaattaatctataattagagaatgtttactgtagcatcacataggctaatcatggattaattaggctcattagattcgtctcgcaaattagtccaagattatggatgggttttattaatagtctacgtttaatatttataattaatttttaaacatccgatgtgatagggacttaaaagttttagtcccatctaaacagggcctaagatacaacatcatcccccaccaattattctttttattttattcacgaatgcgaaaaaaaattgcacgtcaatatattagagaagaaatcagagatttgattaggggcaattgtatctgtgcccccgctttcgaagccaattgctattttacccttattttttagggtttacagttttacccttactttttgaatctgaagcagccgtgtacccctgtttcaaacagcaggttctaacggtgttagttgtagagaaaatgacatttatacccttagtggttatagcattttttgcccccatttttttcaactgtgtatgatttttccccctattttgtgactttagcttgtaaataattcaaatatgagcatctcttgtgatgtttttgtattttaacccaaaaaaatcacaaatactagacaattacgaaatatgaccaaaatttgaataaaatttcgacaacattttaatagaattttgacacaaactagcctcagccaaattaattcaatctgaagcgaaaacaaaaccaaatcaaagctaaaatatcacacgctgaaattaattccggacatcataaatcttcaaccagccgccttccatccaccccaatcgccacgtctaactccacaattatgcagtaaactcctaaagtgcaaaaccaccagtagcatcatcctgaactggaactttatgagcggaaaagaagcacttggccagctcgaagattccagcgacgtcgtcgagcgctagctgctcgtcctccaccgctgggaggcgaccgtcaggcgccgctgccggcgcagcgttgcccggcatgagcgcgggaaggtggtgcgaaaccggtcgccctcgccgccgccgcgacggccgccggctactccgcgcgcctgggagcggccgttgccgccgcctggctactgccccgtcggagcgccgcgcgagcccccgtccttgcagccgctgccgcgccgcgcgcacgccctcgccgctgctgccctgccacgcgccgccgataggtttcgggttgggaggagagggattcaatctccaattctctatccattcactgaggggtacaaaggtaaattcatatttcatgaaatcttttttttattttcttttgtatttctttaacccaaaatgcgggacccacctaacggatgttagaagtgagggcatacggctggttcagatttaaaaagtggggtaatactgcaaaccctaacaaataagggtaaaacagtagttaagtttgaaagtgggggcatagatgcaattatcccttttgattacacaacgtaaacgaccagaaaaccattgccaggggacaagaagaaaattggaaaggaaaagactgtaaaaggaagaaaaaccctccttaaagaaaaaaaaactcctattaattatttttttacataccactatcttataatcctcataaaattttagtgtagcagaaattaatttcagagaaacgtatttatccatgtgatttttacgcatgtccaatttaactattccttctgtttcaaatcattctagatctatatactgaatcaaacgttctaatttgtatcatcaataatttcttaaaactcaaatagtttagtgtcatgagaaatatttcatgatatataatttacttgttgaactacatggatttctaaaaattgatggtcaaaagataaagataagacgtgtgatttaggacaaatgtaaaatgtgaaacggatggagtacttaaaaagatgaatattaatatgtaaataagagttcttactagttcttaagaaaataatgttgacaaaatgtgaccacacactcacgtccaaaaacacacacagaaatgattgtgataaagagaaaggcgccatggatacacacagcacttctttgttggaagctagcgaagcaaatggatatggacacctcaacgaactgacccgtacgcccgcacgtagtacggggattttttttaacttttaattttatttattaaaatatataaaaatagttttttggttttaaagtattacaaatcaaccccttaccgttctttaggagtttttttccaaaaaaaaagcgccctccaaataattttttttataacgtgacacatgtccattgatatattgtaatggtcatgaggaagaaaagtggcacttcacgggcaacccccaccctctaaaatagcgacctacaatattttgcagacggtctccttatagccctctaggatgacgttaaggggttgcctataaatggctaaccctgattattttacaggcgaatcgcttgtagccttccgagagagcgagaagggggttgccaacaaaatggtcgaccactcttcatgcggcggttagcatgagccaataaccgtgtgccacgttattttttaaaaacgcactcccaaaaagcgttagggttgtagatttttaaaactttgaaaccaaaagttatttgtttaaaatattttaataagtaaaaacaaaaaaatttaaagaattccgtagcactgtagcccatttttgatatggccaaggcccacatagcaacgcatatgcatcattcatgggcctccatttctagtgggtttcatgggcttctctttttttcctcggccgaaggcgaagcgttcttttcccctttgggacgcgggattccctcgccgccgccgccgccgccgccgccgccgccggagtgaccacctcgctcgccggcggactcgattggctcaccggcggcgacggaggaggaggaggcatctgcggcgttcggcgcgaccccggagatggaggggttcctctgcgaccgcctgctcgacgcggcgcagcccatcgccgagcgcttccgggcgctcttctccctccgcaacctccgcgggacgcccctcgccgcgccctcctccaaggtctccccctcgtcggctcacccgcttacttgtctccttatgcagcagctttggtttccaccgtgatatgattcaaggtctcagtagcttgccgacttggtgtcagtactcagcgatcgacgacgtagcatagttagctgccatctttcttctaatttgctttcgttgatcgagctagtttgatgcgattcgaggttgtgaagatgcaattagctgtctgtgtgctggtagactggtagcatttcttcggtatatggtggcaagtattactgtcatgccttgtagtttggtaccaaattcccaattcagtaatccatctcgcattcttgctcaggcgttgatctgacaaagttactttatatttcctttcttgtactagttaattctgtgctaatttatgctctcttatgatttatgaatcatccttgaagtctgaaaacagtgtttaacattgaactgagaatgattgtttatgtttctactgtcatatagagctgttagatccaattgcctgtcaatgttttgttaatgaacgggcttaagaatacctgatgtgtttgctgcaatgctcagctgcaagggactcttcaaacttgcttgcccatgaggctgcatttgcactaggacaaatgcaagatgctgaggctatccctgcattagaggcagttctcaaagatctttcacttcatccaattgtccgacacgaggtaattgctacgacggactaatgccatcttctgcttatagtgatttactttcaattttgagaagctttgtatgtttattcattcattaggctgcggaagcgcttggagctattggcctggaaaagagcatttccctgctggaggagagtttagctgttgatcctgccgtggaagttcaagaaacatgtgagctggctattagacggatagaagatannnnnnnnnnnnnnnnnnnnnnnnnnnnnnnnnnnnnnnnnnnnnnnnnnnnnn

SEQ ID NO: 27703 - DNA, 11818 bp, Oryza sativa
  unsure (1)..(11818): unsure at all n locations
nnnnnnnnnnnnnnnnnnnnnnnnnnnnnnnnnnnnnnnnnnnnnnnnnnnnnnnnnttttgttaatgaacgggcttaagaatacctgatgtgtttgctgcaatgctcagctgcaagggactcttcaaacttgcttgcccatgaggctgcatttgcactaggacaaatgcaagatgctgaggctatccctgcattagaggcagttctcaaagatctttcacttcatccaattgtccgacacgaggtaattgctacgacggactaatgccatcttctgcttatagtgatttactttcaattttgagaagctttgtatgtttattcattcattaggctgcggaagcgcttggagctattggcctggaaaagagcatttccctgctggaggagagtttagctgttgatcctgccgtggaagttcaagaaacatgtgagctggctattagacggatagaagagcaaaagaatactagtggagttgaaagtgcaactgtttcaccttttctctcagttgatccagcactgcctgcaaagcaaggacttccagtagaacaactaaggcatgtcgttcaacacagtcctacatgtcttcattgtgctttgtgtgtattatcatgctactaatagcatggttattaattttcagggagcttcttctcaacgagcaagaaagcatgtatgaacgttatgcagctctctttgcactaaggaatgacagtggagatgctgctgtttctgctattgttgctgctctaggcgtcaaaagtgctcttctacgccacgaggtttgcttgaagccttgaacttcgataatcgctgttgcatctttgtccacaagcataagttatgcagatccttacatctcttgttatgatacagaaaggacattagcaaagcaaaattatccagttacacctactcagttttgtagtaattaggatacccaataaattgttttctgtaagaaactaggggtggagcttcatccaaataaggtagagaaaaaggcaacatatcaggataggtttggtggcatgatgtatttcatgagacagctgaatattctagagtgcacatttcttgatctattcatgatagcaccatctctaaagatcaatctattctttttattgagataatcaacaacctttttcatattgttactgttatttatgttgtcattgtgttctccactgtaatcattttttcttctgtaatgttttgcaggttgcttatgtgttaggccagctacaaaacaaagctgcttcagatgcactttccactgtcctgaagaatgttgatgagcatccaatggtcaggcatgaagctgctgaggcccttggttcaattgcaggtaactaatacgataagatttgatttcatcagtctctcatcaaccatggatatatgtcaaagctttgtgagaatatgtccaatgctgtcctgcagatcaggaaagcattgcacttctggaggagtttgcaaaggaccctgagccaatagtctcccagagctgcgaagtagcactcagcatgcttgaatatgagagatcagggaaggcctttgaggtacatacatacacgccaggcctagatcaaacagaaaagcatttgtaactagctttgtggcattgtctaacacattgtgctgtgttgttccattccatgcagtttttgttcccgcagactcctcaggtgcagcaggagtcctaagtgagttgtgaaagtgtgaactgagagcgagaggcaggctggaatgtgtctaatcctgtaatccaaaccttataccagtctaccttgaattgatatgttcgtcaaaaggatttactgatcaatctctgggctctcattctaggaagaaaagagaatgtgttttctttgagtaccaactagactaggtgcttaatgatcctattaacgcattgtttttttttaatcttgcacatatatttcgttattaaaatgagtagtacaagatataagtgggataatgcacataataccacgatgctgattaattgtctgcagttgaacactacagtgccactgcacatgatgtcataccaccgcagcaatgcagcatatgcaatataaataatctagcttatcttttgactgttaacacaggaattaatgaagaactaaagggtgtgtgcactttattaccatttgcaactctactaaattttaataagataactgatcttactgatactattcttccaaatttggtagttttgaaagtttctcctaataaaaacattaccaacatttctttttttaaaaaacaaactaaacacatccaatgcaaccaaaatttagtaacaccaaaacatgtcaaaatttagcattaataaattttggtaaggttaattttgggaacaaagtgacacaagccctaacaaagagtgtgttatgatcacaattcaggagaagagatatgtgtatatatcaaaatcaaaactgtgaccaggtaaaacactggtcatcaagcatgaagtatttacaccgtcaaagcactctcatagaaccagtatacaacctcaacttgaggtgcaaaaccatgcaaaaatctgatggcacacgaatgcgcaagcataatgtcagcaaccagttggtactcacttctgccaactggtaatacagcagtcaaaccagggagaactcaatgcatgcgatgtgaaatcactgggtaaaaatcacctaaatgctatgagaggccaagtaagatcagtactccaatagcaattggtggaacctaatgcgtcatcagatgcttgacgaggtacccgagcacagcaaagatcactgccgcaacgagcagcgccacgacagaatgatacggccccccagcaccagcggcaactgcaaggaggagtagtgttagtgtcagcactcagaagattaatccggcctagtaccctactgattgtatacttgcaaatgacttaaccattattactccattgatcatatgaaaaatcaagaacagtgttaaattacacgcaagaagttccaagaacacaagtatgacatctatcaagaacaatacagcagaaaatgatgtaatcgaagatcaagaacaatacagcagaagatgatgaaatagaattgatgcccctctctcaatgcaagaactcacctcggagagtgtcgacggggaggacggcagctgaggcgttccccaacggcgggagccacgagagctcagaagcgtaggcgtcgccgtcctcacctaccaagttcctccaggcctgtaaatctgcaggtagcgaggaatcaggcattcaattgtttctacgagaagcagcgcagtagttgtttcgcaagaacatgagcattttatagtatttcgcaataaaatcaagaacagagggcactcgatatgtcgcaagaaaaccaagaaccagagcatttgatatttcgcaagaaaaccaagaaccagagggcactcgatatgtcgcaagaaaatcaagaaggagagggccaagaattaggaacctgagggacatgggcatgggcaccgcatatcggcgtcggcgtcgtaggtgtgcgaggccggcgatggaagtgatggtggtggctgctgccggaacaagggaactaagtagttgacgcaaagcttggcggcgccgtagaggaagacggcccaaacgatgatgctgagcagcgtgaagagcacggtcgtgaggcatgtagatgagaacacatcgtcgtcgtcgccgccgccgcgctccatatagtcgccgacgacgatgtcggtctcctcctcctcgccgccgtggccggcgcccgtcccctgctcgtcgtcgggctcacgcgggggcacgacctcaaccgcgagcgcaaccccgcctctgtcctccgccgggtgcagagctctctcccgctctggatgcagagcgtcgccgccgccgccgccgccgcttgcagccagcgccaccacggagtggacgacgtcgacgggtatgtcgagaaacacctcctcatcgagctcgaactcgtcctccgccatggggaacggaacggaggcggtgatgaaggatggtggtgggaggggaggggaaggtggggatcgagtggagagctttgaggtggtggtcggggtggaggaagaaaggggggaactcggcggctggggcgctgcttatataggcggttgggagcgtaacgcttcttcttcttcttcttggcggtcttcttctccaccgcagccgacggtcggagatacatggtgtgttcggtccgagtcggcgaccattgaccaccgacgcgcaactccggtcgtcggggaatagccactccggcgaggcccgggcccggagcttcaccggaaccccgccgcctccggcgatgcgcaacccacccctgtggcacgcggcccacgccatggaagtggcgactgagatcgaggagaagagactactccgtactatgtctatgtatcatcaccactggacccccatacaccggcaccggtccatgggccatggactcactcaccccgacttcctgttcttttcggtttactttttgcaagtatttttcataaaaaaaagttgttataaatatacatattaatccattttcaacttttaactaatatacttaattaattatgtactaatgaatttaattaaccatatacttaattaatacatactcctccatcatataatataagaaattttggttgaacgagacacatcctagtaatacgaatctagataaggagcctatcaagattcatagtactatgatgtgctccatctacctgaacttacttatattttgagacggatagagtaattaacaaacatagtctaagatgggcttagaccctgtttggagagcttaaaattctgagaagaatctggttagaatctaaaaagttggcaaacccagatttttgacttataattcattttctggattttacgagaagctgcaactacccggaccttcccaaacatgcccttagtccaccatgagctgtggatcaaaattcaaattctctctctctctctcttccactagaagtgggctccacccatcagaccaaatactcctttacactccttttaaatttggaaaactcttttctttcttgcaaaagttcatttaaacttgtaaaatccatatattcctagccacaactctgattgactccgtttagctatttgaattacccttgaagaaaatatctacctaacgacgctattggtttcttttttttaaaataatcactgggggaggggggggacggactttccccacctgaatttcattaaggaaatagaagaactgggactacaagagattagtggtttcttacataggaagagagaagatctttccacactgaaacaactaccatatcttctctacgaagacgctcagcccagagagtagcatcttccacacattttacaaccattcgagagagggatttagggagataaccaaaaacaacatcatgcttgtgaatccataaaccccaaaagcaaagtaagtaaaagacttgaaagtgcttatcaggacaacaattttacggtccttgagaagatatgtgtgtccaacgcatgagtgcaacggagcaaatttttctttgagcggtaaggaatcacgccagcaatcagatcaaaaggaagtgcgggcagggtttcccaaactgccagggccggggttaccggtctccggcggtaagcacggttaccgtggtaaccgtgaaaaatcgtataaaaccgtgcaaaatttatcaaaattttaaattattttttaaatttatttgaatttaaggaggttaccgcggtatttatattaaaaagaagtcatagtactccgatccctttatatatgataaccaaaacatcattactcaaaactaaactcgtgtctttcacatatattacaatgtacgtaggcttttaacctgatgtgatgagatcagaggccaaaggcagcaacatgaccagtgtttctaccttcaacgaggttatggatgacggtcacagcaagcatgatcgcagggccagagccacccaaacccatgaaaccagccaacagattcagtaaaccaacacaaattccaacgatatatgctgccatggtcatgtagtgcctgcatcgcctgggactaatcgactcgtcctcgtcatgctcctgcagcagctgctcaggcgacactcttgttcgttgcgtcttctgcaataaaattcaatatatctatatataaacgtacgatttatatataactagttaattgatcaaacaatatgaacatactcaattcgtcctattaaaaactaacctaatattagatatgacacatcctagtactatgaatttgttcagagttttagatttattttttttctttagacggaaggagtagactggtacttacctttagaagcctgacgaggtatctttttgaacgtgagcaaactctgaaccaaaataccgagagaagagcatatcccaaaaccacgaacgcaacataaagaaaagaatggaccgggtctatcacaatgtcatccaggcttcaattcatcatgcagcaaaaagaaaacaggtcataagacaggttagttatacatatatgtagctcaaataaaattataaattgagtcctgcctagcttagttactgcctccgtgtttttttatcaataaatatttaggagaggaggtagtgtatactagtagtttcaatggaaatggatgaacaagtaattaaagctagaagaaagaataaaaatgagggatacatacgttagtggcgttgttatgtaagaggcgatcccactgacaggccagtagtgcccaggatactgcctcatttccttccaaatgccaagcatgttcaccactttattcgtctcgccatacttgatgctaagcatctgcatacatatatgaacaaagtaaacaaaccaattaattaattaaacaacggttaacagcacaacacgatcaacaaattaatcgctctgtatccattatcttaaaaaagaaaatgtatgtagctacctgtgagattgaagagaagggaaaggagaggagtgcaggttgcaagatgatgggagcgtaggccaggtaggagacgctgatggtgtgtgtgattcgcagcgttggatcagccggcgacctcaccggcggcaaggtgatgtgatggtctcccagtattatcaacactaacaaaaagaaggccaaagtagcaagcatcatcatccaggggtatgcatggttcaaggccttccagaaaatacatgcactgcaaacatttaatccaataatacatattattagctatatatagtgtactagtaatcaatcattcgagctagtaattattactccctcagttttaaaacgcaagatatgttagttctttataagttaaaagtttgactaaatttataaaaaaaaatataatatacattacacgaaattaattttgttaaattcatcattaaatatatttttataatatactccctccatcctaaaatgtttgacgccattgactttttttaaaatgtttgaccgttcatcttatttaaaaaatttaagtaattattaattctttttctatcatttgatttattttaaatatacttttatgtatacatatagttttacacatttcacaaaatcttttgaataagacaaacggtcaaacatgtttaaaaaaagttaacggcatcaaacatttagagaaggagggagtatgattgatgttaaaaattaatgttattatattttttataaacttagataaatttgaggtttgattcgggataaaactaaaacactttacttaggcttaggctgatataatgaaataaataaataaataaataaatatatatatatatatatatcctaatgagaaattcttaccagcaattggcggccgagaacaaggagagaccggacaagaatccataaccctttcgaaggaggtcgtccagataaatggcaatgagaccaccggcgattagttgaaacacgaacacgagtgcagctgtagtaataaatggcgtgcctcctgcaatggcggaggcatatagaacaatggcaacaggcgacacgatggctatctgcatcgcaaacaacctccgtgtcctctccctgaatcgatcgatccaagattattattattattcagacttaattaagttagaccatgcatgcatgtggatgaatttgtggttttagtttttggtaatatatatgaattagtgatcatcgatcgaatatatacgagtaaagaagctaaagttgtcaaattaatagttttgataaaagtagctacagttttctagaatatacccttaatgtcatcttagcataaaaaagacatttagagcacccataatggttatctataagctctatacaagagatccatgtcagcatattttcttacttgaaagagattaaatgaaaagagagagagtaaagctatctactaacctggagatagtctacagagaaaaacgaggcaatgcattagagagctatagatacacatgtagacatactattgaggtgttttactattaatctagtcttttgctgagatgtacatgttttatagagagcaccttactttaccattgcgggtgctcttagaacagtacataatgcattaactcaagaggtgatatataattttttttttgcttaaaagcagaacatcaaagctcgaatagtacgcattaatcaaacgtctattatttaacaacggagttattattaataagtactccctttattttatttttatattataaattactttgactttgactttttttctagttataaacttttttaagtttgattaagttcttataaaagaatttagtaacatgcatatacaacaccaacaccaaattagtttgcttacttaaatatagcattgaatatattttgataatacatttattttaggttgaaaatattattatatatgtttctttatatatactcacttagaaaaaaaaatcaaaattacttataatataaaaaacggagactgagatattacaggcggcggcgatggtcggggagcctgtcgtcgtggacgccgatgatcttgagcgccatgcagaggtggacgaccatctccgagtagagaagagggaccaacccgagcgccatcaccgtaggccgcaatgacgccgacatggcgttcatccagtatcgcgggtcgtgctcgccgccgccgtagtagttttggaccccgtagagcagcagctcgccggcgacgaggaagacgagcagcgacaccgccgtgtagagcaccttccgccggaaagagaccgccatgacgccgccggcgttcgtgctgctgtcttctacctccggcaacagcctcgccaataatctagcagaagcaaccgctgctgctactgccattgatcgatcgatggatcagtgaatttcgtcgattctcttgtagcttttggttaatttctgacgccgattttgattttttatcgcgtttcgttcgggcggtgcaaaccgaatcattattggattccattccaggccgaatttgtgtacggctcgagttgggcctcaactgggccgcgtattctccacaaagcaacgaattagtatatgggcctccatttcaggttaatttcatgggcttttcttttctctttttattttttttccctcagttgatccagcattgtctgcagcaattcattgtgttttgtgtgcatttatcttcctattttagtatagcgtggttgttcattttcagggggatgcttgtcaacgagcaagaaagcatgcacgacaacagtcaacagagaaacagggtttatcaataaacatccccttttacttgctttgctagatttcattttcacacattggacctctgaatctgtctgtctgactcatgctgttattatgcattgaacaggatgatgattacgttgagacgaaaatgtctgagctgaaaaaaaaaagaggtgatgaagtatttcagaagagcatcagtgtagtacacactgtcactgttacattcttctatctgcttaaaaaactcatactagaatattactggaatgctagtactatgctgaaagactagtgcatcagcccattacctctttgtgtgcaactcaatgcaaaattttccgttcccttgagttagcaataagaaaaaaaaactagatctttccttccattccatggattcataaaatcagcaattgataccttttttttttactgtataagtaatgaattttatgatataaaatcatcgtgagctttgtgcactctggaactggcccatcggcaaagtgtaatgttttgcaggttgctgcttatggtcaggcaggaagctgaatgaactttagtcacgatgtgttgtttgatgtatacttcctccgtcccaaaatataagtatttttagaccctcacacggtcttcgatatactactttaaccaacggtatctacgaaagtaaaatgttttaaataaaaagactagcatattatgatagttcgtttaatgataaatatagtaacatcaaatttatgttattaatcttttttaattttttactattaacagttaaaatttaaaaagtttgacttggcactattctaataatgcttatattttaggacagagggagtacatttctgaattggggagctgatacttgagttttgtgcagcaaagcagaactgggaattcagaattcagattggaaagaaagtgacagacagagaggtacggccgtgtaaaacaccctacgccggaaagagaccatgaattgctgccttgtacgatcgacctcgccaatctactactaccaggcaccagcagcaactgccattgatcgatcgatcgatgaatttctcggcgatgatccctagcttgattagtttctttttttttttgagaaagggagggaaactcccccgttttcattaaagaaaacgcagatgattacaagagttccagacatcaagttcttacagaaaagacgggagaaaaaggaaaacaaacagttattacaggactagaacattggcatttcaagcatcaaaacacaggtttccatcgtcgtcttcaaaacttcttgccattagtttagcctgcctctctctgtttcacatcctattctttgtctgccgcccctccatccaaattttgagtgaaagatctcatttgctacctgccttagtagctgcgcccccactgcattcttcctttgtctccctccttgctctgcaaaatactccaagagtttaaatttgagcaaatgttgtaaattatttctataggatcaacaggcataattccatcaaagcaggctctgtttcttgctttccaaatggtccacaagactgctgtaacccccaccataatcaacttcccattccctttgccaaatttcaaaatccaggagctaaacatttcccccacattcctgccaggcttcacattgagagtgcattcaacaacactccaaatgaaatgagccatcggacaatctaaaaacagatgttggatggattcactcttgtcacagaattggcatttaatcgagcccttcctccaaccccttttgaacagattatgttttgtaagaatactatttcttagaaccagccaggaaaaaactttcaccctgggtggtgctttgattttacacatttttttggagggataattgatccccctgaatatcaaagctctgtagaaaggattaacagagaaacctttactagacagtcttcaaatcagtctgtctttttcattagatagactaacatt

SEQ ID NO: 27704 - DNA, 535 bp, Oryza sativa
gaatcggcaaaagggcaagcccctttgtccccctcctttttttcccctttttcccccgccggcgtcatcctccctgtcgccgctttggccgcgaccgccgagcgccagctcgcgccttgaccgccctaagtcggttcccaaaccgacattgccgccccctttaaaccccagctccttcccctccaatctccctcgttttcgcctcctcgccatagctgccgcccccgtgctctgttcgccgaagccgtttgttgttgcacgtgtcgaaggagtcggcacgagcaaggacgcggaaggggactccggccgcgccctctccttcctcttccccggcccgaggccggagatattactcccgcgccgtcggcctctcgtcacagcgccccgacccgcacggtagtgcctccctccgttcttcctcctcgccccatctcctccccctagctttcggtagtagctcgagtagactacccgtagctagccggcgccgccccgaccgttgccgtcgctcaccgcgtgctcgccgccatcgccg

SEQ ID NO: 27705 - DNA, 913 bp, Oryza sativa
  unsure (1)..(913): unsure at all n locations
nnnnnnnnnnnnnnnnnnnnnnnnnnnnnnnnnnnnnnnnaatgctatggctgatgcagcacaatgggcattaccataccaacttcgccagctatttgtcacattacttcttttttgtgaagtcactgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccggcccatcttcccctctctccccgggcgctctctctctctctctctctctctctctctctcgcactctcccatctctccccccctcccgctcggcctcgcccgtacgctgctcgcgcgtgcgagagccgccctgagcgcctctctccccgctcccccgctcagcctcgcccgcacgccacgcgcgcgtgcgcgtaagccgccgcgccgagcgccccctccctttcccctcgctctgccgcgcctgcagccgcgcagccgctcgtcctcgcgagccagcgtgtgcgcgcccgcgcacgtggtggccgaccgcccggtcggcgccgccgccagcctctgcacgcgcctgtcgccagtgtcgccgctccgctccaaaccgccccgccgtcatcgtcgtcgtcatcgcccggcccccgcccctccgcgcgcaagccgccaagggacggaggcagcgcccctcctccctctgccgcgttgcccccgctcccctcctcctttttcccgaatcggcaaaagggcaagcccctttctccccctccttttttt

SEQ ID NO: 27706 - DNA, 774 bp, Oryza sativa
  unsure (1)..(774): unsure at all n locations
gggcgaatccgagctcggtacccaaattctgtcccttcccataaagagtatcttgcactctttcccataatatttgttttgtggggactaaggaaaaatattcttgtataatggagtagtacagttggcaataagtcttggaaccaattaattagttgaccagtcccagttaaaaaagtcaaagtctttatacaaatccaaatatcccatctacgtacactttgcgtgggaaatcaacattcacctgcataaatccatggactacagatcgatctgattattcagagtcgtcaattggatttggaaagatagtgataatattcatgtccattcaaacaaacaagctcgcatttcaacccaaaacgagattgcaaaccgtgagcgagtgaacctcggcagttcgctgcatacacattggtggatcaacctcatgcaggttttggtccaggtacgggcagatcaccgaaaatgagagactgatattgattgattcagcttcatatggatcgatcgttcttattaactttacgtgcctttcatcaaccagcctcatctttgcatttatatttatgcttaccagccagaatttgaattttcaatcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27707 - DNA, 1694 bp, Oryza sativa
  unsure (1)..(1694): unsure at all n locations
nnnnnnnnnnnnnnnnnnnnnnnnnnnnnnnnnnnnnnnnnncaggatcccgtccacggaggagattgcggaccgcatcaacaagatgcttgcggtgctcgacactaacattctctgggtgaaccctgactgcggtctcaagacccgcaagtacaccgaggtgaagcctgccctcaccaacatggttttggccgccaagctcatccgcacccagctcgctagcgcgaagtgaggatcgcctttgcagcaagttcccttcgattttgaggaggaatgccatcatagccatcttgtttttgaataatctgggtccagtggatccactgtctgtggttaggtttagtcagtctcttggggccaagatcactcatacccattttactttgaatgaatttggtggtttttgaggcagtctgtcggtgtatttgtattgtaaactgagtggaaatcagcagtgtttcatctacatctgagttgttgcggatcaaattacaaaattttcaaggagagttgatgttatgttctgccaagtacccaaggcttttgtctggttttcacccgagttgatagttttctgatgatttcttgctgtgttatcactttgcattcttttactcgtgcttatgtgctgttcatgatgatatataaatccaatcacttgaaagacttccatgttgggatttgaacacaaattggcttacttctgtaggcatattcaacaatagcaaactcttcatgttcattaggaaatgaaatggattgaaaatgtaacaaaagtatacttgcaattagtagtacattttggttattaatgtggtgtttcagtatacacatttgcaggtgttaatttacatgtaatcacattagcttaattacatatcattcacatttggcatctgtttggtcagagacacaagagtcaagagctcaaggtgcgccacacggatacgatgatcccgacgagcaccgccgccgccgccgccatgttcaccatcagcctcctttcctccgcctccctcctcccacctccgctcgccgtcgccgtcgccggcggccgctcctcctccgctgctgccgctccagctcgacccatttcttgcgcctccttctctctcttctcctctttcctcttctgcttcgaaagcggcgtagtcgccggtagccttggatcgccgccgtttgctgctggacttggcgcaagaagcggcggccgtggcgagtcttttgtgctcggcggcgacgaggatgtcggcttgccggcggcgggctttgctggttcaggggtgatagccggaggcggggtccaataccgctgtgacggttgctgcggcggcggcggcggcgatggcggcggtggctttggctttgttggttccggaggagtcactgccgttggagaccaataatcctctggcggcggtggcagcggcgatggcggcggcggcgagggctttggctcgagaacacgtggcatcttcaccggagctcgtggtggtggtggtggtggctgcggctttggctcgacaacggcaggggtgtcccccggagttcgtggtggtactgtacgcggcggcggcggcggagatggtggtggcaatgttggtggcggctgtggcttctgctgcacaacggggggcttcaccgacggtggacgtgtcagcggcggcggcggcggagatggtggttgcaatgat

SEQ ID NO: 27708 - DNA, 4883 bp, Oryza sativa
tgacgccatgggtgacctccttccttggggcaaggacatatgcttctttgcttccaggggcggatccaacgtgaatgtaggggggactcatgaataccccggagcaccccttcgattttttcaccataaatgataaactaaaggtccctaaatagctggatattgaagaaactgtgtaattgagcccccccccaattttttttttcctggatccgcccctgtttgcttccttcatggcagatttttttttttttttgctacacctggtgtattggatcttgggtaataccaaaagttcatcatagttgggccaattgggccgcctatatgcttttcaggaatttcagcctatttgttttttttaaaaaaagaaacaattttgaattggcaatacttcatttggagttcttagggagaaaaaaaatatgttagtgctgattttattatcatgtagtattagtaataagcatctgtgtaaggtgtttgtctatgtccatgtggcttggatttgggtaataccaaaatcagaattgggcctgttctgttgggcattggacttccagggacagcagcctttttattttctttttaacgaagaattttgaattgagaatgtttgttttgaaattagttcttcagatttgatatttcttttagctgcaattcctttcagggagagcagtctttctttttgttttaaagaagaatttgaaattgaccattattgtcctgaaaaaagttcttcagacttgatgttacttttagttgcaattccatttctgtttgttttaaacaataattcgaaattgacaatatttgccctcaaattagttcttcaagcttcatgtttgttttagttgcagtttgcaaaggtacttcttcactttccaagttttaaagttgtacttctttttcagcatagttcttcatgagtcttatctcttcagcctacctagcaaaacttagtaatttaggcatgtttttttttttggtgatagggaggaaaccatattgctaatccctttttcttcagttaatcttcttgtcagttctgaactgaagctcaaacagaagggcacaacgatttgtacaagaaaaccaaaaccatctgggactctgtgcttgggtagcattattcagttaagagatgatgtacacatcccatgagtcaagtgtttgcagatcaagcaaccagacaagcaaagcaaacgtggagaatctgtttgcatcttggggtggatcaaattctgcataattttttaatactggtccaataccagtacaggctgctgatttgttcacacgctggtcaccccctctgaagatattgttccttggatgattgtccttgctggataaagctccttgcataatggagcacagttaacaagggggaaggacaataagtttcacaagtatcaatcagttatatgatggtaatataaggcataaaggcttttccggcacgcggaaaattagtaggaatgtctcaagaatttcagaaaaaaaaatctcattcaaggagttagggaatttcagaaaattcagagtagaagacaagatcatgtgagatcaatcaactgtacaaaagaggtccccagcttgttaggacaattccaagctgggattcaatgaatagtcctagatcagggtaccaggctacaaaaagagtaaaatgcaccagcggtccttcaacttgtcagcaggtttcacttaggttcaccaacttgcaaagcgcatatcgagatccctagggttggtttcttctatcagcccggtccagagccgtgtttgaccgtgatctagcatacgtggcataccacgtggacgatcaaatagattttattttattttttctcccttcttccttctcttttctcttttatgaaaagacgatgacgtgtatgaggcattttcatcttttcgacaaggaagaaagagaaaaaaaagaagaaagaagagagaaaaaataatttaaaaaatctatgtcatcgtccacgtggcatgccatgtaggcaagaccatggtcaaacgcggctttggattgagataatacaataaaccaagtttagggaccttaatgtgcgcttcgtaagttcgtggacctaagtgaaatctcctgacaaatttaaggaccgctggtgcattttactcctacaaaaaagtcagtctagtgatcacaaatccacttatactactacccaccatgcattgtgttcatcatttctgacagacaggcactggctcactagaattctcactcctgttaataaatcagaaacttaagttgcaaatggtggttccttcttgagatgatcatcttgatcttccagaagaacttgactggagaagagaagagacaaggtgttgatgatcctactgtaactcatggatcaggagaagatatatagtcacctgtgatagcttatctgaattacttactgcgtggttccaatctaacagtagcatctcctgatgttgagacctcgattagatggatggatgttgaggctaatagttgttcatccgtgtggtgccaatctgacagtagcatctcctggatgctcttgttcatggaatggcgtgtcgtccatgcattggtcaggcaatttgacaatttgttcatcgtctagcagagaggatatatggtcaggaaagagttgatgagataaaattgcagttcgagtacggttatactgccgtcttacctgatccaataattggatggagaatgttgtgccggtaagtaaacagtaacaagttgtgaattttcattatctgctagctagagtgtcagctctgaagaatatatcagcatatgtagaaacatgatgaacattagtttcagctgatttgttttcttgttactgtcatacatctctggtaataatagaaatgggataggttttccactctgtctgaaaaaaataattcagctgatattccaatctcactcacctcacctgctgaattcccatagccaaataaattgattccataccacctattataggggatagaaaggggagaggttttcctctctgtctggccaaaaaatatttcagctgatattccaatctaactcacctgctgaattcctatagccaaagaaattgatttattagacatactccctccgtttcgaaatgtttgacaccattgactttttatcacatgtttgaccgtttgtcttattcaaaaaatttaagtaattattaattcttttcctatcatttgattcattgttaaatatattttatgtaggcatataattttacatatctcataaaagtttttgaataagacgaacggtcaaacatgtgctaaaaagtcaacggtgtcaaacatttcgaaacggagggagtaccaattattgtatcttcagattagtgagctgcatcagaaagtagtatgcatgatggaatcagagaaacaggagtagcagctgcagcatctctcttccaaacctttaaatactaatccaacaatgttacttttgcttaccagataagttaacaccacaatgaattatcaaatcccaaatggtactgaatcaacacaatataatatggcatataagttgacacaaatgcaaacgaccaccacaaagtgataatttagtccaaagagaacataaaaaaggaagatgagaggaattcagaagaagagttttgagtcagtcagtatcaaggtcatgtgattgatgattcagcatcccttgaggctcagtggcctaatgagctgccacttgtcctaatgactccacattttcctgtcaatttccacactaactctgaaacaaagctcaaaacacagagcaaaaatcaaagaccaaaacttccatctttctctctagaccaaccaagaacactgcatttccagtaccaaaataaaacaagaaaaacaaagaaaactacttcctccgtttcagattataagatgttctgactttggtcaaagtcaaactgcttcaagtttaatcaagtctatagaaaaaaatagtaatattttcaatccaagctaattttattataaaaatatatttaattattaatttaataaaaaaactaatttgataatgtaaatattactatatttgtctataaactaagtcaaacttaaagcagcttgactttgatcaaagccaaaacatcttataacctgaaacgaagaaagtacaagacaactacaagttcccagctttctcttcccatttcgattgcggccatctatgccatcaaaatcgtcgtagcttcactactctctcccaatcatcactaagctccaacctcctctctgtcatctcccatggcggccttcttgcgaacgctgcaccggcgaagaacgcgcaatgccgccgccgccgcgttcttggctctcgccgtcgtcgtcgtcgtcttcttcttgtccgtgttcgtcgccacgcggaatgaggctgacatcttcttcagtggcgtcgcggcggcgagctcgtcgtcgccggattcctcgtccggtgggtgcagggagctgcaggcgctcgacggcgatggcgcgaggtgccggtatctgcgggcgcacgcgccgtgcgcgccggtggggtacgtggactacctccggctgctgtactgcgggttcgggcgggcgccatggctgggctacgcggcgctcgcgctgtggctgctcgtgctcttctacctcctcggcgacacggcgtcggcctacttctgcgcctcgctggaggggctctccgccgtgctccgcctgccgccggcgatcgccggcgtcacgctgctgtcgctcgggaacggcgcgcccgacgtgctctctagcgtcgtggcgttcgccgcgggggcacgcggcggcaactgcggcggcggcggaggggaggatgccggggatgt

SEQ ID NO: 27709 - DNA, 2221 bp, Oryza sativa
tgtcggtgctctggtcgtacgtgctcgcgcgggagctcgtcgcgctgctggtctccatcggcgtgccggccggcgtgaaggccggcgtgctgggcgcgacggtgctggcgtgggggaactcgctgggcgacctggtggcggacgtggcgctggcgacgcggcgcggcgacggcggcgccggggcgcagacgacggtggcggggtgctacgcggcgccggcgttcaacacggtggtggggctggggctgtcgctgacggtggcggccggggcgcggcacccgaaggcgtacgcggtggagggcgggccggcggtgtacgtgacggtggggttcctgacgacggcgctggtgtgggcggtggcggtgctgccggcgagggggatgaggctggacgcggtgctcggggtgggcctcctcgtcatctacttcgtcttcctctgcgtcagcctcgccattctcacgccattgccttcaccacattaacttcatttttcttctttgcaaattgaattgcaaagatgatgatggtgatgatgctagattggttgggttggttggtgtcaagtgttaatttgggtgattagttattaattaattgcatggtattttgttcatgcagaattgggaagatgaaatgctttgtagtagtatatgacttgtcatgaaatgtaaatagaagagcacatatagatgcaatgaaataatgcatagtagtactagctttttcaccggaatggttgaatagtgagatgatttgtaataattattcgagcatatagatgaacaatttaaataccataaagttataaaaatgaatatgagatagtttgctatatatatatatatatatagttttttttttggaaaactacgttatttaaaagttcagaaaacgtgcgcattctattagtctgaaatatatacaaatttccgaaatgttttcttttctctgtgagtacgtactactgaactagtacagcatacagaatgtgtactctacagtgactgaagcgtgtagctcgatcaaacaatttgattagcggaatttcgtagtcattaaatttgtttttagtggctgggccacaataataatttgattttagttggacttgcagagtggagtccttgctgggcttcgttttctagttgcattacacgaacgtgtatgatacgatacgattgcctatttgccatgtgcttctcactctgatacgattcccatatctgacatctagtagtcatcaactatatctaatctcgtggttgtgacgattatattactggtaattagtgacttaagagctttgtaaattacttgacaacgaggcaccagtggtctagtggtagaatagtaccctgccacggtacggacccggtttcgattcccggctggtgcattttgttcttcttttatttttcacagtttttcaaattttggcctgattaaaaaagaaaatttttgggtgttacactatatgtcggaaagagtttttgacacgaatgaaaaaactaatttcataactcgctagaaaatcgcgagacgaatcttttgagcctaactaatttgtcattagcacatgcgggttactgtagcatttataactaatcatagactaattaggctcaaatgattcgtctcgcgatttcctctaactgtgtaattagttttttaatctatatttaatgcttcatccatatgtccaaaaattcaatgtgatatttttagtaaaaaaaagttttgggaactaaaccaggcctttaacaccgagttttttttaaaaaaaatctttttcccttagaaaggagagagttttatacccatcaaattttaattcagagtttttttaattccttctcccttaaaatgaagaggatttttgtaccgtttccgagtcggagcagcagtcttgccctgactatttacgtgcacgtgatcgaactcaaacagtggatggatcgatcacccgggatgtcacggcggcggaggaacgacggcggcgaggccgatggccgcgccagcaagacggcgcggcggcggccggcgcatacgaagatgaagcacctctacctggtgctcgacgacggcgacgaggctactactacttacaccatccacaagctcgacgtcgacgacgacgcgggcattatccacgcgcccgacgtcgaccggccggcgactcggttcgcggcggcgccagcggccggtggtggccaaatgcact

SEQ ID NO: 27710 - DNA, 10428 bp, Oryza sativa
  unsure (1)..(10428): unsure at all n locations
caggtcgcgtcccgcgacggcgcggggcccccggagtacagaaagacgctcgactacgacagcgtgtcgtcgtcgagaacaaagaacggcgcaacgcgccacgctcacctacatgggcgacggcatgttctgcgccgtgaagacctgtgagacgccgccgacatcgtcgtcgtcgtcggaagaaggtgacgccgacggcggcgtgaaggtccatgtcacggtgttcgggctcaagtacaatcgccggggagagctgcaggcgagggttcgccgcgccgccggcgcgttcccactgcccaagcaacatgtcccatcgttttctcctgtagccttctggatgtagcagctgcttgcagaaattttatttttatttttttatacttttttatgtattaattttattgatataccttttgaaaacatatttccgaaaattttatgaagtagtttgcttctcttgcattacattgtggaatatgatcagatcaatagtttcatgcaaattaaagtcttacatgatgatatttcggccactacacaccagatattgcccccaaaaaaaatgattgcacaaagttaacatatggctggacagtagatttcaccttttctttttatagatgtcccccagcttctattaaacttcaacagatgtacacacacaaaaagcaaagtctactgggtatatatacttgtttacagtacacaacagactcaatattgctatagtaaaaaaacactcatatccacaccaaaacaccacccaacatctgaatccctggaatcattcacaagcagcaatcaacatggttagcagcttctgagtattacagattgcattgatgtttaaagaaagaccttaagcctcttccggattgtgatataaaaaaaaggccaacacacaaaaggctagcgcgtctggtatattagaagtagcacatgcaaaatcggttcatgaacatgcaaaaggcttccaggttgtgataagctccactttcaatatacttgtacataagagaacaacaataaagttgaactggtaagaatggctgtggcacatgcgcacaaattcacagacaaatgagtagagagtttggtcatagtaagggggtgttcgggagagaggggctattagcccctctctaaaaaaaacataagtccttctcatagggatttatgtttttgtgagaggtactaaagtttagccccagtttagtccctccaaccaaacaccacctaaggaatcatgaataccatcacgatccttctgtacagactggccttaagtgactgaaaaaggtgtttcagtgtctgccctgaataagctgaattgtgcagggcttcaattcgcgtatatgaacagagtgttgtcagggaaatgatcagttgagttctttcaatgtcacttgtaaatgtctgctgtcttcgtggtcaaccttttggattccagaatctgtgtggcttttagtgaattgacctgaacattagcacaagaaatcagatgtatcaaacaaatgcgtacatgcgaaggtctgatttttgctagagtctacagattcactacacaccaaaagcagccaatggtataatactataatgcaactaagaaagaatatgaagattagaagacaagcagtactcactttagcgtatatccttgcttaaacatcaccttctggaaatcgcccatgagtcttggaaaattctgtgcaactataagtacaaatacatcctcttttgctcttgcactgtgctgcctgatgtttctgagaagtttaagaaggccacaaatgtcatcagaataataagctttccttcctgtggcaggatcaatgaaatcaagtgtttccttcaaatgcgtatttccatctggagcttcaacacccttcttccatttggtgtatttactgagtttggtcttaattttctcgtacgttggattatctgttgtctccattttctcaaacatgttatggagagacatgaagtgggcagctgatctatatccatccttcaaagtgatatagtcctctgctaaactgtcataacctctggcacaacgatcaatcagctcaatccactgtataatgtccaaaggcaaagtggtgaccgaaacaaatacctcctcgcgagtcatcttcacaaatctatctgtatccttttcaatgtcaccatcctcaagcttgttaatcactccctttgacagattaccaaatctcatgttaccacaggtatccattagaaaattttccgatgtaaaatggccaccaaatgtcagtccagcccagtgaaaattcttgagtagtacatatgcgttcctgatcttgcatttcacttcatttgacgttgtgtaagaaatatgtctacacatattcttctcttcttcttcagttgatgtgcttgctccttccttcggttctagtggatttgtccatggaatctgttccggtggcgacttgacttgaggtgttatggtttgaagaattaacctgtccttattgaacttgcagtagttcctcaggctggtatacattgtttcatccattttgcagacgaaaagattatggtttagatggtatgccttttcttcaaatgccctgtcatactcaagtttccttcttacagatcttctttggtaaccataacatggtcttaattttttgcttgttgatacgatagtgtcccttgcaccttgacttgttgctggagtcttgattagagcttgaatagcctgtaaattatttgccatcacaatgattaactaagatcaattgccaaaataacaatcagcagatgtgtttccatgtcaaatttttttttcacaagataaccaatcaacagatgcagctatttgcctatcaagacattcaaattcagcatatgagcagataatacattctaggacaaatctttaaatgtagcaatgcaaaattagtgctcgctaccttcttgagagagagagagagagagagagagagatgctagctacttacaggtgcatcattttctgggatctttattccttttatatagcagtcgtcaatccattggatgttaaccaccttcttgccttcaccgttccatatcagaacagctccctccgaatagtctccctagcaatttgaattaaatgtcaagaacgaaacatgtgttacactaataaaaatcggtagtaatttttttaccgccatagcaacatgagtgcagatgtcatagtctattgattgcagtacgaagcctcctagtacttcaattttccttttgctctgcatcatttagttcagaatgttaataaaacctggaggaagtaaattgttatcaatggactcccatgctgacaagccagccatattagtggtagaaaccaaaatgacatgctgcacaattttacagggtttcaaaattgaacgcagataaatcttacagagccaatcaacaaaattagatacgattcgactaacaaaattcgataaaggaaccttagatacattagtgaagtatagattactcctctaattcgttatcaggaaaatatatggagataaatcctctaattctttatcagcttgtacccttcaggcccaaagaaagggaaggacaagtcacaaaactcaccagattctcaaatagacaagcagtttggaattttggtgcatactaggaatatggcttgcttagaaggagtaaatactaaggggctgtgtagcagaaaactaagatggactggaaatgagtgattgtgtgatatgttccctactgttgataatcatgagcgtaatgtttcaatcttcagagcactgctttcaggtagaaagaacgcaatcttttcgcggaaagtatataaaatggaacttgttttttaccttgacattagatgagatggcataaatatcaaaatatgcacacgctgaaaatgcagtacgaaaaggagaagttcctgagaagatctggttgacagacacaatacttctgtaaaattgctgatatgttcaatttagtttaaatttcatcattccataaaagtcacatgtgtagattccttaacctgctgataatttgacttcatcctgatagcctaggcaccgataattaatctttaaaaaacaagtgtaaggaacgggatgtgtgctgtgtgcatgttgtggcctgaactaaggcagtaaaaatcaattaagctcgatgtccagttccgcatttcccttaaaccctaactctgcaattcgatgaaattggggaacacacgccgacatgtgaattatgagcaactagaactggggacattatctcacctgttcttttagaaggtgtgggaatccgtgaagtatgaaacgcatcccggcgaaagggcgattgattctgcccccgcgatctgctcccgccgctgatccctcgccgctgatatggcctcgcgcctcgagatcgatccccgactcctcatcgccgcttcggcgtccaaatccgccgccgcttcgggctcctcccccggccgtggatgtatcccccggcaccgccttgttcttgagccccgccgcgtatctccccaccacagccgccgccgccgcaaacgatttctccccatccgcagcggaccgcttccctgtctctgccttgaccttcagccccaccaccggcttgcgctcctccacctcccccgcgtatttcctcctcgaccccacctcttctccatccaccaccgccgcgtcgcacccctcctgcttcacggtggctttgctccgcgccaccgccgcgtcgcatccctcctgcttcacggtggttttgctccgcgccaccgccgcgtcgcacccctcctgcttcacggtggttttgctccgcgccaccgccgcgtcgcacccctcctgcttcacggtggttttgctccgcgccaccgccgcgtcgcacccctcctgcttcacggtggttttgctccgcgccaccgccttagcttcccccccccccccccctctccgaccgcaacggctccctcctccgtcgccgttttggcccgcgccttcggcttcgccaccgccaccgccgccgccgccgccgtagcggggtcccatcagcggcggcatgacctagccgcggcgcttggcgaattgggggcgaactgcgagaagcgagcgggaggaggcgagaggcgaaaggggaggggagacgagcgggagggagcggaaatttcgagttcgttgggctattggctacttgctgagctgtcctttcgttttgtctacccggtccggatggggccttgtgggtttttcactttttctttttctttccttttctctctctctgtttttttttgtgacgatgggagtaataaaacagtaaattccttctattttcttgcggtgaaaaattccttcagatatcagtatcacggccaaaggtgccacaaacctactgaatttaggcggttccaaaaacaaaaatttctatgctataacatcgaatgtttgatacatgcatagagtatttaatgtaggcaaaaagaaaaaatcattacacatattgcatataaattgcgggacggatattttaagcctaattgtatcatgatttgacaatatggtgctacagtaaatatttgctaatgacggattaattaggcttaataaattgttttgcagtttcctgacggaatctataatttattttgttattaggctacatttaatattttaaatatgtgtccgtatatccgatctaacaaccaaacccaaaaattttccccaactaaacaagcccttaggtggtgtttggatccagcgacttaattttagtctctgtatttagacactaatttagagtattaaatatagactacttacaaaactaattacataaatgaaagctaatttgcgagacaagtttttaagcctaattaatccataattagagaatgtttactgtagtatcacataggctaatcatggattaattaggctcaatagattcgtctcgtgaattagtctaagataatggatgggttttattaatagtctacgtttaatatttataattagtgtccaaacatccgatgtgatagggacttaaacacgttgaacggtactcccttcctcctaaaatagaaggaattttgggtgatgtgacatactatcctataccttataaatctgaacgcaaatcctttatattttgaggcggagaaagtattactaattagtactaatatttcgttgcggcaacatactgacatgtacatacgcagcccgccttgtcaggtttgccaccatcagccactaccttctcaccacaagctccgtataccccaccgacaacatcgacacaccgctgcgtgctcgtcggtcagctgaaggaagatgatgcccctatgtggagatagaggtggtgtgtggcttccgttttccagcgatggtggtgcggcgaggggccaggaatgataatgataaggtgaattaggcttgggtagcagcggctattcacattaattagacgactgtacggctcgggcatccaatcaatttggagaaaaatagaacgctgatgtcagcgcccaatttacgtgcaaaactattttaaactgatttttctcttaattacttatctaaatcattatccgattgtaccattaaattcgttgcaattaaatctttaaaacaagaccacacatggatatattccgacgaaattttttttagcttattattaaattattttaaatattgcacgatgttcaaccaagtatatcggaattgattcacttagtagatcgaaaatgtttcgcttgtttaaatcaggtgttgtttcaccgtatataaaaataatgtttcagcaaatagctaaagaatgttttagttcacagcaacatttgatccatacgtagtgaaacattataagtacactaggtgaaacatttttcggtggaataaaaaataaaacgaattcccttaataggggttcccaaaatatataggtttttttgttataatgaaatatttcagtttactgcaacattagatctatacatagtgaaacattgtgaatacacttggtgaaacattttgggtaaaaaaaataaaccaaatttccttaatatagagttttcaaaatatctagttgatttgttgtaggtggagacaggtactgtagtgggcctagcggcatgcaccgcgcacagggggcggggtagaggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcggcacggcacggcccgggcggcccgtcaggccgaaagcgccggcggcgcgtgacagggcgggcggcggtccaacgggaaggcgacacgtggcactaacggctatttgaccgttcaaatttgaaaataaccgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccagctcgaagagatcgagaacctccggtgtgtggcaaagcttcgacgagataaaggaaacatgccccgacggaagggagatatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagagctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtacaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtaagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatcaatatttttaaattttccaacccaacaaaaaaataccattttttataaaaattaggcattaccagatcattacttttttnnnnnnnnnnnnnnnnnnnnnnnnnnnnnnnnnnnnnnnnnnnnnnnnnnnnnnnnnnnn

SEQ ID NO: 27711 - DNA, 615 bp, Oryza sativa
ccccccccccacccggttgatcggatagaatcattatcgggaatgataatgataaggtgaattaggcttgggtggcagcggctattcacattgatggagtagaagagcaatgtctagtggatttgcagcagaaaccataggagcccaccagataggcggataggaggaagaaatcaaatttgtactagtacatttttatgagtttttaatgtttcagaaaatgcatctttcttgggttggattgaaacgttgtccttgatacttcgatggtgtttcatatttttgtttaagaatcttgtaattggttaatgttccatatgtgaaaataatagtacgtttcaatacatgaaacatttttcaggtagcggtaaaacatcgcccaaattttaaagaaaaaaaaaggttaaaatcaaacactcgatttgctgtcgcctcccagcattcatgaacttggagaaagtttgtccgaaacaacggcgtcacacagcgcgtccgactccgtttctcctgtaggtcgagtcggagtcggtttctcaccccatgtaacccatgttcgaatcggattcggacactacaaccgccataactacctcggctatatatatgcaatgcacg

SEQ ID NO: 27712 - DNA, 524 bp, Oryza sativa
ttaaactagaccaaaagtgagaatccccattcttatgtttgatttgagtcagagttttctttttcaaatacttgtttcttagcatgtcttgccacaaaccttctgtattctccaaattccacagccatttccccaacagagctttattcattacatctaaatctaaaatccccagccctccctgatctttagggaggcagatcactagccatttcactagatgatatttcctaataccttgatcttcttgccacagaaatctccttctataaaaatcaattttttctctaactccacaaggaagagagtataaagacatcatataaagtgggacactgctaatgctagagttaatcaaagcaaccctccctcctattgccaggagtttcccctgccagcaccccaacgtcttttcaattttttcctctacaggtttccaatctttgtgatggattcttacttgatttatgggaacacccaaatatttcattggcagtcgcccaatttggcaagtgaacatttgg

SEQ ID NO: 27713 - DNA, 1853 bp, Oryza sativa
  unsure (1)..(1853): unsure at all n locations
ggcgaattcgagctcggtaccctcagcttcactcaacatagctatgccttccagattcaaagtaaaatcattctctggagggggaccaaaaagctgtttataaaaatttgttatatatttcattagatcactctggcctttaatctccccctcttcctgatccagagaatgaatcatgttttttcttttccttccattggctttagcatggtagtattttgtgttatcatccccttccaaaaggttttttttctttacatctctgcatccatttcaatctatcctctcttactactttcttcaactcttcctccaaatcccctctctcttttctttccagaatagtcattccatatgcttcacattttttatcaatgtcttctattttttccataatttcatgttttttccttttgtacattccttcccagttcatgttccaaccttttagtttctttctcattttttgtaaactccattgccatttatcaatactggatccatttatattacaagaattccaaacttgctcaaccacagtattaatatcttctctcatgagccaaatattctcaaatttaaacagaggagactgccacttttctccctcaacattgatcaaaagaggagtgtggtcagagtaaattctctctaagacccttccacatgccaaagggaacttaatctcccatttatcattaaaaagaattctgtccaatttttcaagagttacactttgtttgttattagcccaagtgaattttttcccttccaaggccatctctctcaagtttgcattctcaattatagaattgaacataagactccatttattcacccctcccctcttgtttttttcattctctcgtctcaggatgttaaaatccccaccaattaacaggggttcatcacacccataacaatcctgagctaacaccctcaagaactcctccttgtgttcaggctgggcagccccatacacagttattaatctccacacaaatttgtcatttctattttttactttaacatgcaacaaaaaattcttcttggaaacttccataatttccattttgtcttcatttattcccaccaacatacccccagatctacccctgggaatggtccaattccaactaaacttaccccctcctcctattaaatccaagtctttagcagtgaaatcctgcttcacagtttcttggatgccaatgaaatcaactttatgctcttttattaaatcattgagatgctttattttatcatgatcacccatacctcttatattccaaaataaacctttcatgatttcttttttgtttttttcttctcatttttgccactacatttaggagtgaccttgaaaatctcaaggtttcctctgttatttttcctcctcttttttcctgatgaattgctttgagaaagcctcaacatgttttcagcataatcaaaatcagacatacaatcatctgaatgtaagacttcatctatatttatgtctatgtcactcaagttttccccaacattttcacactcccctttctgagaagtatttagtttctctttcaagaacagatttattctagccaattccagatttgtatccacagcttctagagcacatcctaaattaacacctagcagactagccatttgagctagagagaaattactttcatcaactatagatgggatttgtttgttacctttgttgatgaaagcattaagagcctctttcctttcagctgcagcatcggccacctttttgtcttccttctccaaaagtcttagacttttcttcctcttctcctctgtcannnnnnnnnnnnnnnnnnnnnnnnnnnnnnnnn

SEQ ID NO: 27714 - DNA, 11399 bp, Oryza sativa
  unsure (1)..(11399): unsure at all n locations
nnnnnnnnnnnnnnnnnnnnnnnnnnnnnnnnnnnnnnnnnnnnnnnnnnnnnnnttcctttcagctgcagcatcggccacctttttgtcttccttctccaaaagtcttagacttttcttcctcttctcctctgtcatgtcttcattagtatgagacagaacaactcccaccgctgcagcaaagtcacttgattcttgtgattccatgttctcctcactccccaccagttgcactcttggttcatcttcatcataaatcacctcctcactgtcattttccactctctgactagtaccacttttatctgccatcccttcttgtgtcttctttgttttcttatttttctcctccccagcatgtgcttcttctctgattccaccctctatcatccctcctgctacatctttatcaagttgaatctgcttgactttaaaatgttcttctagttgtactctcagagccatctccctgtctatctccatctgtttgagcttcaccatttctgcttgagcactttcattgtctgaatcctcttccacaactatggctttcctcttgtccccagccttttccaaaaccctcatatttgatgcagcttcttcttttcttggtttcttattcctctgcatgtgatttatgttgccaggttcattttgctcctccacctccacagctctcttttcctgtgcacaatctctaaaccatcccaactccacaatctgctccaacttgaaatgagctttgtaaaccagcaacttaggtgtcaccagagtcatggtcagaggcaagctttttagtgtcatcattcctactctaattctgaccacattctttgtctttaaagctaccatatccacttctatcacaggtcctagattggaacccacttcatgtagagggtcgtaatccttcatttcatcaggtaccccctccacagtcacccacacttcatgtaacctccccactgcctcagcttcttgagtccatttcttcactttcacctgtacagatattccttttactctaattgagtcaaattcagctaactcatccaatttcatcttatttgggaatctcatatggaacaaccctttctcctgcatcctagccttccaagtccagttccacttgaaatgttgagtgaatccttcctccaaagcctgctcagtaagatcacctccccacataattgtcacaatagccaaagggttaacatgttctttttgcactatacccttagcactctgaatcagcacacagcccagacctggggcagcacatcccactactttagctacaggtttcttctgattcttcctaaaacaatcctctgtcctatgagtctcttttgcacatatcatacagaacactgacaatttgcaatctctagacaaatgactgtaactcctgcatttagaacagaaaatcctctgctgggaatgggattcaccaacctgatgcttggactcaactcaattttgttgctgatttggctttgcttccaatcctgaactgatagaatccatcttggcacttgtttcctggaaatttggacccgcttccttcctcccttcagttttcagcgtgtccttcccctgtgtcacaccctaaaaatcctaaatatataaattgttgtttaattggaattattagaaatgattttaaaagtctagaagaaaagatctaattttaaataataaattccaatataaaagtgggcaagataaaattttaatactttacttgattctatagttcctagatttttctaggatttatttgaaccaaggaagtatttttaataaatggaattgcatttcatgaataatttaaattggaaaaggtttttaaagttcccatttggctttgtccctctctctcctctccggcccagtcggcccagtcagcctgcagccgcccgcgcgcgcgcgctcggccgctgacaggtgggtcccacctgtcggactcgtcgtcctcctcgcgccgaaaccctagccgcgccgcgccgccgccgcctttccaattcggccgcatctttcccgatccggtgaaatagtttgaggggaaatgctccccgggatcttctctacctttttccttttggaatcgatcgccaattcggtttggaaatccatggattcatgttcgattcggatcgatctatctcctccgaaccctaaaccttccatcgcgtcgccggtcgctgtgggccttcgccgccgcctccttgcccctataaaaggacccccggtgtctccgctatccgtcgccacccttgcctttgcccgccgccatctgtagcaccctagcaccgtgcagccgtgcgccgccgtcgccgccgcagctccagccgtgcgccgccgtcgctccggtcgtcgtcgctgctcggggaggtcaccgttgtggtcaccaagccgtcaccgatctcgtccacccctccgtcgtcgccgtaggtcaccggagcatcgccgtcgtcatcaagccgaaggtcgccgccgcttattccacgacgtcgtcgccgtccgttgatcttccgccactgttttggtcaccggtgagttcgccacgtcgccctctacgtgttggtgtcctccgttcgcgtcgtcgcgccgtcgttcgccggcgagcttgcgtgcccgagccgccgccagtgatgacgtcatcgccgacgtcatcgttgccgtccgtcgtaggccggtcgtagaccgtcagatcttggccgtccgttgtggataggatcgatctcggccgttcgtttccgtgagtcgccgctgtgcacccggtccaccgcggaccctagccgctgacgcaataattcccttttccttttcaaaaataattcattattgcgtcataattcaattaaaacccatataagtgttttaatccgatttaatgtttaaaaaatcataactaattcatcttaactcagatttagttggttcaagtctctaaatttttctaaaattgagatctacatgttaaaaatatctacatgtactgttcatgcttgtttatgtgctgttttggtgattttgctcttttctgtttagattccgacttttccggagagtccgttttcgcaggagaagaatttgaagagttccaaggccagcaaggcaagtcacacagatcccaaccaaccctttgagcatattgatcccgtttaaagctattgtttctattcaactattgcatttatttttgaatgtcatggggtggaattaacctattgtttgttatagcccttttgttcttgattactttattccttgataccttgggttattataacttgactagttgagctttatatattggttcagctagatatcagatatgattgcttagccatgcttagaaacattagcacaatattgggataacttatgattcactattatttaatgatggcttaatgatagttcacgatggtcaatcgtgattggttaattaattaaattgccaactaaaacttgataatggtgggttgtgagcacatggttttgttggtcgtgctcatgacaataaaggaccggttcacgattttcggttgtgaaacattaaccgtgccaaccacaagccagcgtgggcaacggctttaccttttgtataacatggttcattccggagcaccagactgagaagtggcggagataagcccacgggggtcgctggggagtccatgccttgtttataagggggtgattatgatccaggaacggtgagctgtggtggattgtgttgtgcgaggggtactgtcacagctcctttccgaggtactgtggtggtattgaggcgcatggtgacatgtcatgaggctgtgtcttgtgggtacagtggtacacctctggccagagcacaactattcgaatagccgtgcccgcggttatgggcgggtctaacaatgtctttcgtgattagtctcacacttctcatcataataaaagatgctataactggtaataatttgattagctcctggtttggaatggttaattcctggtttggagatagaactgtgcagccgagatgattgttcagaatgtgcagccgggatgattgttcagaatggttgggcctaagcaacagggtatgttgtatagcgttggattaatattgtttaattattacttaactgttttattaaattctgaaatgtttattaaatgctgtttatgcaaatgaaaccctactatgccatcctttgttatcctgtgcacttgcatatttgttgcgtggcttgctgagtatgtcatatactcacctagcaatcattcatcagaggaggagttctacagtgatgctgatggtgtggaagattaggtgtagccctggtcaagctgcctgtggagtggagtcgtcggcgccgtttatcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccggacgtgacaaattggtattagagcctccttgaccctaggttgtgccaaatggttacccatagaagccctctaaaaatattagaaaagtagaactgttctcttctctttctcttttaattaaaccaaactaatggcacatgcagtttataattcctttaattgttctcatttaaaaatttatttattattcctgtgttattagtaccgtacatctattactgtactaatggcccatttaccagcaaaagttttacaacattgttttatttaatcttgctgtaatgaaataaatttagcatgttgattttataactttcttttattttatttcttttgaaacctgttgttcaaaagtgcaaaatttgtaatcttgtttccaactgtttcaacttatcttgctagcttggtttactttatttacttaccttttactttgatttttctaactttattcaaattaatccaaaaacttgtgctattaattggataaaggtcttaactccctcctttcacttgtctttagatgccgcgctacaagcctgagtacttgtttggtgttgagcgatttgtccaggagttgcgtacgatgtcctttgccataggatttgggactgcccctttgtatgcccagattcctcatgatcgtgatgaagagaagtgccgagtcaaagtcaccttgaacagtaatagtgaagatatcccatcagtgatgttcgaagttggaggaggaaactacattcatgcatgtcaggaggtggcaaggatcgccataggagagctccgcgatcgctacagtgatcagttggccgacactgagtatcgctaccatcctcgccaaccccagggaggtgaccgtggcagctaccttgagactgaggggattgagaatgatgctaccacaaggcatttggttgagatactgtgggctatggatgagacccgcgcggaggttgtgctagcagctcaagatcgtgaagaccggaatcgtgataagatttgcaagctagaggacaatgtggattgtaacatcccggcctagggtttaataggattaatagaatactcataccaataagttgcaacttcttttccggaagccaatctccaaagaactccagggttaagcgtgcttggcctggagcaatttgggatgggtgaccgaccgggaaattctttccgggtgcacacgagtgagggtagtctatgacctatgaaagctatcagatgtaagtgggcccggcctgggggaggcgggacgttacatggatcgtttgggcccggcctgggggaggcgggacgttacatggatcgtttggagaaggaactagccgcattgaagggagaagcaccaccacaaaaggccagggttcgtcttaccgcaaggaagagagctctattcgtccctcgctaccaattggcgccaaaggttcgtgtggtggaaaaagaagctaccccaaccctagcggatcctccggtcgtcaacgtaagtgatgatgaaggagaagaatcgaagcgcacccactcaaaggtcgaatggggagctactcaagatgatggagacgagccgaacgagccttcaatcaactccgatgccggatgtaagcgcatgcgtttgtttgctttcgagtgttaggtagttggtgagtttagtggtgtgagagtcttcagttctgtaataatgaaactcagttaagatcaataaaagttaagttagtagaaaaattaattctctgtcctaagtagttttccccggtttctcttcttgtgctcctgcccatgccagatggtgctcactcgcagcatcgggaatggccccaacatcaacaataacaacaacaacaatggagagaatcccacacttgcccaagtcctggctcaacaggcacagcttatgaacatgatgatgcagcaacttcagaaccagcagaaccagggaaataaccatgcacctccctagaacaagttggcagaatttcttcgtgtgagaccgcccactttctctagcaccactaatcctgttgaagctggtgattggctgcacgccatagagaagaagttggatttgcttcagtgcactgatcaggagaaggtctcatttgcatcacaccaactgcatggccccgcctctgagtggtgggatcacttctgccttaataggactactgctgaacctatcacttggcttgaattcaccgctgctttccggaagacgcatataccatcgggagtggtgtctctcaagaagaaggaattcaagtcgctcacccagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgatttccagaagttagtggataaggctatttgccaggaggacaagtataaccgcatgaagcagaagaaacgccggattgctcacttcaaggcacaacaggggaatagtcagaagccgcgtcttcctttaggaccccagtccatgccacagggaggttctttgtctgttgttcgtccgcagcgtcagttcttcaacaacaatgctggcaacaacatccgcaatcaagctccactccctgttgcagctccaacacagcaacagcctgccaagaaggagcaaggcagcaagcctggagtgtgcttcaactgtggtgaaccaggccattactctgacaagtgtccgaagccccgacgcgtgaaggttgtccctgcccagagcaactctaccgcaccagcatcaaaggctcgtgtcaatcatgttgctgctgcaaaagctcaaggtgctccagatgtgattttgggtacgttccttgttaactcagttcctgcaacagtgcttttcgattttggtgctacacattcatttttatctatgagttttgcgggaaatcatgggatggaagtagaagatcttagatgtcctttgatggttagtaccccaagtaatcaagcactctctttgcaacgtagcccctcggtcagaatagaaattcaaggagtaccatttctggccaatcttattctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtttttaaggtcaagtctgaaccaaatagctttggaagagattcccatagtacaggaatacccggacgtgttcccggacgatttacctggtatgccgcctaaaagagatattgaattcagaatagatctggtaccaggaacaactccgatccattagagaccttatagaatggcagccaatgaattagcagaagtcaagaggcaagtagatgatttgcttcagaaaggatacattagaccaagttcgtctccatggggagctccagttatttttgtggaaaagaaagatcatacccagaggatgtgtgtggactatcgtgcactaaatgatgtgactatcaagaataagtacccgctgcccagaattgatgatttgtttgatcagcttaaaggtgccaccgttttctccaagatagatctccgatcagggtatcaccagttgagaatcaaagaggaagatatacataagacggcttttaccactagatatgggttgtttgaatgtactgttatgtcttttggacttaccaatgcccccgctttcttcatgaacttgatgaataaggtgtttatggaatacctagacaagttcgtggtggtctttattgatgacattctcatttattctcgaaccaaagaagagcatgaagaacatcttcgtcttgcactagagaagctgcgagaacatcaactgtatgccaagtttagcaagtgtgaattttggttgtctgaagtgaagttccttggtcacgtcatcttagccggaggagttgccgttgatcctagtaatgtggaatccgtaaccaactggaaacaaccaaagacagtttcagagattcgcagtttcctgggtcttgcaggttattaccggaggtttatagagaatttctccaagattgctaagcccatgacacggctgcttcagaaagatgtgaagtacaagtggtcagaagaatgtgagcagagttttcaagagttgaaaagtcgcttaatatcagcacccattttgattttgcctgatccaaagaagggtttccaagtgtattgcgatgcatctaagcttgggttaggttgtgttctgatgcaagatgggaaggtggttgcctatacatctcgtcagttacgtccgcatgagaagaactaccctactcatgatcttgagttagctgcagtggttcatgcgttgaagatttggcgtcattatcttttcggtactcgtacagaggtgtacaccgatcacaagagtttaaagtatatctttactcagccagatctgaacatgagacaacggagatggttggaattaattaaggattatgacatgggaattcattatcacccgggaaaggctaatgttgtagcagacgctcttagcaggaaaggctattgcaatgctacggaaggacgacagttgccattggagttatgcaaggaatttgaaatattaaatttgggaattgtcagtagaggtttcgttgcagccttagaagcaaagcccactctaatcgatcaggttagagaagcccaaattaatgatcctgatattcaagaaatcaagaagaatatgagaagaggaaaagctatcgggtatttggaagatgagcaaggaactgtatggttgggcgagagaatctgcgtcccagacaacaaagatttaaaagatgcaattctgaaagaagctcatgatactttatactccattcaccctggtagtaccaagatgtaccaagatctcaaggaaagattttggtgggcaagtatgaagcgtgagatagcggaatatgtagctgtgtgtgatgtttgtcagcgggtcaaggcagaacatcagaaacccgccggtttgttgcagcctttaaagataccagagtggaagtgggaggaaatcggtatggatttcatcactggtctacccagtacgtcatcaggccacgactctatttgggtgatagtcgacagacttaccaaagtggctcatttcatcccagtaaagacaacatattccggaagtcggttggcggaattgtatatggcaaggattgtgtatttgcatggcgttcctaagaaaatagtgtctgatcgaggtagtcagtttactttaaagttttggaagaaacttcaagaagagatgggttctaagctgaacttcagtactgcttatcatccgtagacagatgaacaaaccgaaagggtaaatcagattttggaagacatgttgagagcttgtgctttagacttcggtggaagttgggataagaatctatcttatgcggaattctcgtacaacaacagttatcaagctagtcttcagatggctccttacgaagcactgtatggtcggaagtgccgcactctgcttttgtgggatcaaacgggagaacgtcaggttttcgggactgatatcttaagggaagcagaagaaaaggtaaaaatcattcaagaaagattgcgtgtggctcagtctcgtcataagagttatgccgacaatcgccgcagagatttgagttttgaagaaggagatcatgtgtaccttcgtgtcacgcctcttcgaggggttcatcgttttcacaccaaaggaaaattggcaccgtgttttgtgggaccttataagattatcaatagaagaggagaggttgcttatcagttggagttacctcaatctctggcaggagtccataatgtgtttcacgtgtcacaattgaaaaagtgtttaagggtacctaccgaagaagctaatcttgaacagatagaagttcaagaggatctgacatatgttgagaagccaatccgtatcttggaaacaaacgagagaagaaccaggaatagagttatccgttttgcaaagtccaatggagtaatcactcggaagaagaatcaacttgggaacgagaagatgaattaaagtcagctcatccgcatctgttcgccagttcttccgaatctcgaggacgagattctgtttaaggggggtaggtttgtcacaccctaaaaatcctaaatatataaattgttgtttaattggaattattagaaatgattttaaaagtctagaagaaaagatctaattttaaataataaattccaatataaaagtgagccagataaaattttaatactttacttgattctatagttcctagatttttctgggatttatttgagccaaggaagtatttttaataaatggaattgtatttcatgaataatttaaattggaaaaggtttttaaagttcccttttggctttgtccctctctctcctcttcggcccaatcggcccagtcagcctgcagccgcccgcgcgcgcgcgctcggccgctgacaggtgggtcccacctgtcggactcgtcgtcctccttgcgctgaaaccctagccgcgcctcaccgtcgccggcttttcaattcgggcgtatctttcccgatccggtgaaatagtttgaggggaaatgctccccgggatcttctctacctttttccttttggaatcgatcgccaattcggtttggaaatccgtggactcatgttcgattcggatcgatctctctcctccgaaccctaaaccttccatcgcgtcgccggtcgccgtgg

SEQ ID NO: 27715 - DNA, 775 bp, Oryza sativa
  unsure (1)..(775): unsure at all n locations
nnnnnnnnnnnnnnnnnnnnnnnnnnnnnnnnnnnnnnnnnnnnnnnnnnnnnnnnnnntgctcttccccattttctcccgagccaaaagctatcagcaaaagtgcttggccaagaacttgcactgcctctccgccgaacccccggagcgacgttggtgccggtgcaagagtttgggttggcaagcccatcttagcatatgcttcggcgaagatcacgtcggccgaactccctccatcgaccaggattcgtcggacttcaaaaccggctatctcagctgagattaccagtggatcttgatgcgggaacaggactccttcggcgtcttctggcccgaaagagatcaactggttcacgtactgtggcgccccctcacccgccgaagtgatgctgtggaccatacggatctgcatcttcctctgccgtttcgacaacaggcttggcgggtcagctcttgtaatcacttggattacccttcgttgtgtatcttggcgttgttcggctaggggtatttgctcctgaactgcttcacggggtgcttcgactgttgttccttgctgcggccttgggtcttgcgcgttgccacgttgcctaatgtttaagcattgctccgtggtgtgcaaagagcgtccgtgaaaagcgcagtagaggtcttttcggaccttcttgcgggctggctgatgatggttgcttgcttgctgggcgtcgaacttcttgcggaaggcttgcacttcttcgacagccatcacagcctttgcccgccgatctgttctgaa

SEQ ID NO: 27716 - DNA, 562 bp, Oryza sativa
gctcaaagggtgggttgggatctgtgtgacgtgcctatgctggccttggaactctacaaattcttctcatgcgaaaacggactctccggaaaagtcggaatctaaacagaaaagagcagaatcaccaaaacagcacataaacaagcatgaacagtacatgtagatatttttaacatgtagatctcaattttagaaaaatttagagacttgaaccaactaaaactgagttaagatgaattagttatgattttttaaacattaaatcggattaaaacacttatatgggttttaattgaattatgacgcaataatgaattatttttgaaaaggaaaagggaattattgcgtcacaggctagggtccgcggtggaccgggtgcacaggggagactcacggaaacgaacggccgagatcgatcctatccacaacggacggccaagatctgacggtctacgaccggcctacgacggacggcaacgatgacgtcgacgatgacataatcactggcggcggctcgggcacgcaagctcgccggcgaacgacggcgcgacgacgcgaacgg

SEQ ID NO: 27717 - DNA, 18565 bp, Oryza sativa
  unsure (1)..(18565): unsure at all n locations
nnnnnnnnnnnnnnnnnnnnnnnnnnnnnnnnnnnnnnnnnnnnnnnnnnnnnnnnnnnataacttatgattcactattatttaatgatggcttaatgatagttcacgatggtcaatcgtgattggttaattaattaaattgccaactaaaacttgataatggtgggttgtgagcacatggttttgttggtcgtgatcatgacaattaaggaccggttcacgattttcggttgtgaaacattaaccgtgccaaccacaagccagcgtgggcaacgactttaccttttgtataacatggttcattgcgaagcaccagactgagaagtggcggagataagcccacgggggtcgctggggagtccatgccttgtttataagggggtgattatgatccaggaacggtgcgctgtggtggattgtgttgtgcgaggggtactgtcacagctcctttccgaggtaccgtggtggtattgaggcgcatggtgacatgtcgtggggctgtgtcttgtgggtacagtggtacacctctggctagagcaaaactattcgaatagccgtgcccgcggttatgggcgggtctgacaatgtctttcgtgattagtctcacacttctcatcataataaaagatgctataactggtaataatttgattagctcctggtttggaatggttaattcctggtttggagatagaactgtgcagccgggatggttgttcagaatggttgggcctaagcaacagggtatgttgtatagcgttggattaatattgtttaattattacttaactgttttattaaattctgaaatgtttgttaaatgctgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaagattaggtgtagccctggtcaagctgcctgtggagtggagtcgtctgcgccgtttatcttattttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaattggtattagagcctcctcagcagcttgcagaatttcctcatgctttgccttcccatcctctactcctcgattcagatctggaggtggcggatgtggaccttgcggctcttgtcgcccaatctgcaaagggcggatatgtccccttccccctgcgtctcccctccagaatcgattaggcggcttgaaaggtggacgcggcctccatcctccgccctgatttgccattggagagccgcttcttaccaccttcgcgaaactccggccgtcccctcgaacactcgccgtccactctcgccgtcgcccaccaccgcctacccttggccactcctccacttctctcacctccccttgcgtctcccccttctccaatctcctccacccgccttggaaccctagctcctcgagactagctccccacaggtggtgtagaaacggagtcaggagagtcgactcaatggtgttccaccgatctccaaaatcgccatcgttgaatctcgacacgtgttgcccctccacctctctctcccccactattggatcgggccgaaaaccatgggcttcctccctcccctgatcaaaaactctctcgcgcgccgaggagcactctcccaactcccgaaggccatcccctccgccacgaatcaccaccggcgatcgtcggagcgccgcaggtgactccctcgtcgtctctcctaggattgaagagtttctgacgccgcgggtgactccctcgtcgtcattgattagtttctgacgccgaattgaagagaggattggattactgctggcatatgaagtgaatcaatgcaatacgattcgtaatgagttagcatcccaactgcagagacaggtcacgtatatacgtacgtatgcaggccggcctacttccaaatccaaattccaatacgattatacaattcaccgattgattgatttaatttcttcctgcttcaattcgatcgatcgatcggcgtcgaccagaaattaatcgatcgagtctatctagggaccaatcgaattcatcgagttcgctcaatggcaactgctgctggtagatatgaagacagcggagtcagtgtctctttccggcggaaggcggcgtacacggcggcgtcgctgcttgtcttcctcgtcgccggccagctgccgctctatggcgtcaagaagtacaacggcgacaaggatgtcccggatcccttgtactggatgaattgcatgtttgcgtcaagcaataacaccctgatgactcttggaatcatccctcttcttctctccgagatggccgtccgcatcttctccgcactcatcatcaccaggtggccacccttccatcatgtgcgcctgtaagctactccctcatcttttttacagtacttacaaaaataatggaaggtgccatattctgtagcgtaaaatctggtatctcttgatacctccggtagtatgagtatcgctccacagagttcgaattcgttttttataagttgtataataaaaataacaaatataaccctaaatatctgcatagtagtttagtataattttgtttaacttatagaaatcgaatttgatttgtatatttgtaaagtgatcgatgtatctcaaaattgatctatcttatcaatttttaaattattttttatcatttaagtggcatgtaaaaacgagaggatcctctcaaggatgaaattccatctccaatattagtaattgtttttttttggaactaacatgcatattaattttgtttgattaactaacatgtctgcatggatgcgtcatgcttgctctatatattgtggagattatggataccccatatctacatgacggttgtaatttagccggatatacggtaccaaatatagatggaatatctctataaagactcgggttaggttctaaacttatatgtcaaggaaatacccgggatcttagtcggttactattgtattttatctataatcccatattgcgttaggatatggactgtattttgtaaagtggactccttcccctatataaggagggtccgtgtgcctcttggggggcgattctttttccagtttatacaatcaataacacactcggcggaatcatccccggacaggagtagggtattacttcttgaataaaaaggcctgaacctgtataaaattccttgtctccaaacccattcactttcctagcttgatagctacccccttttattattgtcgaaatcttgtttcgacagttggcgcgccaggtaggggcagcgtcaagttatcgccaactaagtgcgatgggtttcgtttctggcatcgacgacttcgcctttcctcccgggtaggcgttccggttcggcagcctcaacttcatcaccaacgacttcggcaagatctctctccttgactcggattcaaaccagtcggggagagaccaggtccccgtgccgttcggtattccgaactcggccgaggcctactccaagatcatctctcccgagtcggcttcaaaccactcggataagatccaatctactcttccgcgaccagatcaagacgacgggtcctatccctcaatcctgatgaaacttcctgatgatttggccgctgtcttcacagtcaggacatctcccactcgaagatctaggcgagcttcggccccgatccgatctagatccagggaggttggcgttatactccaacctctcgggacagtctcgacggaagagttggatggctacctcagctcccccggcgtcagttctcgaccaaccgagatcctcgactacgacgatttcagctaccactacgaccacggcgacctcgacaacttcgacgacagctatgaggataactacacgcccctcttcttcggcgtattcatggctgacaacgaaacggaggaacagcgccaagcccaagaagcggaccaagatcgcgcacggaaagaagctgaacgtcgccgactggaggaagagcgacagcgacaagagcgagaacgactacagcgtgagcaacaggatcgcgaacggattgcaaaagaggctgaagatcggcgacaacgcgccttggaatctgggcggcgagcgagagagctcattgggcaacaagacgtggctccaatcggaactggagaaagggaaagaagccagggccgaagttgatcgcttgaaggccgaactggagaaggagaaggcccacaccgccgtgctcatagattattacaatctcaccgagccgaagatggaggctcttcggcaggaggttcgcaaggccgaagcaagcgctgcagaggagtcgcggcggttttcatgggagatggtgaaaaccaccgagtccgcacggacagcgtgacaaacgcttcgcctcgcccttactgacatgggcgcaaaagtgcggggtgtcccctccgaagatgcatcagccttcgacttctccgaatggacccaacaggctggtggttcagtttctgactgcgccaccgcatacagcgattgctgtgcacgcgtgtcagcggcctttaccatgggcctcctgcagcagttcggctgcgagaacatcgccgagtttcccaagtacgcaaagggggattgggaaatcagtgcgcaagacatttcgcccgcgcttcgtgcgtggcgaaaacaattttggcagaaggacgaccgctccgccgctaaggcgcaccttttggcgcagctggcgaaagcagaggcggtggacctttgtgaagatgaaggcgcggcggctggagggggtggaggcgatgcccgggaccacccagaggtgtgaggccctccgcccttctcttagattttcatagttttcttttggtgttcgctagatgtggcaaaccattgtatattcggcaaacttccgctaaaccttaaaaaaggctttttggtatatttggaatgtatgacacaatcttaattactttttgatgatcgaagtctttggcatatttttatttcactcgtttcacattatgccataccttccccttctttcgcctattcttaccatgcaaaatgtgttttgccttttctgcactgtctaccagggggtctgctgaaaatcgtgcattcggcccccttttgggagctggcgaggtcaaaacgagaaattcgtggcattgaaggggctgtcgaagacgcgatgtccatttcggccattttatcacgaaatggagataaacggtcgcagctataaggttatcaaggttgccaactggctacgtgcgcaccccgggtgaaccttagaagattacgatcttgttcactcaagacatttggaagatatggctcgcttttggcgaaaccatcagaagactaaacgccaggaatcgatctctcagcgtcgttacagtttagtctgtgtttcgccccctactattcttaaggttgtgtatgatattagtagtgatgacgaacctagttcgtccgaccattccttagggagggataatgattactggggcgaaaatgtaatttacttgtaaaatgaattgtatcgggttgtaaaccttgtattcttcgattatttttttgaagctaataaagaacgtgctttatttccttttcgctatttttcgcatcgtcacattttgtgcttttgttaggccggaacatgccggcccctttgcatatattagcgaaataggtgtactgacttttcagcttttcgtcgttcattttcgatctgtagcattctgtgtcgagagaaacgcttttgcttttatgttgatcggtcgtaacgtcattcggctatttattttccgagacaagctgttgcggtttcaacgttcggcgagcaatgcttcggccgattcgtttcgcccccctggcatttttcgctgatcaggcgcttgccttggggtttttccacaaattatcaatcacacgaaaagaaataaaaagaaggcggaggacacagagattttatactggttcgggcctccatggtggataatagtcctacatccagttttttttttctttttctcttctctttttttctttttttttcttgccgaaaggcttacatagtgccgaaaggcttacatgacagtatgtacatttttacaagttggcgatttgggtgccacccattctagacatagaagcgcttgagggaggcgacgttccaggaatggtcgaactcctcgcctttgagtgtcgctaggcgaaaagatcccgtcgtggacttgtgtttgatgatgtatggtccttcccactttgattcaagcttgccaaccgctactgggttcgcctttttccttaggacgagatgaccaggcattagctccgtgggtcggacttttttgttgtaagctgccgaagtgcttgtggcgtacttgtgcatatgctcgagcgcttcgacccttacaccttccaagagttcgagcgatacctcgcacccctcttcgcccctagagaacataacccttggtgagttagcccctagctccgctggggtcattgcctcatcgccataaagaagcataaatgagctaaacttggttggtcttgtgggggtcgtccgaagggcccaaaggaccgataacaattcttctggccatttgcctttcaccgccccctcaagtcttttctttagtgcttctaggatcttgccatttgtacgttcggccgccccatttgactgtgggtgcgcgaccgacgcgaacctgatttccaggttaagcccttcgcacatttctctgaacttatcagagtcaaactgcttgccgttgtcagtaatgaactcttttggcactccgaaacggcaaacaatgtttttccatacaaacttctgtactgcggccgaagtgattgccccaaggggttcgacttcgatccatcgagagaaatattccacagctacaattgcgaatttatacccatttcgcgccactgggaatggcccaataatgtccagcccccatctggcgaagggccatattggtgcaatgggctgcagatcatactggggcacggcttggcttcggccatgacgctggcaactttcgcacttcttgatttgctcaacacagactttcaacacagtgggccaataaactccttgtctaaatactttggaggccaccgttcttgcagcctggtgcgcgccacatagcccctggtgtatttcctttgccatttcttcgccttcggcaaaagagatgcaacgaagtaagggttgaagtaccccggagcggtaaagctgacctgagaccatcttatacttcgtggctctgtgttgcaaacgcttcgcttctgcttcgtctaccggaagccagccagtttcaaggtgtttcaccaatggggttcgccagtcatatgggtcttcgcccagtttctcttggtcgattgtcatgacttccgagctgtccatgggcacacttggagcatgtaggacttcgaaaaagatgccaggcgaatgcgggccaccacaagcagcggatttcgccaaggcgtctgcttcctcgttctggtctctaggcaagtgttcgaccgttatgccggtgaagcatttttccatggaccaaacagcctccagatacctcttcattccctcttcttttgcctcgaaggatttgtcaacatggcctgctaccaacttggagtcagttcgaattagcaggcgccggactcccagtgctttcgcctttcttaggcccaggagaacggcttcgtattctgctgcattgttggttgtgtcgaactgcaatctcgccgcgtaccaaatcgacacaccattcggcgaaaagaggactgccgcaacgcctgcagaaccgtcagagcacatcacccagaactggtcatcgggctcggggtcgggggcaagtactggtgtccattcagctacgaagtcagctagcacttgagacttgatagcagagcgtgcaataaaatgcaagtcgaacggggatagctctgccgcccacttgctgagctggccagtgacttccttgcctcggagtatttcgcccaaggagtactgtgatgggactatgactttgtgggcctggaagtagtgcttaagcttgcgcgaagccattactagagcgtaagaaagcttttccatttcaatgtaccttgtcttcgctccttgcagtgcttcggagacgaagtagaccggtttctgtccggactctgtttcttggacgagtgcagcactgactgccaccgacgaagctgccaagtataatagcagttcacttcctgggggtgggcttatcagagctggcgggctttgcaagtattgttttagctcgtcaaatgctgcttggcactctggtgtccaattaaactttcccgcgccccggagggtcttgaagaagggcaaacctctttcggccgccgttgagaggaatcgactgagtgctgcaattcggcctgtaagcttttgtacttcatgtacgcttgacggaggcttcatttgctggatggcatcgattttctcgggattcgcctcgatgcccctatcggaaacaaggaaacccaacaacttgcctgcgcggacgccgaaaacacacttctccggattcagctttatgcctgccgcgcgcaagctgtcgaacgtctcttgcaggtcgaacgcatggtcgaaagccttgcggctttttacgacgatgtcgtcgacgtaagcttccacgtttcgccccagctgcttgccaaggaccttgtacaccagcctggcgaaggttgctcctgcgttccttaagccgaaaggcatcctgaggtgacaaaatgtgccaaatggagtgatgaaggatgttttggggatgttgagcgggttcatgtggatctggtggtaaccggaatatgcatccaggaaagtcatgagctcgcatccagctgttgaatccacgagctagtcgattcgcggcaaggggaaatcgtctttcggacatgccttgttcaggtctgtgaaattgacacacatgcgccatttgccatttgacttccgcaccagcactggattcgccaaccactccgaatggtcaatctcttgaataaaccccgcccggagtaatttttgtacttcggtcttcgccgcttcttggcgatcggcagacatcttgcacaacttttgctttcttggcttaatattcggcttgactgctaagtgatgcatgatgagatctgccgggatcatcaatctgcacttttgttatcttgccgtgaggggtgggcttcagcatgtgcttgggccgctcatgcggttcggtctcaacattgtgcactgctctgttgattatggctagatcgcgttttgaagcggccgaaggctgaagccccttgactactatcacccctgttgggccaggcatcttgagcttgagataattgtggtgggaaatggcttcgaacttgttcagggttgcacggccgaagatggcgttgtagttgtatgggatgtcgacgacgtcgaacagtatttgctcttcgcgcctattttctcccgagccaaaagctatcagcaaaagtgcttggccaagaacttgcactgcctctccgccgaacccccggagcgacgttggtgccggtgcaagagtttgggttggcaagcccatcttagcatatgcttcggcgaagatcacgtcggccgaactccctccatcgaccaggattcggtcggacttaaaaaccgctatctcagctgagattacaagtggatcttgatgcgggaacaggacttctttcggcgtcttctggcccgaaagagatcaactggttcacgtactgtggcgccccctcacccggcgaagtgatgctgtggaccatacggatctgcatcttcctctgccgtttcgacaacaggcttggcgggtcagctcttgtaatcacttggattacccttcgttgtgtatcttggcgttgttcggctaggggtatttgctcctgaactgcttcacggggtgcttcgactgttgttccttgctgcggccttgggtcttgcgcgttgccacgttgcctaatgtttaagcattgctccgtggtgtgcaaagagcgtccgtgaaaagcgcagtagaggtcttttcggaccttcttgcgggctggctgctgatggttgcttgcttgctgggcgtcgaactccttgcggagggcttgcacttcttcgacagccatcacagccttgcccgcccgatctgttctgaactttctccaagtcatgggggcttggccttgccttggcggctgtccctggatcgccggctgagactggcgaactgataggggaggtggttcgacaatttgaacttgtgcttgagcttgagcagcggcgacgaaggctttatcgtactcagcttgtatagcttgccgtcgcttagaatcctcctcgccccttgcgaacccgtcagtgatgcgaagtaggtgctcgagcgtctgcggctccttgttggcgatttttcttgttagttcgccctcaagcagaccggccgaagcggcgtttataaccgacgcctcggttatgtcttgaacttggcaccgggcttgcgagaagcgacgcatgtactcccttatcgactcccccggcctttggcgaatgccaagaaggtgttgctgcgtcttcggctcctcataggtgcctcgaaagttaaggacaaaaacatcgcgcaattgctcccatgagtaaatgctattggctggtaaattgaaataccaagaacgggcgatgccgtctagagcgagatgtattaccatcgccttggtattttcatcaccatgagccgcttcgatcgctgactcgtagatggagaggaactccttcgggtcagtttcgcccgaataacgcgggacaggtgggaacttgaactggggcgggattggacgagtcttgattcccccactcagcggcagccccttttcgcctcccgccctgtttaccgcaccttgctgcgggtacggtgtggcgaagggcgaaatcgtggcttgtgcgtggagttgggccgcggcattcgactgcccggctccaactggtggtacttgctgggccgccatggatgggtcaaagattggctgcgaccacatcatggcagcttggattggtgcttggtttgttccgaagcctggggttggaacttgctgccaaacggttggcacctgagcagtgttgccgaagtcgaactactgtccttgactccacggcgaaggtcccgagcctggctgaatcggtggcaaccaattaggcgcaccttgacttgtattccccaccgggtgagccgatggggttgtacttgaaatgtagtggggttggttgagttgctgaaggaaagcttggagttgcgcctgcagagccgaagccccttccgccactgtttgtgtcgcttggccaggtggttgatgctgcccgacgaagtacaccggcggctgtgcggctagtggcggagagggctgggtcaccacttgcggccggacttgagaaggggcatagcctgccgaatactgaaggattggagccgacgtggccttggtccgccttgtcgcctcgtatgcttgttgttgttctagcatttggcaaagcatgtcttggagccgtgtcatgttctgccgcatggcttccatgtcggcttcggcttgcgcttcggggtccaggctgatttgggcctgtacaacggcgagcgcagttggcgccgccggctgtgatggggcggcttgaggcaccaccagttggtttgtcgaaaggatctccgccctggtctggagtgctcttgccgccgcagccgccttcgccacgtcggccgtgttcggcacttgcactgaggttgcgggggccgaagacggttgtgatggcgcgggggccgagggcgactgtgatggcgcttgtccttctacatcttcggtcacggacgccgaaggctctgctccttcctcggcggccatgtccggtccggcgtcgctctccttccacctgacgaccttctccttcacgaccctcttcagtggcattcgctctcagtggtttcgttcggactccccatggtcggcgccagctgttgtcgaaacgacaactgcgtacgtcgaaggacgtggttactcaacagtggttgggaaaatgaagtgtactaaattttgaatttcacttgggatcccccgttacatggcctagggggctatttatagccctattgcaggctcttactactaggatctaggttgtacaggggaatttacatgattacccttatgaaagggacatttacaggggtacataatgttatagggtctcatgggcccctgatgggccgtctagtgatcaccggcccttaggcttgatgggccggaaaggcttcctcggcccttgcgggggcgaacttgccatggcgaagtcgtcttccttcggcagatagtcttcgccttgcacccttcgcccgagacgcccctggcttggcaaggccctcgcgcgactcttcgcctcacgccgttcttgctccatagccttcgccacgggtttcggcagatctggtcgaagagcctcatgccatccgccaacaaacgtgattttagaaacatttagaaaaaaataatctaatttggagtttatataagtgcggtaaacttgttttaaattttattttaatatacagctccttaagacgcccgtatgtaaaaatgagtttatttttgcatgcggaccttttaagaggcccgtatgaaaaaatcaatttcttaatcaaaattagctaactattgcaagaagaggaataagtctattttccctcgctaatgtcttactcttgattgaatcctctccctcaaccacaaaattggatataagaaaattactaacactaaaatttagaaatgttgatatgttctattagaaaaaataacgagctatatctcttccttgatttgagaatctcggtttgaggggttttttactttgatatttatttgttaccgtattcgttccgtttcgtattcgctccgtatatgtattcgacaatattcgattccgttttcgtatccggagtttccgatttcgattccgattccaaaaagaaaatatgaaaatgaatatggtagagctagtttccatccgtatccgttttcatctccaatgacatcgatcgatcggtagccagatttggctcctttttcttgtgcgcgcgcgggggatcttgttgtcgagtcggatccgctcacttttgatgggccatatgaccatttgggccagagtaggaaggcccattttggaagaaagttacacctctatttggaccaaatattctactactatatactacggtgtatacgcatgcacagtgtacgtataccttatgcgtagttttagccttagaattactttatgcgtctactttgccattttagtttttttaaaaaaaaaatcttatgtgttccgtgaactagcaaatgtatgtgagtttgaatggcaagtggaggttcgctgctggtttgtgaaaacgctaggggattaattaatattgccaagttttaataggatttcttatatatttatcaaagtttggtaagaaactaaatggatgcacatctttaataacttttatgaaaaaatgatatggtttaaaataacataaatatggacaacccttagttgttaattttattcacctcatatataaaaaaaatctagataacggctgtaggaataggataacttgaaaggtatatgttatttccatcaaaacggttggacaggcatgcggcacgatttcctactaagcggtaggcggcggcgggcggtcggctgcgccctcccctctgccagagggaaggcgggaggcggcagcggcagcggtggattttgtttgttctttttttttagaatttgtgattcatggtatggatctgagatatataatctgtgatgtatttgatttgtgatgtatttttttggagaattttttatatgaacttatgatttgtgatgttactttgattttaggatatgtagggcactcgatttgggaaaatcatgtagggatcaactcgaaggaaaaatcaaaatgcaagcagcaaagaaacaatgaaaaaaaaagaaaaaaatgatgaccaaccgggactgccactaccatctttagtcatgattggtaaacatctaactttagtcccggttatttcacccgggactaaagatggacgaccatctttagtcccgggttgcatttagtctcggtttgtaatataggactaaaggggttgtaaaccaggactaaagaagagttttccgggagtgaaagtaaacgatcaaatatattatttgaatgtatagcaatgcattggattttcagatggaccaagcggctagtaaattaatcagacaaaagtataaacgtgatttttttatcattatttgaacctttttaatttttaattttaaaataaaccatctcaaaacttattaccaaaatctaaaacttttggtgtaacaaaacaatactgccaccagcgggtgtggcagtttgccatgacaacgccatgctgttacattagctataccgatgtggccaaataacattgctacgtcatccacatcgatatgggagtattattttaccacgccagcctatcttatactgtggtagtgttgttttgtcatgttagtctgactggcgtagctaatgtttctgattttgaaaattagttttagaaaaatttattttaaattaaaaatttaaaaggttcaaaaagtaaaagaagttctagaaacatgttgtagacacaaaattaacacgcgttattgattgcttcaatttcatatctagcgccaacatggcagcatgattaatgacgcattttccttaatcccctttggcaacttaattatatccaactaaaggataaaattcaagtgaggaacgaggatccccaaaacttagcgaagaaaattatcaccagttatttctttttaataatgaaaatgtattacatctctgccatctgtcataaggcatgcaaccaattagttcttattaaaataaataaaatgagttgtgggacaaatctccagttaccttgaaaaataaaagcagatgacacactaaaatgatcaccagttaattaattactagagaatggaacaatatatacctccaaaattatagtacgtcgtgttaaattatacaaagacatacatgtgctccatgtgccacactagttgggagctgcttctttttttatttatttcttgtgaagactgagctgatagattaattagtcctcttattttgtttatttcagtttaatcaaggattaatgactcttcagccttgcaaaggccatcatatcgaattaatgacccatactatttttaatcgcaaaaaaatgtgaaaggaatgatcgatcgatatcaataaaacttaaggtttttgtataccatttcagatgagctgccacgtgctaccttgctactgtagaaactacagtccttgcatgctatccacaccgttcgattgtggctgcaagcatctctgcccttgagcgtgtcttcccagggagcctcggctgctctccaggggacccccatttttttccccatcggttgattcatcccccagcttctctatttgcacgcagttcacacgcttcctccgtcgatccatccagcgccgccggtggcatcgccgcctcccttgcccagtgtgttcttgcgtcttctttggcttagctgtggacggccgtggtcttctgctcggtggcttcgtctccaccatctccattccatccgtcagaggctgtcgccgtccgcgagtagcagcagcctctcctctcccagtgacagtccagttgcgccaccaccgacgaccttttgccttaccggttggttctccggtgcccattgccatcgtgtgcgggagcaatgccctctttttcccacggcagtccaggcaagaaaatccttctatccccattgttgtacagaagaaacccttaggcctttagaaatgtcgttctttgatttattatgtaccattgtgacagattcccttaacctgtatttttaatggtgcaagttacttattatcaagcatgtgattcaataatccctactgattaagcatttaattgaatttagcctgctacagtggttatgggatggttgcctgctgcccccaagtccacgacatacacatattaaagttgtccatatttaggttcatgcttagctttccataatactccattgtgtactcatctgcttgctttatgattttgttttgccattttgtataaatatctaggagtggtttggtgatggggatggatgcggtgcctgacactctaacaccaacaccattttctcagctaacttagggacaaatgagacagagaacaggccaggtgctactcctacacattattcggcatattcaactttctttgctttttctcaattctcaactacagttttcttatgttgagcggaaaacttattgatgatttatttctttgtgttctaagtgctccaagcagtgaaagctctaaccctaccatatcttttatctcaactcctgaaataggaatctccatgtcagtgttttgtcgtccatttcaacgacccgttaacaggaggcttgcatttaaccctatcaatcctgctactccaatagatcaacattttgtctcctcatcagatggcccaacagtgccaggtgttcagtcccttcctgcagtgcgcggtaaaggtaagcccctctattaagaattaatctctatttgattgtgctcaagcttgctatactaccattgtatcattttagattcataaatgccagttcaggtacctgtgcnccatagtgacatatttgttccctttgtgtctgctcatataaaatttggatgcttctcacattggcataggtcctttggataatattggtttgagactgcctcgaccagatccatctattgctacggaagcacgcaagaagcgtaaagtcacaatggttttaaggagaggacataagttacccatatccaatattttctccttcaactaactggcttatttgttgcttccattggttcctacatttctatttgatttcgttcagcaagtgctgattcgaccaatctatagctcctcaatttgtgattgttacattaggagctggacctgatgatttctcatcttcatatcgatgtgttcaacgatgtatttccccacaagttaatgccaggcattgtgatgtgcggatagccaggaataatgggatgagtactactattggcgcttctccttcatctcacattgcccaaaatgacacctccttgcatagggtgaatacatgtcaacgaagccgtgtagggcggtccagagctgatggtaccttatttagtttgctatgatttttccttatttttacctgtttgggaatatgtgattacatttggcattttctgctttctaggaaattttgtaccccttcttgccagtcgacatcgccgtaagttcttttcttgcacatgctttgatgcactaaatttatacataacatctgcatgctcaagacttataggggtgttcccttattattaccagctgatcatgatgctgctcgatattcaggctcaacctccacagttcatgttccgaagtaatttttgctgctcaacactaatgttctatctcgatgatcgtaaagcttctcgacaataatactccacccaatgatcttttttctatggtgaaaccacttaaccatgttctaatttatattatatcatccttttacaagattttccattctaatttttctcttattcctttctattaggtactattttcacacctctcaatttaggaggccctacccatacttgccaacattgtggtgctcgattctggtatgaggaacgcgtacgtgggtgtggacgaacagctttgcaaatttacaacaaatgctgtagaggagggagcatttatttgcctccatataggccaccaccagaacctttgctctctcgtttaactggacgagatcgtgttttgtccaaccacttctttgaaaacatcagacgatacaattctatgtttgctatgacatctatgggtgtaaatatcatcaactcaattaatgatggtcatggcccttacattttcaagattagtgggcagctatgccaccgaattggatcgcttattccaaagcatggtgcaagaccagaatattgtcaattatacatatttgacactgagaatgaaataagaaatagagtggctgttgcttcacatagagagatgagttttgaaccaaatgaggatattgttgcatctttgatgtccatgctcaatgcacacaacccagttgttcagctctttcgaactgctcgtgataggctgcatgatcagttaggg

SEQ ID NO: 27718 - DNA, 2216 bp, Oryza sativa
ggatattgttgcatctttgatgaccatgctcaatgcacacaacccagttgttcagctctttcgaactgctcgtgataggctgcatgatcagttagaggatcattactcagtgaagttatttgccacccccaatgaacatggtaatatctactcagccccagttgcatcagaggtggttggtttgatggttaatgatataagcactaccgagaaaggtcgtgacttaatagtagaggatcactcattgcagcttcaaagggtaaatgaaactcattgcaaatttatggcaatgcaatacccgctattgtttccttatggagaggatggttttcatgaaaatctcaagtatagacaatgtcaccgctcaggaatgatcaaacggaagaaagttagtttggtagaatactttgcatatagattgcatgatagagatgatgacttcaacaccccattgcgttgcaagaggctcacacagtcatatgaggttgatggtttttgttgtgtcaaggatagccgcttgaaccattataggaaaaaaaaaacttttcagctgaagtataggagtagcccctataaagctttacttgatacagtcagtagcggcattattgatgcttcatcggtaggccagaggattattttgccaggttcattcactggaagtccacgctattactaccaaaattaccaagattgtgtggctctctgtcgtagatttggatgcccggatcttttcatcacttacacgtgtaatgctgcttggccagagataacagaagctttagcatttataccaggacaacaaccttctgatcggcccgatattgttgatcgagtttttgaaatgaagctcaagctgtttgttgatgatataaaaaaaatatgagttctttggtcccatactcggaagttagctcgtttaattactatgttttaattcttatgttttaatatgagttcttatgttttaattactatgttttgtttcagttttgtttacctcaatattttttttcagttgtctacacgattgaatttcagaaacatggtcttccgcatgtccacttgatagtgtggcttaaaaaggatagaccccttgatgccgatcagatagacactttcatatcagcgcagttaccagacccatctattgaccctattggttatgaggctgtctcacaattcatgattcatggtccttgcaatattccaggttcctcttctccttgcatggctgatggtaaatgcactaaattctatcccaaggaattttctgacaaaacagttgtgctacctaatggccatgttaggtatgctcgaccaaataatggaatcatacaaagaaacgtggcattgagattgataatcaatttgtggttccacataatgtagacttattagttaagtatcaggcacacataaatgtggaaagtgttaatcgtgatggtatggagaaatacatgtttaagtatacaaacaagggccctgattttgctaaagttggaatcaaaagaaaaagatacccccggttcttctacagaggaaataaatgaaataaaggaataccttgaatgtagatgtgttacaccacatgatgcagcttggcggcttttgcaatttgatatccatcacaccgatccagccgtggaacgtcttccagtgcatctcccactagaaaatggtgttgtatttactgaggatgaccatcttcaccaggtgattgataatccatgcaatctcataacaaaattgactgcatggtttgaggcaaacaagacatatccagaggctcgacaacacacatttgtagagttccctgaacattggacatggcatggtgatggaaaattttggaaaccgcgtcgtaatgcccgtggaaaggttggccgtatagccaatgttagtcctaaccaaggagaaagattttatctgcgtatgctattgcatattataaaaggggcacaagacttttctgatcttcacaccatggctggccaactatacccaacatttcgtgctgcatgtcaagcattaggtttacttggtgatgattgtgagtggtccaatgctatggctgatgcagcacaatgggcattaccataccaacttcgccagctatttgtcacattacttcttttttgtgaagtcactgtagcgcccgttccgtcgtggcgcctagcgggaaaattatctcttaaaaaccctaattgcgaaat

SEQ ID NO: 27719 - DNA, 13953 bp, Oryza sativa
  unsure (1)..(13953): unsure at all n locations
nnnnnnnnnnnnnnnnnnnnnnnnnnnnnnnnnnnnnnnnnnnnnnnnnnnnnnnnnnnnnnatctcgtgacctcgtcgccgtttccctctttctcccgccgccggttgccgccgccgcaatccgccgccgtcgagcaacctccggcgaatccgagccgttggctcgtctccccttgtcacgtgcaaccgcccggtgtgcacgcttttgcccgtatcgccgtggttcgctccgccgctcgccgccgccggccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcggaccgcgcgcatgcaccgcgtccctttcccgcccgcgcgcgtgcgtcgcgtgctccctccgcacggtgagccgagccgctaacaagcgggtcccacccgggaccgcgcgtgatgagcccggtccaccggctctctctctcctccctcccgcgcgcgcgcgagtttgggccgccttgggccggccagcccatttagcttggccagaccgctccatttctcttgggccgcgccctagccatccgagaaaagtctatattccctccctcccttcttttctttttcttttccaaaaaaggatttaaataaatcctttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcaagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattcccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgctcgaacagccgtgcccacggtcatgggcggatgtgaggtgattcctagcgtagttttgtttgactactgcttgtgaaattgttgttgtgaaaaggggttcgatgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatccccccccagttgctgaagaagatgaagtggatcctactgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagtcaccgacccaataaaattgcttgaagattatatcaagccaatgggagaagatttggcatatcgtactattcggcccacacaaggtatctctcaaccattagtgcagcaacacattaggtcatatgtcttggatgaattagacaaattactcaaagattctggatatagcctaggtcacttcaacttgccagagccagaacaccatgattacaatgttttgaacaacaggttggtagtggatgagctctcttatgaccttgatgctactttagtagaagcaaatgagcaacttaacaataaactcaagtcagagatctatttatgatgccatagaacactcagttctgaatggttcaggtcacactttctttgtatatggatatggtggtaccggcaaaacatttctgtggaatgcacttctcaataatataagaagtcgtggaaagatagccttagcagttgcatcttctggtatagcagctttgttgttgccaggtggtcgaacaccacactcacggtttagaattcctatagatattcaagagtattccatgtgtgctattaagaaaaatacacatgtcgctgagctcatagaaagaacatcactaatcacatgggatgaggcacctgtaaaccataagcactgttttgaagcacttgatcgaactcttagagatatcatgccatcaaacaattgttatctaccaaacaagcaatttggtggtgtcacggttgttctaggtggtgattttaggcaaacattgcctgtcatcccaaatgcaaataagcagcagatcctcaatgcttcaatcacacgatcccatttgtggcagaattgtgtggttctccatttaactgaaaacatgagacttagatgcccaacactttctcaggttgataggattgaattagaacagttttctcactggcttctttctattggtgatggcacactacctaatagcatgccaacagatcgacctgacacaacatggatccaaattccagagtatcttttgttacctgctcaggaaagaaaccttacaggtttaatttcttttgtctatgagtaaacaccagatgcctcagaattaccagcctatttgtgtcagcgagcaattttggccccaacaaatgaggtggctgctgctataaatgctcagattattggccagatagctaatgaggaaatgtcatattatagctttgatacaattgatgataccacagctaactattgcactcttcaagacctgtatcctccagagtttctcaacacggttcgcatgagtggccttccagatcaccatttacaacttaagattggtgtcccaataatgttacttagaaatttgagtccatccaagggcttatacaatggaactagacttattgtgacgcagctcactcatcgtgtaattgaagcccaaataataacaggaagcgctaaaggttctaaagcttatatccctagaattgtttctgtttcgacagacccgaaatggcctttcaagatgagacgtcgtcaatttccagtgcgtgtttcatatgcaatgacgataaacaagagccaaggatagagacttagcaaggttggtgtttacttgccaagtcccgtgttctctcatgggcagctttatgttgccttctcccgcgtaacatcttcaaaaggattacgaatcctcattgaaaataactctgctgagtatgaaagaaagacacataatgttgtgtattctgacattttccatgatatattaagccaatgttgtcagttctccccagatacccatgtccaatagatcagctttcttactacaaggtatttatgttttacaatttatgctctggtagtctgtttagtataatcttttttatgcctgaattttccatattacatccagtagacaacctacacttgctaatgcgtttctcaatgctctttgatttattaaagtgtatctgtcatcaacggagtgcacaacacagaaccatcttcatatatatattttagtaatgcagtcctcttgcagttctatggttcttttgaaaggagtgacttaacaacaatacataataacaactgttgaatttatttcaagctaaagaaactgtagtgcttatgttgttcagctatgttttcaaagtagcttacttcctgttcacatgtaaattatgtgctttaagtcatgtatgcacatcaaattaccccatttcaatataaatttagcattcttaaatatggttcccaccacctcaggtttgatttttcttttgtcccaagttgatatatctgatttctatctttctacatatccaaccatcctacattcatagctaaacatacaaattagataagtaatatctaaacttacatacttctataatccacatggatatatggtggtaagttcttatcattacttattgttgatatagataagcacagttctaatgctcctctgctcatatgttaacatgagtaaccattttgttacattgtactgctaaattttaattctatttggacagcccattgttaaaagatattctcccctcaacttcctattgaatggtaataggaaatgtcccatttcttattgttttatgtagagatagagacctcaaattcacgtctcatactatcgggtaatgattgacaagtatatttgatctgagttcattttacttattgcagatcaagaatgacatataaagaagaatattacttaatattatatgagggaatttctatcgtttaacaaggtatgacatatgacactgaaaggaataaaatttccaatttataagctcaagagttaaactatgttcctatcagaactaaactgaacgatctatgcgctttggcttcattttagtgtttattttgtagctcctttacatggtgatgaaatttccattaggcgttgatgcaaaattcaacagcgcctactatttcaggattaccaagtaggtactgcaggagacgtgctcacatattatcacaactactctgttttgccacaaatgatgcctatccggacatgtgcaacttggttatctcttctgcagttctgctgattgatcctactgatttacagagcttcttaatgtatgttttattcttagtggttttgtatattctcatatgagtaggctgagatttgtataaacctaatgccatgcccaatgttaaaaaaacatgtaggatacgatttaaccctatgattgttgtactgaactttccatctaattcttccaatatttagtgcccgcggcaacgctcggggtatagagtagtataactatatcagcgtcatgctgtcaaaacatatctacacatgcatacatgtgtacttttatgtattttatgatttgatcgcatggcatctcttgatatggatcattatcatttcataattaagctgcagtggtatatatatatacatatactgtatggccaaggatagcatgccacgagcaaagatatttgacgtcgattaatctatatgcatgattcttgctctcacaaattctaacggtctcggggaataagccaaacgatatatttataataaaaaataatttataaataaaatttttatatatgtattattagcgatatataaaagtaaaggctgtaaaataaatttcgataaaaaaaacttaaaatcaactttaaattaagattgaaaattcaaattctggctggtaagcataaatataaatgcaaagatgaggctggttgatgaaaggcacgtaaagttaataagaacgatcgatccatatgaagctgaatcaatcaatatcagtctctcattttcggtgatctgcccgtacctggaccaaaacctgcatgaggttgatccaccaatgtgtatgcagcgaactgccgaggttcactcgctcacggtttgcaatctcgttttgggttgaaatgcgagcttgtttgtttgaatggacatgaatattatcactatctttccaaatccaattgacgactctgaataatcagatcgatctgtagtccatggatttatgcaggtgaatgttgatttcccacgcaaagtgtacgtagatgggatatttggatttgtataaagactttgacttttttaactgggactggtcaactaattaattggttccaagacttattgccaactgtactactccattatacaagaatatttttccttagtccccacaaaacaaatattatgggaaagagtgcaagatactctttatgggaagggacagaattttgcagaggattaatgttttttctctaactaattctttacgtaaatataaaattacaaaagtagtataatactatgttacacaaatgaatttgaccacatcaattttcacatatatggttaaacgcacccattatccaaaacaaataatcataatgattatggtataatatgtgtgtgtgtgtgtatatatatatatatatatatatatatatatatatatatatatatatatatatatatatatatgccaccttgccaaataaaatggcattactcgttgtgggcgtctgtgtttgtactgtgtttcttaaaaaaatgacagtatttctctatgcgaccgaatagattagcactatccccttcccccttagcgtatgacaccattaacttctgtacacatgttttatctttaaccttactgaaaaaatatgtaataataataatattttttgttgttatttatttttaccattaaagctgctttaagtatgacttacatatattcttttatatttacatttttttaataaaatcactgttcacgcactacaaatcgatgacaacgtatattagaaatggagtgaatatttcatcgtgtagaacggataggatggtgatgtgtagggtctttggttggagttggcttggctaactattccaattctatctgcaagctagcatggccggcgtgcgtgcaccgggatggcgacgtcgactttagttcttagaatgaaattattggtagaaatttggaatgcccaagggccaagggacaatatgctgtgagacgagaagaatctgccaactgcttgcatgccacaggcaaccgccggcaatgatatcattcatgggattttttttccttatgataatggaataaaaacatcggatattatttagtttaaaaaaaacatgggatattattttattatctgaaagtcacaattataagaaacacccatacccaatcatatgtacagtactaccttcgttttatattataagactttctaacccatatatatatatatatatatatatatatatatgaatgtaggcaatggtagaaagtcttataacctgaaacggagggagtagtatacttcctccataaaaaaaaactcaacttaggaggggatgtgacccctcctagtacaatgaatctggactaccatttatccagattcgttgtctcacatcccctcctaggttgagttttttttgggacgggagagtaagaatcactcatatgagaagggctcactcttaaccaaaacacagcaggggagtctcccatagtaaaaacactcaagtatcatattgtgatatagtagtaataatatttaaaactgtacaattgaactgacacatagtaacaaattacctgtagcagtataccactatacttgtatagacatgtttcatctattgcacatatatgctcattattaaccatctagcccatcgttaatctagtaccacctattttatatactgatctcaaaaaagtatcgacaatagacatatgttgtgctctcttcgtaaaaaaaacgaatctggacatacactatgtccgtgtatgtccagattcatttatagaagtgggttttttttttgacatagggagtacgagcctaaacaattctactctgatatcgatgtcccacaggcgacaacaaacgaatttgcgaagcctccatatcctgcataccataaataaatcaataggataatcccatatagtttttccccgattgaattttcgtagctgcaaacacttatttataggcagagagagagagggagagagagagctgtggcttgggcaattacgccacagctcactgaattcgatcgcctctctctctcgttgctgccttctggcaaaccatggccgtccaggttcaacgaacgcccctcccccggtccacgtacaccggccatcgggtctatctcctgcgggccccacctgcagtgacacggtgcaccgtggaccgcgcctttccgcgcagtcatggacctccccttcctcctctcctgtataaaacctcgcgtcctgatgcttcctcctccaactccacgagccgccatttcccaaggaggagcaaggattgttgttgtttcgctgtcagatcggtaggcagtgccccccctctctgttgtctcggattggattggattggattggagtttttctgggttgatgtggtgattttgagggtgatttttttgtgtgtgtgtgtgtgttcttgatttttgttttttatttggtttgtttcagattcctgacgggataatgggtgagaccatcgccaaggatgtcaccgaggtgagcgagcgccaaaatggtttcttgttcttcatcgtggtggcatttttttggattggtattgggatgtgatttgagagagaaaaagaagaagattgaatcttttttgtgatgtgctgtagttgattgggaacacgccgttggtgtacctcaaccgggtgacggatgggtgcgtcgggcgcgtcgcggccaagctcgagtccatggagccatgctccagcgtcaaggataggtgaagctctactgaaatttatcatcttgtcatgttagggtggtggattatgtctgaaaaatcggttatttgtggttgtttccggaatggagatgtgatttttctctgtttagttctcagctgtttatgattagagctcttacttgcatcttggattttgagatgaaattttgatgtgtggttgtgttgggtttgtacaggattggatacagtatgatcactgatgcagaggagaaggggctgatcactccaggcaaggtgaggattttttttaatgatttcggtgttctgtaccaatggaacagtttggtcttataaactagttgttcttcctgcatcaatgtgaatgttgttcatttatttatttgttggatcccactgcggtttgatagtatgttggagctgatctgctgatgaaagggcgtgcatagcagagagtttgagttgaccggcgcatgtgcgaaagctcaaataagtagttagattgataagaaatggaccattcacctactgcattggtctagatattttatagaaaatgaataaggtgttcctcgcgttatctaagtcagaaggcaacgaaatgtgatccccagctgtcactcgattgcataatcataagttatccgatagctgttattctgccatctcatgttgtggcatgtttccctaatttattcttgatgaagaggccactaaacattatttttgcaatggagataacctaatgattgatgcttgggcctagactggttttgtttagttgattttattggaaaaataaattgattttcttcattaaatggaaacctgctgtatggactgattagtactagatgaaccagcatatgtttctagctagttatgtacaatagaccttgtcttgtcttattttagaaatagttttcgtagtacttatgctattaaagaatagatgaccaagtaaattttttttcagccaaataagatcacggctccattgcatcactgaagtttttcgatctgcttgctctttataagaacaatcatattattttcaatagcagcatattttgacataccatgcttcttctagattaatatatttgccgtgtctaggagtcatgaatgatgaatgtggccttgtttgcagtattgttcgttttctcctgcatctaggtgttttatttctgcagatactttgccagttgaccaaagtaatttttatattgccagttgaccaaagtaatttttatatttccagttgccatctgcatgattcaattagtagcttaaagcatactccctccgtcccaaaatataacttttagcattcagaatttgtctcaaaatataacaacttcttcacctacattcccttctcaaccaatcacaaccttccaccattcaaattcaccacctactttctcttcccaaccaatcacaaaccctcgtccatttaatcccacatactttcttaatacctgtgtctaagcctagaactccttatattttgggaaggaggtagtatttaaataagggaattttacaatgctttttatgtgatagtaagttagcagtttttttttgttggtaaacactttcttcaaactgctagtaaagctaaatctattataacttccatatagttaagaacgcaagatctggctttactgatgttttgctttgtctgtcaatgattgccagagtgtgctgattgagccaactagtggcaacacaggcattggactggccttcatggctgctgcaaagggttacaggcttgtactcacgatgccggcctccatgagcatggagaggagaatcatattgaaggcttttggtgctgaattgatacttactgacccactcttgggaatgaaaggagctgtccaaaaggcagaagaactggcagcgaagacaaacaactcatttatcctccaacaattcgagaaccctgctaacccaaaggtgtagcatgatttaacattttaatacccttgtttatatttgtgttctgtggactcatactgggatgttattatgcagatccattacgagaccactggacctgaaatctggaaaggaacaggaggtaaagttgatggtttagtttctggtattgggacaggtggcactattactggagctggacgatacctcagagagcaaaatcctgatatcaaggtaaggaccagaaaagctctatactacagttttggtttgccacattgaataattaaagttccagcatttgttcctttaggaaaagaatagtatctgattttattttttttcttatgtaagatctatggtgtggagccagtcgagagcgctgtcttatctggtggaaagcctggtaataaggagtcatccattaattccatgtcatgactttatttcattttctggttgtgtcaataaaaaaataataaattgtttgccgcactttagttttcccacaacagccaaaagctaaaacaaaatctttgatttgtggttgtctgggacttagtcatgtgaatatcttgttgaggagggagagcagatttaattattggatggctgcattttgaaattggaattatcatgtggttgatgattgttgatgtgctccctaaggactcattttctgggttcaatagtgtatccttgtacctctcaatagaaaagaatatccttttgaagaagggatcttgtgaaccatttacttctaatgcagggccacacaagattcaaggaattggagctggttttgttcctggggtcctggatgttgacctcatcaatgaaactgtacaagtatgttatgcttctgtattaagttgagctgtagaaagacatatatataatttagcaccatgttttttttctctcacttgatccatagctttacttttcttcattcgaatagtagtcggtactagatctatattattcatgatgtcttagcaaatatctgcttcttttaatctggtatgaacgtttggtgcattgaactgtttgacaggtttcaagtgatgaagctatcgagatggcaaaggctcttgcattgaaagaagggttgctggtaagatttgtgtttgatgttcatttctgtgctctattattaatctgtaggtacacaaattgcttttgttaagcctctctatgtacggatcattcggatggtacctttgctgaagtcatcagtgatgtaaataattgtaggttggaatatcttcaggtgcagctgcagcagcagctgttaggctcgctcagaggccggaaaatgaaggaaaactttttgttgtaagcgtttcatttttcttacctctgaatttctaatgccctgtggcttaaagctacttcgactgcacctgcatttgtttatccatttggtattttagtccaaatgtacagcagtacagatatactccaaatttacactccagtgacctagaggaaaagctaacgaatctgagttcttgttttgtcattgtggcatctataatttcaattcgcatagaacgaactgccgtccaaaacaagcactatctccacatttgtcatgacccaaggccatgacgggataaacccatggacaacattgtcgatttgtttcatcatgctcatccccacactaacacctttccctcaatgtaggttgtcttcccaagctttggtgagcggtacctttcgtcggtgctcttccagtccatcaagaaggaagctgaaaacatggtggttgaatgaaatgcacaatatccgggaatccacaggaataaaagtttggtatctctgcttgtgtgattaaacatacattgtcctgccattttcaagttgttctgcttgtgtagcaatggggaacacagtgtgttagccttgtagtgttaaacagtttacattttatcttccctgtatatcagaaccctttacatgggcatttgtcagccagtgtgaatgaaataaagcatcatatgatttgtctcatgttttgggatctcgtctgaaccataatattcttataagagaacaaggccctgtttagttcacaccaaacttctcccaactttccatcacatcacatccaaaactttcttgctcacataaactcctaactttttttacagactatcaacttttcctaaacttctccctaattttaggaactagacacagcccaagtctcatgttttgggatctttctctgaaccacaaattctcataagagaacaagtctcatgttggatctttctctaaagtctgaaccataaatattctctcaagagagcagtagtgctctgaaaaatgacatcaggcccaaataagggttgtaccagtttatgggccatgggccatgactgacagagaaaatacataatagtagtactgatgaacattgatgctcctagtccatggtgctgctgctaactggcttttgcagtaaaaaggagccaacatcagtcataaaggtccaatgcagtctatgctcatgttccaggatctgttttggctgttgcctgttggcattgccagggtgcagtacaccatcattcattggtttagttacctgttactactagttaatgcacaaccttgtgggtaccgagctcgaattcgccctatagt

SEQ ID NO: 27720 - DNA, 4150 bp, Oryza sativa
tgcaagaacacgcatggcggcatgggtgagtttcttcagacaagtacaggattgagcttctcggccaccatgatttatgatttacagagctttaattgtcagtaaaattgcaagcatgaatatggcagaagagggccaaccatgtgcaaccaaaaaaggctccaacatgataaaagaacagcagaaaggtagcctggactagaccttcctttcctttgctttaacttttgagtggacaggaagactacaagcacagctgcatcattgttcgtcatctccagccatggaaattgtctcagtgtgcaagagtagagcctgcagagagatttctgaattgaagacaactttgtggtctgaaaaaatctgaaatctgcagggcattgattcatgcagtctatctgatctactgttgagcagaatttgctaccaggaaaacaatcagttatgattttgttgcatttgctaagattttgttgtcataagatcagatattaggtggactataacagttattaatcaagatatttaccatgtagcttgcaattttcaggtgattggcctgaattttagcacactaacaggaaacatgaaccctaaatctatctggggctcatggcatgtccaaggagatacgatttgcggttttgcaccccaccaacaaaaccacacaatgagaagctctcattccacttcagaaaagaatgacaaatactactataatgagaattatgaacatatggagaagaggccaaaaggggcatggctgaagtatgtgcaaagatcatagatggtgcaggatataatctaagaggcttgctctcattccatcttgcagacacattcagcaagtatcacagaacatagtctaagaggctgctctgaattctgatttccatcttgcaaacatattcagcgagtatcacagaacaagcatgctgcaagacaatggtgggataacaaaggtagcaaccacccattggtattaaactgatgatctccaacaactagcagattaatttctcaagttaaaaaacggctagagctaacaaagagttcatgacgcctaactagattctgctttcgttttctcagcatctaaggctgagagcccctaaaagctcaatgcagcagattgagatgtgattatcagctcacttctacgaccaaggagcccgcctaaaattcaatgagacagattaagatgttcttcactatcagcttacttctacaactgaagagttcctaaaactaaacgcaacagatcgagacgttcccgaccaccagttcacttccttgggtgtggaacagaattcctcagctgcatgaccttcttatgagaattggagtgtatgtcactcacaaaagttggactattagcaggcctgtattccggcagcagcctgccagacttgaacctcacaccgcaagcattgcatagcgtcttaggccccaagggaccggtcctccactgtggcgtcttgtaggacaagcaatgggtgcacctcttcattggctcctccgatagcagctcatcattcacataaacagccttcttgatcttcttcttatctcgccgctttcctatgtcctgttctttgtcaatctcttggccatagcgcttcttggaactggtggtgtgcccattcctcgcctcaatcctcagacgacaagcatcgcaggtaggccctgatggaccatcccaccactgtggtgattggctggacaaacaatagctacaagtgatcaccagttgctcctgctggaattgcattcctgcactcattttgtaattctcttcctcctcttgttcttgctcttggacaagttcttcatctttgtccttcttggggaggataagctcactctctgctagccagtccttatgatcgagcaggagtagcggtggctcgacaaacagcgtgatacaatgttggtcatcagtgtcgcttatgacagatgccaggctccttttcttttttcttgcattggtagatgagcgtggtggtaactttggttttgcagcaccttgacttgccattgtaataggcggtagttctgcagagacagggtttgtgcaggatgcagaggttgacaagcagtcctctacatagacagagagccactctatgccacttctatcactttcctgcaaagtaaagaaatgttagacaagattgcaatggcgaaaacaattatctatccatcttttaaaaactaaattacataacagtgaaggaattatagctttacaaagctctcgttctactagattacagcaagacatgcatggaggtccaaaatcaaaaaataaagttagctgaagcatggcgcaattaaattcctcaaaagttttttttttctgacaaaaattagcaaagacaaaattccaggggtcagtatcagctgtttctggtatacagcggtaacaaacttgaagttcatatatctcaagcatcaagaaatttatggcccctcaaagatagaatgtgcagcatctacaatttgtaattgtggcaaggaatacaaaactgccacagcaatcactcagttacaacttgcaattaaacactatagcgggcagtgggcacacaataggatcaattgcagtaaatgctatacctgcaacagaccaaaagaaactccaaaccaaaagagagctaggcaaccacatttcacatggggatgcaggcagtaggccctttattgaattctaacagtaaagctttagaattacacaataaaattgaacaatgcctaaaagaaattaggataaagctcagtgcctcttatcaattgtttccggcaacaataaaggtttttcacccgaattgacaaagtaaaaaaaattggctgtcgcaatcttgcatgcacatcatcccatcgacgaaagaagatttttacaatggacacgtctatgcaatgacagtgatggtaagggaataacatatacacacatcgatattgaaagtcacaaagcaatacatgcatttcttccctgtgacctcacaactaagccaaaaacaagatgcaagattggcatgaacatagtcttgtttattttccctatgaagctctgctggaaaaaagtgtgcggctgaatgaattgctcaacaactgtaaatatatttgtttctctatgaaccaaaaaaattctttccaatttataggtaggaaaaggtgaagaaaagggcgaggaaatgcagcacgcatgaataggaaggtaagatagttcaagaaacaaaggaaaatcccccattttcttctatgcaaacataatagtggagaaaattcatctaaacggtaaagaacacaagtgaaaggaaaaaaaaacccaaaccctaggtcctagaacaataatatcaagaaactagagaataggccaccacaaccgcaccaaattcttgtaccaaaaacccccaaaacccccaacacaaaaactcccaagaaatccccaatttagaaagaagaaaaaaagaaaatccccaaagaaaacatccaatactccccaagaaaaagaaaccatcttcctccccaattcctcctccccacggaagagcaacccaaccacgcccggttcttggcaagaaaaaaaaacttataccaaagcacacatacacacacacagcaacagcaagaaggggggaaagaaagggggaagcaacaaagctaggaggcccggagcactgaccgtggcgggctggtgcgggaacaactcctccagcgaggaggcggccgcattcggcgggtgcacatccatgcccagcgacgaggaggaggcagccgcacggttgaggagagagaaagagagagagagagagagagagagagaagcggaggaagaagagggggtaggtttccgcttggagaggggagggagggtttcgcttttatctgagccggattgctctggctcgctcagtgagcccagccgtcggctcgtgagccgagccgagcaagtactcaatactggcgataatactggcctgtttagttccgaaataaatttttcatgctatcacatcgaatgtttgaatacatgcatatagtattaaacgtagacaaaaagaattaattacacaattcgccaggaaattgcgtgacgaatctttgaagcctaattgcgccctgatttgacaatatggtgctacag

SEQ ID NO: 27721 - DNA, 4647 bp, Oryza sativa
  unsure (1)..(4647): unsure at all n locations
ttgttgatcctctggcgacggaagcgttgaaaagcgcgatcattggctcgctttgtcgtccctttgcagattgtctgatgagcactaaggtggagagcaactcttttggctctgctctttgtgtcgccgcgcttgtgcaatccaacaactggcggtttgcgtctaacgagctggttaatgatgtctgcttgaaagtctcaagggccctagaggaggcgcatgctcagagtatcgcgcacttaaacttggtggttgttttgctgacacaaaatccactgatgcttgagccttatggccgatctttgattcgatcgggcttacagatactggatgagagtgctaaggcaagcagttctcagatgattatttcatcgattcaaatgatacattccatcatgaagggtttggatctaggcattatatcttctgagatcagtagtattatccatgctatggaacaattccaggacgacactatgccagccatcagcattgcagctttcgaggcatctgagactgctaagctacttgttggcaggcaaaaagagagtgggcatgacaataatttgagtcagttagcaaactattctgtaagaaatggcagaaagggttcatattcacattctctcatggatgatgcggatatcagagacgatggttcatgtgattcacattcttgtgacctgaactctgttcatttgtctactgattttgattctcaacattcagtgggacaatgtggttctggaagcacacgtgcaaggcggcagctatggtgtaacaaatctgacaaatcacatggaatgtccaatcatgacttatttcgcactgttattccagatagtcatgaggcttcaggtttgatggcacatttcagctctgttgatccaattaagccagacaggaggttgtcagatgtgccaacaagagttgctggcccatgttatgtctgttcagcagcgcatgaaacgaatcactgctctcaggtatgcggcagaaactcatagcagctttgatctacttaaaatgtcaaatgtgttgtatgattaaatacttgcttttctttaacatattatttccattccttagccccaaatagcatgaacatattttgatgtcactttcatataccatccacatatatgttaattgtttggatatgcattttcattagcgtgctgaagatttgtctttcagtggtttatatttgacatgattttgggttgaagacataacttccttagaattaaatgaatttacatctctctcactttgtctcatgttttatttcagatatccagggcacaggttttatcaggtgacatgaggatgaattctactccaagaaagcaactccattcttgcaccttctgtagagacccagaacaagatggtcacccaccacttgaaagtccagctatacaacactgctcagggccaggtactaatattcttcagttcagaaaaaacagtgagcttaaggaaagaaaagaattttgggactcaattcggcaggaaaatcaatgccatatgcaaaacactgatgccctaatagaagatttgaagttcccggctgacgatgatgatgaggattttgatggtgcagccaaatctccatgtcaagaatgtcaagctgtgaatgagaagaagactggaggcaagaaaagaaatgcaaaccgttctcactatccagtttttcttttcgtttttgttgtggcaatcattgctctcttctttccttggtggaaggactacaaagagccttatgttgttcctacataaacatatctgtttgttttgcgatgtgcatcaagccatccgttttttcaggaattgtatggtggcaatctttagtatacagaaattataggcagcagtttacatggatgactttgaatggtgtaaattctgtgataaggtgatggaatggttaaaaagttgtaccatttctggatgtacttttctcttatgtggtcataaaaatccttagtgttatgtatcagcatggaagttgaagttctctgctatgataagaagtttcagtactacaaggcagcacgttcttggtatcatgggtaccaggttttttatcttccgctgcaaacgttggttttctcaatttaaaccggccgtttgaaacccttgttctctgtaatcggtgattcaaacaatcaacatggttagcatcttgtgtgagttaagattgtggcattacaggacagcatgcatgtgtaactagttgctgggactagatactctgttacattgaatttctttcttgtttatttcaaaatgcagataaaactctccattgtatccattgtattaatggttgtcaaaactcaaaaaggatattatacaacttacattcttacaagcatatgactgaactttgagaaactataaataagggactgtttagatctcacccaaaaattttacaccctgtcatatcaaaagtttaaacacctgataagtattaaatataggctaaaaaaataagtaatttcacagattgtgactaatttgcgacgaattttttaagcctaattgctacatgattcgacaatgtggtgttacagtaaacatttgctaatgacggattaattaggtttaataaattcgtctcgaggcttactgacggctaatgacggattaattaggcttaataaattcgtctcgaggcttactgacggattctgtaattattttttattagtgtccgaacaccccatacagcaccctatataatattcgatgtgacacgccaaaactttacacccctgtatataaacaccccctaaagcactgtagaatgctacacttcactgaaaggaaagcactgtttgattagcattctgaatgttagttttcttttttccttgatctgaatcgcaatatatattgtagattgcattgcagttttttgcttatatatggcttcgtctacatccagaaggccacaggagagaaccatgagaaatgcttgggcactcggaacgacccggcggcgcggcgagccgtcgccttcagttctccccgccggttgtacttgagcccaaacacggcgacatggacctcacattgcggcggcgtgaccacgccgccgccgtcgtcgccgtcgcattccacgcagtcgacgacgcagaacttgctgtcgcccatgtaggtgagcgtggcgcgtcgacggccgccggggcggcggcggctcttcttccacgacggcaccacgtcgtcatcgtccatggtgtcccactccggcggccgcgcgccgccgcgggacgggacctggcaggcgcagatggtgtccccgtggcgcgggaggccgacccaggcgtcgagctcggcgtcgaagaagccctggccatggaacggcaggagccagccaccgtgccgcctccactcgccgcgcttggtgtccaccgtgtacgtgccgccgccgccgtcgccggaggtggagacgaagacggtgtggccgtcggggtgcaccgcgtaggcggcgacggcctcctcgaccggcggcggcggcggcgccacgggcgcgttctttcacgaccagccgccgcccgtcgacagcacctcgaaggcgcgagggaagcgctcgccgagagacgtgagcgcgtacagcctctcgccgccgggcatggcgatggccatcccgccggcgaggaggccggggagcggcgactcgaccgtcagcgcggccgcgcccgtgtcgtacaccagcgtcggcgccgcgtcggacaccatgtcgacactgtcgccgcacatggggaagaaccgcgcgtcgcacgacgacctcggcgccgcgaaccggacggctggaccgccgccgccgccgtggataaccccggcgtcgtcgaggtcgacgtcgagcttgtggatgctgtagcctctgtcccagtcgtcgagcaccaggtagagatgcttctgctgcggcggcgccggcggccgcggcctcttgtcgtggtgatgtcgccggtaggcctcgccgccgtcgtcgtcgtcgtcgtcccgccgccgcctaggcatcccgagcgatcggtgtttgggcgcgagctagatggatggtttgatccactttgattacacgtgcattgcatatatatagccgaggtagttatggcggttgtagtgtccgaatccgattcgaacatgggttacatggggtgagaaaccgactccgactcgacctacaggagaaacggagtcggacgcgctgtgtgacgccgttgtttcggacaaactttctccaagttcaggaatgctgggaggcgacagcaaatcgagtgtttgattttaacctttttttttctttaaaatttgggcgatgttttaccgctacctgaaaaatgtttcatgtattgaaacgtactattattttcacatatggaacattaaccaattacaagattcttaaacaaaaatatgaaacaccatcgaagtatcaaggacaacgtttcaatccaacccaagaaagatgcattttctgaaacattaaaaactcataaaaatgtactagtacaaatttgatttcttcctcctatccgcctatctggtgggctcctatggtttctgctgcaaatccannnnnnnnnnnnnnnnnnnnnnnnnnnnnnnnnnnnnnnnnnnnnnnnnnnnnnnnnn

SEQ ID NO: 27722 - DNA, 923 bp, Oryza sativa
aacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcgggccacgggccgtgcacagtgtttttttttttttaaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttggtaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaacttacttctaacaaaattctactggggttggtctggatccaggtagagttgctcaaagtggccggccaattcttggttgtccgcagtgtattgggcatgttgtcgagcaagctcccagtctttaacgtttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaa

SEQ ID NO: 27723 - DNA, 1162 bp, Oryza sativa
cgatatgtatagtacaaaagcattgaagcgatagtaaaatccacaattaggagacacaataatcaagggcaagggaacgagaaccagttcatctttcccggcctcttgttgaaatgatttgaagtagtatagtagtagtaaccaacaatcaatatataataactgtttcgtttgtacatacacatggagagttgaacccaaatctccacatctcctttgtgctgctaaaatcataaaattaaaacctactagtttttaaagatggaaacaaagcagaagcacatccatgtgtttgctttgatgcccccaagctcatctcctttttggcttgggaggaaaaaaaataaaaagaaatgaaaagttgatggaatgcatcgatcgatctcttgtcgctcttagattagatcttcatttgccttggtgatcctagccctgtggcttcagatctcttcatgatcctcaacttcttgcatgtgctggtgaacatgctgcaaaatcaaacagcaaatttaatcagtttgactgcaaatatatatataagcaaattactaattaattaagagatttgttgagatgaaaagtttgtgaagaacttactcgaaagggacgtcgccgacgagcatgaggtcgccgtccttgtcctggtaggtgatggcgaactccgacgggttggcaccgtcggcggcgccggagaagcagacgaacatggcctccagggcctcgcggagctccctgtagcccttgtacatcctcaggtcgatcttcctcaggtacggcgccccgtccatgctcaccttcaccagcgacccgccgttggccgccgccgccgaggaggctgccggcgccggcgccgcgttcttggtgatgggctcgtctttgttgttgcagctgctcacggcggccttgctcttgctcgccgccgctgactgttgctggaagcagctcttcctgtacgacctcaccggcggccacccgaccacttgagccctgcagggaggaggaggaggcagtcgccatgtcagaactcagaaccctagctagcttcatcgtaaaagtcaaagatgatctctggaaaagctagctactcacttggctaccggcggcgcggcctcgacggcgtcgtgctcgtcgtcgtcggcggcggcggcgttggcgttgttgt

SEQ ID NO: 27724 - DNA, 22267 bp, Oryza sativa
tcccccggtcgccgggccacgccgcaccggggccgtcggatccggtggcagccaatgcgttttttcttagtgtggggcccacccaccacggcccaagccctatgctaggctgtagtaggatctcgcgttacgcgcttttccgggttcatattctattccccccgccgcgtggccacatgccaatgttaactggttatcggctatttacactgttttctttttctttttttaaaaaattaactttatccggcttgattataagggtgtggagtattttatttaaattattatgtcccatggaattggctttaataaattagtaatgtggaatttttgtgttcgatcaagcgaattagtcgaaataccacaccccgtcatagatagatccggtaacccggaaaattgttgatacagagacatagtgatcaggcatgtaggagaaagaaagaaaactagtgtgaaatgattagtaggatgagctatacatgaatgaatgatgattagggtaatgggggagcatctcttgcacattcggtgctgttccctttcggccctattgatcatatggaataatggagctacatatacatatagatagatagatatagtcatgagtggattgtgtgggcacgtatattgccggcccgttgcttgatttctggtgcaccctacctcttcttttcatttcattcttgagtgtattacacttgactcaatcgaacagtggatccatctatattttgttctgtgtctagggtttcaaacctatcggaaaaatagtgcaaaactcagtgccggcaaaattccgcaatacaatgtcgaattctttcagaaattttggacttgcagatattggcaaaatttagcaaggaggatattctctatggagggtatgtaagtggttcgcgggagggaattttgttctgaaacttcgagctcgagctattttgtgtcataaatatccatcactttaagcttttttttaatattgtaggtatccacatatatacataaggtgccacaaaaccacatgaaaaactactaattaagccaaaaaaaggttattaacaattttaattaacaaagcctccctatgatctacaaacaagatatttcaaaatgacaatggaggctttgctgaaatttttaataaactccatacatgcgggttttctatgtggtttataacactctggatatgtggtttataacactctgcaatcgatgcaggctagttcacttacaaacaaatataagtggtgcaatgggagaaaaagttgttgttatacaataatatctagttacatatatgtgataccgtcatgactctagaaggcgcctcacgatgaaaaaatcgaaaagaataaaaccaacaatgcaactttagacatatactccctccgtactcgtaaaggaagtcatttaggcaatgtttaatcaaatattgggaatataaattatgaataactctcaagttattgagtttgaaaatgtaaaagttatatgaataggtttgtcttgaaaaatacttttataaaagtatacatatatcacttttcaataaatatttttatagaaacaagaagttaaaattgtgttttggagaccgtgtcgctgtccaaaacgacttcctttacgagctgtacggagggagtatatataacataaaataaaatttgttgtacacataactatcattacttaattcctttcaaaaactatcattacttaagccctctcaatataatcccccgggccttgatctcctcctcaacaagttgtttcactttattcccctttccctctctccccactcactatgtgcatcgcattactaaatgagatacttctgtttggatgatcccttttgatcttgttcttgcttcttttggttgggaaagggtccaacaaaaactagtgggagttgtttgtttcaaaacctccacacaaagcattgatgcactgtgttacatcctaattaaaaaaagtgtgtattcacacatatgttagttaattgatgggaaccaaatggtcccccttgctacgtttttggctagctagctaattaactcagaagatatcatggaagttgcattgggacaagttggagcaagatatatcttttcaaagtcttgtttacctgacacattctagaaagctaaagtgcatgggatgctttcagactatattatgaaactcaaaaaaagaaaaagaaaggaaaccactttgccctgggtcaattctcctgcatattgccattaaacaacagttacagctaccaaacttgctagttacggaagatacttaaaaaaaatgtaatactacaaaagttacaaattcacgaatttagcgtagctcagctgcttagatttcttgtgatgaaacctgctcgtctagataagagttcaagttctaaatttgacatgagtacgctcatgtctgtagctattaattgttttagtggcaggtgatcgacgtgcctgttgatagcgagatgactgcggtgactttgtcaatattaaaatatgttggttaagtttctcggaggtgctcatacaagtaggattatgtgtacgtatttatagagtgtgtgcatccatgtacgtacatgagcatacgttagcgtttgtatactaaaaagagaaaaggtcctaaatccaataaaatggactaattaattagaaaaataaaattcataataaaattctagtggtgcttgcaaacagtgtccttccactatgtattttttacagtatttaagcaagtaccatgaagtactatgttacttatatatttctagtattaattaatttgtgaatgcatgagagttttcttttaaggcagcaaatcaaacactagcaatttgcatagtatgtgtacatcatcgaggagcatatgttgatgatcaacaataacaaatcaagcattgcagttgtagcatccagggatgtcaaagcagtgttttccattcgctttccaagacaatatcgattggctttcttagctagttcgtatactcaacaataatcaatttccccattggggttttgaaatgaaacttcttcattcactatatatatgcttaaaaatatgtatacattgtctgaatctcatatcaagaacatatacatatataaaagcctaacaacagttaattaaggtctaattgatgaagctaattatggagaagcaagacaccctatatatatggagctaataaccaatacatttatatatgagccatatatataggccttgacctagtatatacatgtatctaatctaacctcttctcttaattctttatatgctgagaacttgagatgttcctgccgatgtcgacacatagtaatatgctccatgatcaaaacaattaatttgctatttttgcatctgggtgtgtatgatatctttcctattgtcagcatcaatacagtccaatctagccaataagctactagtattttattggtggtaaacttcacccttgatctgataaacttgttcaacaaacgcgctagaatcaagcttgattccctgtcacaatgctatcgtccatacatgcatgattggttgcatcaatgcagagcttttttttttttgtcaatagctttgctatagcatttgactattgcgagataccttctgttcctgcaacctcctgcagacacaacctaaaataacaagccagtgcttgtgctgatcatgtacactcgagtttgtaaactatatatgtgtttttcaactgcttctctttttctttatggaatattgttgttgcctgatcaatgttcaagcttagcagtgagatgcattaatatgtgcatgtactaccgtccatgtcggcccacagaaaattaattcctcggattctagatatggtctgctatgcatatgagattattctgataagggcaccgactagctgtgcacggtgctttgtgctgatgcagtgcaatgcaattagacatgttgtgtttgatgtactaaatactacatgcatcttggttcccaaataaattagtgcatattatagtaagttccaattcagttaatttgtatgctgtaacaagatcatgcatatgcatgatatgtgttgtagtgacctcctgctacatcacaagcatttgtatattataataaggatgttgtatcctctttgaaggccggctttgcatcaaagatcatgctccatgctttgggtgtttggctgttgatactgatcttcataggaggtccgagccgcttgatcattacctagtgataagattagaaccaatggcttatgatggatctcggtatttgtgccgtcacaaccttttgtttttttttctcttcacatggtttttttttcctcgatgaaccatacagttgtaaaatttttggacccgattttctccataatcaaggttagttctttacttcttaattaaaagtgagaactcgctgccatttttagaggtactagttatatataggcccacgtgttgtaacgatttctttatttagtttagtgggaggatttagactaagtgggatttttttttacaatggttggttttttgataaatcagtttaaatttttttgggcggtttttatgggtggaaagagatttaggtggatgtggaggactccctcttttaagtagtagagatatatatctttgaaaaaactagtgcatttgcccataggaacttatatagttttgtttgtaatctagttcaaattaaataaaagtatgaattacccctaaactattgtggttgtctgaatctcccctaacaattgcggatttgtggtcgtccgaattaccccttgaactcaaataccatatatcttacatcctcaactattcaaagtaaagaaatagcccttcctctctccatgagtattgtttcgagtggtttaggctttgagctgcacacgtggcagtccactgtggcaaaagcaggccttgctgccaccctcgctaggtatttgagagggaggaatttagggatttgaggggagagagaagcccacaatttgtcccatgtgtgtgcattgctgacatggcacttttgccatgctgaacaaccacgtgtatagctcaaagccaagtggacagcgaggtgcctgcaaagggaccaaagccatggagataaaggacactggagcgcatagccgataataagggcacggaatcccgagtgattgggatgtgccgtctccggctataggggagccccaaagaccgagaataaggtagggcagggacaccttgccgctgctcggaagaggatgagcagataggggagggaggagaagggtgtgcagaggcatgggggagtgacagtggagcttgatctaggtaagcgacccaacatccattgatgggaggagagaggggagaagataatgttgaatacacgtactagtcttaacgcagtatggatcatccaaaagtgactaaaattcatagtattttcaggtgactgaaaactctagatacaccattttagtgcaattcccacgaaattcctcaagtatcaattaaaagagagacccaagtttactaggggcctccatttcaaaagagacctaaggttatgaaagacaggcaaagacatatgaacagcactccacaccactatcacagtacgtcgattgatctcaacacacgggccgtgtgtgaacaaaggtgtactagattgtataggagtatatcgcaaatgagatatatgtagttgcagatatgcaaaacgtggtcccatgcaaccactcatgtccatatataatctgatcgattgatatggtgaccaaaaggacagacaatgcattatattcatcgtgtaaggagaactactgggatatcgatcaatatagtatcatctagcgaaggcatatatatgcagctggtgcgatggatcatatcacgcgcgcactgatcatatgatgatggggaaaatggcaacaactccatctgttcctgcacatgcacgcatggccattcccctctccctagcttttctctttaattcgatcactggttcacttatacgctcttaatttaatttgatagacgtacataggattattgattgctcatttaggacgcgaaacttttattgttttgaaacaaagattcagaaattagataaacggctaaatgatagagcatagctcaactggttagtttttttttcgtgaaatcaatccgccgggttcaagttctagagttaacacggatgctcgcatttatggtaatttattcttttagtggtagacaacatactcgttgacaacgagacgtccgtggtgacttcatcaatctcaagatatattggtccaatttttcaaaggtactcataggggtaggatgtgtatgtgttgttagctcccacgtttgtattatattttgaaaaagaatatatacacgttgcatggggtaaaagaaactagctaggaaaagctagctagattccgcgttacaaaggattcatggattaatgtttgcccatcaacttcggtgttgacagatatgatcccgcacaaataatatttttttaaaaaaactttctttatcatcgcttcttattattaagatacttttaaattaaatcaatttattaacttcataatatttaatttgttcgtcttacccttgaataattgatatgtaaactcaatttcagctatcgtccatcagcactttagaacacatctagttttgttagctccgtttcgtatgctaccgagtttatggcttgctctacgacctagacctacctgtcagccggttgccctcatatttttaaccatttgatcatcaaaaattgccaacttaaggtagaactatatagagtaaagtccatcaccggtctctaaacttgtaccgctgtgtcatcctggtccctaaactcgcaaatcgaccgttcatatccttaaacttgttcgactgtgtcattccgatccctaaacttatagatcactcgtttaggtcctccaacttgttcagttgtgccacctcagtccctaaatttggatttgaatatcatctgggtcaaataggacggtctaaagactttatatttaaaaataattcataactttttcatgtgaactctaatgaagataaactttataacaaacttgtagccctcaacgcgatctacaactttgtagttgaattttttttattttaagtcattttttgtcccaaaatgtaattttaaaattaaaatttcaaaatctataaacatgcaacaatattttgggaccctaaacagttttaattcaaaaacttttcaactacaaagttgtaggtcgcgtcgagagctacaattttgatataaagtttgtcttcattagagttcacatgaaaaagttatgaattattttttgatataaagtttttagactatcctgtttagggaccggggtgacacaactgaacaacttggaggacctaaacgagtgatctgcgagtttagggaccgggatgacacatcggtacaagtttagggaccggtgatggactttactcaactatatatgtatgcctattgagaaggcaaggtttaaattatggcttggagcattatatcctttctcccgagtatatcaatatgccatgaagaaaatttatataggtcctgtcccctaagggataatgaacctatgtcctactggttgtatttgtatatgaaagatatatgtgtacaagaatatggaaataattagacctagtcgagactaacttgtcgagaatctcaatgagatatttttttggggatctccttgtttgtgtagccccctcctagtcctaggttcaagactcagtgggataattttggtatcattgtgtgcctagctaagtccaagtagatcttcgtaatcttgcgatagttggatacatatttttttttatctatttcaagagagatatttctttatggagttgtttccatatatgaatttgtatactattatttcttcacctatgtatccatacgcgtgtgagttatctcatttagtataacgatagttacacaccaaatccaaccttttctctaccatcaaattgatgtccatcaagtgttgtgtgctactaaaatttaaattttaaaacttgattttgatgtttttccaacgtatatcttttttttaatattgacttttaagttgctaaaaacacatatataaaagttttacgcataagttattttttgatcactaataaattgttacgtcttataattggccataagcaactgatgagggcttggaagtcgtagtcgccagtaaacatatctatgtgatcaaacatatagtatatgcatatgcagtgaagcatgcatgtgaaaatgatctgaatgtagcgggcgatgcgtacacatacacgtgagatcgaagcgacatatatcacaccatgctcgtgcagttgcatcgatcgcgtaatgtactaatgtatggatcgtacaaaagttgtcgggcatatgcatatgcccatttagtttctctctgccgatatacgctccaatcactgatcagtgcacagtgcgtgaaacgtacgtacaccgatcgatcgacaaactcatgcctttaattatcatcttgtcgatcagtcatcgggaaaaactagagctgattttttttttaaaacacagggcagagcatagaccgcttataagcatgcgtacactcacctctctctatatatatacacatgtacacgttaccctataagtttatttgaaaagtgatacatatcatgagattcacaaagttacaacatacgtcttcgctatcaacaagcatgtcgtctattattgaaaaataataattagttataaatacgagcatatacatgctaaatcatgaacttgaacccagatgaacaaattccaccatcagaaattaagctacgctcatttcgcaactgacacaaattaattaactacacaactaattgactcaatgaagctatttacttagctttcagccacagcttattttctttgttctttcaactatgcctcggtccaaaaccggttactaccggtccctcaaatatattagaagagatttgcttcggtctagtaaaaagtacttcaaattgccggtacctcacggtgctaaatcgttttcgaactttggaactaactaggtaggatgggcattggtagatccaacgatcggaaacgatttggcaccgtgatgtaccggcacttttagatactttttgttggaccggggcaaatctcatatcagaaacatttacatttcatccttgatgagggcaccacgtggtatcctagttatcaaattaaaattttgaaaaagaaatatatgaggtggaaataagaggaaaaaaggcgtgaagatgacacgtggattatactatatttttgttacttaattattattaattggtatagtagtatgtttgctatttgcccatgtacgtatactatatttgctattcagtatcgaaaatcacctttacttgagtatatatagggatgaaatatgaagaaaaaattcgatatatagttgagaaaccaatagtaaacggatttactatggtaggaaaaccagaccaaggccatttttgagggaccaaaagtgaatgtaatcccaatttttaccagtgcttaattaattactattccgtcatgttaatttcatgaccctagctagctagattgggcctagtgacggatctactgttgggactgttggtgcgcaagccccacgtccatttcctatccctaattagccattaatgattctcattaagtttaattagtaattaatataaaattgggatcccgtgatgatagttgaagtgcttagtgcctaaaattgcaaaacactcagaatagactataccaatttatttgtagacttttaatacatatattaatgtagatacaaattaaagtggagaagataatatgtttattttataatgtgtatttggatttcatctgaaaatgctaagctgatattcctctgttcgtcaaccgtggaaacgtagggttgcgcccattcgctccacgccattttagaagaaataccaattaagccccggatcatgagatcaaagacaatgctatcccgctatggccgcctactcttccatatctctagtttgctttagcgccattttaatttacattctggattcgcggctgagagtgagagaggacctatttaagcatatactgctatattattcatcaccggccattccttaccatttcttctccctctgcatggtcagtgctcacaaacgaccaatcccccaaacgcagcaacaccaagcaaaagcaaaagctatagtccttcactagcttagctagccaagaatcgggagcttagctgaaacctgctgctgcattggagaagatcgaatatggctggcctcgggttcgacgagaccgagctccggctcggccttcccggcgccggcgagctggcagcgaggagctccggcaagaggggcttcgccgagaccatcgacctcaagctcaagctgcagccggcggcgcctgctgccgtctctggggaagagggtgctcaggaggacaaggaagatgccgacgcggcggcggcggccgccgacgagaagatgtcgatgaagaggtcggcgagccagagcagcgtggtcaccgcggagcccgatcccgacaagccgcgcgcgcccaagtacgcactcgacctctcctctcctcgttaattaatctccatttttgttgttattttcatgaacttgtgtggtcttaattcttgtataaagacagtttaatccttgaagagtttatgtttgctctttgtttcatcttcttgaaggatattaaatccacatagtagataggactgataaatggaaagctagcgagtagcgattcaaaagtatattggcaagtgttttcaagaagagccattagttagccctgaaggaatgaagtaaataaatttctgcagttttgggaaaagactgtaatttgatatctaagttttttttttgaagaacaaatttgacatccaagttaaaacgaaatgaagtcggagaatttttcaagtggcagctaggcaggagctagtttttggtctctgtagttttgggaacagagacattaggatcccaagttggatactctggcaatgatggatacaatattcagtcaaaaaaagatgatggatacaataaacgaacaagaacaagctttccagtatgtagcagtagagtactatccccgttctgaaatattactacatagaatagtatttgactcatccaaaacaatgaatctggatagaagtaatccagattcattgttgtgagatatatgacgatagatcaaatctcatcctaactactccctccgtctcagaatatagcaatttagaatggaatgagatccattttaggataatgtatccgaacatcccatcctaagttgctatatcctaagtaatatttagggaaggagtaagttcacgatagcttccgtgcgtacacagaggagcagcagtagaaaaatggccatctgatctgaaaccaacaagccattggaacttggaaagccgtttttctaaagaaaaaacatttttcatttatgtagtgcacagtaactggcagagacatggcagtttgcttgtcgcactaatttacacaaagcttgcaaattaaaataaagcattgtacaaaatggagaaaaggtgtcagcttttctttttctatattttttttacgaggcgtagctacagatgcttcgtttatcattgaaagaaaaattagtcgtaataacatcctctggtgtgaaaggatagacgagtgttcaaagacagggagcttcacatccctcaactagcggcaaaaatcctgaatgaaatccatatttggatggcatgtggtgcaaagaatcttgcaagaatagcaccataacatcctctgctataattttttcttcttttttttctgctacccctgtcctcctgctcttcttcttaaatataaaactagctcggctggctcagtttttttaaaaaaataaaaatagtcgtaataagcatagtacttcaatccagattagatagatctcaccattaaaaacctaactagttgagcgacgatgatgtcaacttttcattgattaattaattaatcagaatgcatatatgtcgatcagggcgcaggtggtggggtggccgccggtccggtcgttcaggaagaacgtgctcgccgagaaatgcaaggcggcggcgctggtgaaggtgagcatggacggcgcgccgtacctgaggaagatcgacgtcgccatgtacaagagctacccggagttgtccatggcgttccagaacatgttcacctccttcaccatcggtatatatatatatacactagctatatatatatattcaactatatatgcatgatcacacgatataataagtttctctttgtcactgtaatagaactaataaaatcaacggtttctactaatgacattggccgttacataatcctgtcagtagaggactctatttcatatagagacgatcttaaccattgatttatgagttattctaccattatcaacagttgaggggtagtataaacaaaaatatgacctattagattattatagaaaagaatcaaagatgaacgatatatatatagactgattaaaatattaagagaaactattgcaaaacatctgttaaaattaatagggtggttgttgatcatgttcaggcaagtgtgggtcccatcagcagctgaaggagagcaataagctgagagatgacctggagtacgtgccgacgtacgaggacaaggacggcgactggatgctcgtcggcgacgtcccgtgggagtaagcctcgccgtcgcgataagcataatcccagttctaataattaatccccatcagctaagctagcagatcggatggatcgatcgagtaactgatcaacggatgaaataatactccctccgtttcaaaatatttgacaccgttaattttttagtacgtgtttaaccattcgtcttattcaaaaaatttaagtaattatttattcttttcatatcatttgatttattgttaaatatactttcaggtacacatatagttttacatattttatattttttttaaataagacgaatggtcaaatatgtgctaaaaagtcaacggtgtcaaatattttgaaacggagggagtaataataattctcttgatctttaatcctcatctcgtcgttaattgtttgttgcaaactgacatacgtgcaggatgttcgtcgagtcgtgcaaacgcctccgaatcatgaaagggtctgaagccattggccttggtcagtactattgtctcaacagaaattcagttcagagtttcagatcaaaatgtgttttacttttacatgcttcatactaatttggcactaactaaatagtatgtttgtttgattccagcaccaagggcagtggagaaatgcaagagctgaagctgatcaaggagaattaattagcgccgcatccagatttattaattttcacggatattatattatattatattatattatattatattatattgcatgcatgctttgctcctccctgtattatactagtatcaagtaattagtttactgtaattcagtgtcagttaagcctgtgtcatctcagtttttctaagggattttgatgtatttacatgtgggttagctccatcttgttatgctcatggagtatatatatacgtaacaacaatgtcatccttacgtcacccttttcctctctgttttttttttctgttccttttttttttttgcgggaaatgcggttggtgattacctgttcttctgcagggatcctgcagcttgtctaacactagtacagcagtgctcaattatcgtggccatccaacagattataattaattgcctagctgcattgtttaattaattatgtcgaggtgctaattaaaaaacctgtttctggattcaatgatgagaatgagaggcatccttttgtgatgtagtgtacacaagaaacattagtatcttcacaatgttttatatttcccagccagctaaagagaggaaacatgccatgtgcatagagatgggggatcttgtttttatatatcttccagtggtaaattgtgcatcataatataatatgatgttaagagtttggggtttttgttttccatctatctgtattacgtgctaaggtgttcaaatagtgaattgttctacaagcaagcaaataagaagggtgcaaggttggctaaaaaggaaaaaaaaatcaggttgttggaaagcagtgccattatttttttttataaactttaggctgctgcttcaatgctattgtatacttgtatgcgaatattgtatccaaaaaaggaggttgaatgagaaagctattttaaactattgcagaacttaagctatcttttgttgatcctatgtccccttgtaatgatgacacgtcccaaacaatccgggtgttttcaaatgctccagcagagcaagaaaagaatcaaagatttatttttttacaaagttgtatcaagttgttagttgcagcatgccaacaaaattagagatgagtacaggttatgctgatatcaggggttctaatcttctgtattttcttcctctcaaggagacatttcatatattaaaaatcttgtacaaacaggaatcaggaaacaatagctagtacggtcggtagtaccaaccgtctaaactggagtagcatgtgtattcacattcacactgaagatccatcaatgagattttctaccacttgatatctttcagacttgataacggagtaaaatactatccctagaatttcttccataccttaatagcagagtaaaattataccactagatttctttcagacttaatagtacagtacaacatttgtatcacagtaactgcctatactgagggcactcatgctaagctagcaaagcagtaaatgagttgaacattcctgagcataacatttcaaaggatacaggctctttattttcccgaatagaatagaatatatcgtcatggctacatattattgttttacaaagtctcaggccagggaaacacacatcataagcaatggaaacagttgcccaaagcaactttatacaacaagcgcatcatagatactataagttctggagacatcaccgaatgcacaacaacttaacaatctcccagcagtgtgctataaaaattaggatgtgtacaataacaatgctcaggtttctacatctggttacgttattatcaatcaagatgaacggtgcactggttccgccttaaatcgatcccctttttgtcctgcgatggctgagaaattcagaggtaagcccaatatgtaggtgtaatggtcaggagattatgcggatttagaggatgaggttacctcttgctgtgcgaactgcggaagttgaaccctttttgaaccatctgctagccgcttgcatggaagatgtggttcagctgcagcgaactcattcagaacctggcaaaaattttggcaatacattggaaaatgaaaggcaaggggcaatgcttttccagatcttttttttaaaaaataaaaagatggctcaattgacactattaaaaaacagcttctcagctttataaattatttgtccgtacaacaaattaagtgcctaaaccagaactaccagtctttgcaatcagaactgtaaaaggtcagttgcactggttgcccaacaaaatgtgaaatccaacagtttgcatatgaagtttctaggaacatgtttgttccacatgacatgatgtttaggaacaagtttattgcaaaagttatgccataaaaaagagggtaaagcaatttgatcaattgcgaatttgaagtcttctggccggtttgcacctcaaccagttaccagcaagctggtcaggtttactagctaatctggttcatcttttaatttaataagaggcaaagcatttcaaactgcaactagccaactggcgactgccaactaccttatgctctctcaaaattagtgctggtagcagtagcatacataggcgtcttttcagtttaccttctctgctagtcaccgctcaactctaaattcgtgaggagcaatggatagcaaagcaacaaagcaatgaaaacctaatgcaccagcagttaaggacaagatggatgaaccacacacatcaacttggatgtcagtagttcctaagatgatgacaattgacataaggtagacaaacaccatgaactgatcaagagccaaccctttagaagcaagaatacagacacagggagactgatgagtgtatagagtatataggtgttctattgctcgccaatggtctgagttatttggcctgaaccctgaagactcattgagttggagggccttagactaaggcactccagttcactatataatttttttaagggagggaagtctgctacagagatttttgtgagaagtgtcttatatataaaatctagttaagaaaatctcaagttacaacatcagtcacatgacgcaggggcatcaaccatcacaatgtacacacaccgcatccaattgtatggtttatatctaagttatgtattgcctatggtctggtataccttcagcctgctggtgcttactcctttgtagattccaattgaaacacttttcttcgttatgttgtctttcggtttatcagtttctggagggtaaaaatgagccaaaaaccaaaagcaaaattagatgtttttccaccatattggatacaagaaccttttttccaaataaaacaaactaaacttgaagttagcaaacttatgttcagttcaatttatcaggagtgtcttttagtttatcaatttctggagggtaaaaatgagccaaaaccaaaagcaaaattagaatgtctttccatcagattagatacgagaaccattttccaacttaatacaaactaaatttgaagttagaaagcttatggttagttcaatttatcaggaccaatctagttctgcagtctgcacaagggcacatgtctacagttattggtaagcaaaacacacatgtgaagtgtgttcttcagaaatatctagtcattctacaagaattccaattacttgttgtccattgtgaatgatttgatgcttgtcaccttatgagcctacttgaaagttgaaatacaagaaactcaaaacacagtaacaggaaaaatgcaggaattgagtgtcatgatcaatcaagtcctacggcagctgaaaaacaaaggaaaacttcaaaaggtgtttagatacaacaccagaaaattgtaggtttggaagagacagaaacagaagcatgagatatggaaatattcctccaaagcccatattgagtagtctaccatattaggagtttcaaaggaaatcatggagtccaatcctttgttccaaaggcctccataggacttttttttcttacagaaggattgtaattgtccaaaattccatatttatcctccattttaaacggggcctaaaaaatgcaataatccagcgacattgaattttacctagtgcacttgtaactgagtaattgtgaaagaaagttctatccaaaaggaaaattcacatgggcatgagaaagggtctcgtaaactttacctggtttctgattgctccaatcaacatatcatgacaaccagatgcatgcacattctttaattttggacactgaagaagcaaccgttctgcgcaaaatatttagatggttaataacgatggctactatcaacatactcaacaacatgaagaaaaggggaaaggacataagacctggatttagatttgtacaggagttgaggtttagatcattcagctctggacaatttagatatagagcctgccatatgtgaaattagtaaaccatatgaatgattatttcaataaatcaaagcctgcaaattccaaaacacttacatctattgctgagcagccccatagactgagcttcttcagattgccatgcttaatgataagcttttggttagtagactgttttttcgaggtgggcaattttggacaaaatctaatggcaccgttaatttcaccaaaataaggcccctgtttttcattctgcaaactagcacataaggtcattccacagtccattagctgaagaagtggtaattgtgctgttgcaaattggatcccacctatgaaaagacaagataagttttttttacgctggatcatgtaaacacatacaggtggacatctataatggagcacgaataataaaccatgagaaaaaatctgtcttacacgtcgtcacatttgggcaaagagcaaggagtagccttgataaagtatgaggaaatgccttgcagatcatcccgacaccattatcactgatactagatctggagtataatcaaaatagctaattacatcagttaattttgaaaaccattagaggggaaataaatcaatagctttatgatgacttcgtattttatttatttctaaggacataaagtagtgattacccgcttaaatcaagcaattccaagcttgcacaagatcgaacaatagatgcaacagctgcatctgttatttttgaccctagaatcaatgatagcatgcacaagcccctgtgacataataacaagattgagatcaaagggttgaaatgctacatagttagaaatttgtgatgataatcattgtattatagctcaaagatccagcaagattacattaaaagcatggtgtgctggaaagatacctgaggctagcaccctccagagcaaacacagcttcattggataactgagcagatgatatgtgcatgttttttaagttaggacaggtacgacccaggccatccatcaatgtgacaagatcagtacagtcgttactttgctgtgtgaagcacagcgagatttcgctcatgttaggacagtttatgacctacaaggcatttacactccaatgaattatagctgaaaaagaagctgttaaattgttaaagtattaaaacaaaatattaccgattttgaaagggaacaaagatctgacagccaaagaattgacaggcttgaggagtttagattaagaaaaccaaggttacagcaaccaccaattttgagaactgagagagaatgcttttccgaaacaaaccgacttagttcctccctgttgagaacagaaacagctttatttgaaacaggtcctggaagtgggaggctaatagtgttgcagttattttaaaactatgtaaaatcaataagtattgaacattcaagataccaataatggcaatatagcccaggagaaaaactggtttatgcaagcataacataacacgagaaaatgattagggacaacaaaaattatcagcaaaggaaagaaccaactagattgcatttttaatagtagaattgtaaagaagaacaaatcctggcttggcagaatccaatttgctaggaaccttgattttacatggcaatttttagatgggaagctagcacttgcaaacaaatacatgtcaatttgagctattcaaactatatccaagcaagcccactctatgtaatataatgaaatttaaagaaccaaaagacaaagtcaagatacataagtaaacaccacatcacgtatgcaacaactaataagtgataacgtttgaacgtacccagtcatcctgttgactgcgttgtcagacatgctgatctcaagagttcctaaacttgggcaggaaaaagcaagacaggccagtatagtggcatcaacatcactgcataaaacaataagatagttagatacctgtgataataagttataagtacaacatctttttcaaagcgcaataaacagaaaccgcaagaactgtgtatatgccctgtaataagcatagcatcttcttctcagtgtaaataacagaaacagcgtcaaagctatattgactaccacagtggccagatccaaaaaaaggtagttacttgtgctcattcacgtaaatctaagcgcacaagttaatttcactgttgataggcttgagcgaatctctatactgatggaaaaagaaaagatttttttattatttgaactttttaaatttttaatttaaaaaaaaaacctttcaaaacttatttccaagatctgaaccttttggccacactagccggactggcgtggcaaaacaatactaccatgccggtctggttggcgtgacaacgtatttagccatgccggtctagctggcgtggcagcgttatttggccacaccaccctggctggcgtggcaagataaaactatcgcgcctacagtgtgtggcgtgtcagtgttgttttgccacgctaggtgggctggtgtggccaaaagattcagattttggaaataagttttgaaagggtttatttttaaaatttaaaaagttcaaaaaagaaaaaaaaaagggatagtaagcacaaaaggtgtaagaccagttctacatttgttagtgtgcttgaaaacctttacgatgtgaatacttctaatttgtttaggacaaatattacagttacttaaatgataatagacttgttagttggtggtcactagccactttatattttataaaggaagggatctttaaaggttaacagatgaaaaagataagacaagtgaaacaaaaggcaactatgctacaatcccttcactgccagcttctctatcgcactggacctagaaagagtccaaactggaagcatagatccttgagaaatagagcagctatgagtgctgtccactacctctaatgttccaaaacagataatccctcactcgcaacagagacctttcaatgtattgtaccagcaggtcattgataatcatgtgttcaattgtccttttgctttaccaaccaaaatgctacctaatctgcgcccatccaattgaccatgcatacagaataacatgtcccacaactgtagaatcagtcaatataactaaaaattatgatgaaaataaagtttcattaacacggcaaagtggagccaagaaaaatgtaaagaaccccattttcacaactgaaaatagatgtatgttatttaacataaaataactgaactgcgtaggtactggcagaatgaactaatactgttttttaagtttttaaaaatagttggtgtaggccacaggctcaaataatatgaattatgatagaagagaacagtttctactgttcaaaattagcagattttattctagggctagttctatgtcagtccatcatcaacgataaacaacacattacatgtgcatttcctacaaattaatctagtcgatcacttgtgaaagttatacacgccacccttgcaactatatcaaaagattgtccaaaagagggagatatcagcacagacatgtcttaagcatgctccccattattttcaccttgctgcactgagaagtgagacactgacaagcatcgtgttgtgcaaactaaatctccaaacaccaagatctgatgaacccctcaacagaacacacgaggttttctcatccaaagctaaaaggccagaaatgacgagcattttcccaacagtttgacactagtaattccaataaaatagtttcatgtgccaacaccatttggtagatttaccacctcagcacatccgaccgcaagtccatgggattccggtgtcgtaagaatagaaatggcatttcagtgccatgccgactagcgataaatcttctagcagcagtgacagatcggccatcagttgtccttgggaaatctcacgttttcgacgagttagtgtgattgtgctatggagtttaaccaaaattcattggccctaagagtcaaataatttagaaggcattttacagtgccctgggcagccaccgatgagagatccggccatgaatccgagcagatcggcgtggaaatgagatcgtttttgaaccggattcgttgggggtttcacctttccattcgcagggagagccgcgagagcgcggggcaccgcgggagcagcgcgccgacgaggctgaccccagcggcgcggaggcgcagctcctccgccgcgcgccacactcgccccgcgcagtcgcgccagccgcggctgaccgcggcggcggccatgacccccctgggccccaggcggcgcagcacctccgccatgagctccctcggcacggccctcccgcccagctccaccgcctcctcctcctccttcaactcctcctcgccgccctgcccctccaccat

SEQ ID NO: 27725 - DNA, 9375 bp, Oryza sativa
agggggtgggggcggggcccccggcggcgcagacgtggcccttcttggggaggccgcagcggccgcagttgtagctgccacgcgtcttggggcgcggcggaggcggcggcttgggcagcgacgccatgggcgcgccccccactggatttagggtttgctcgcgcggctgttgttgttggaggtgggggatggatggatggatgggtggggaggggaaatagttagcagctcgggaggagggcgggagattggggacggattggcgccatttttcgggtcgcgagtgacccaccgcccgccacgacgccacacgcgcctctacctctcgctctcgacagccagtcgcagtgaaaaataaaaggaaaatttaaaaaaaatggatgttaggttttctatggctttgggaacggggaattgcctttcatgtttaaatactttctttttttttcttcttttaccactggagtgcctggaggaaattcccatcactttcctatctttttatcgccctccttcagacaatcgcttttacactcctcgacttaccctgactcatttttcccatgtgctcttatcaaactgttaaatgatatgttttttataaaaatgttttaaaaaacatattaattcattttttaaatacaatattaacagatagttaatattcaaataatcatatgctaatggatcatttcattctacatatcttttcgatcttctcttttctctcctcccaaacacaactatcaagataaaacttgaattttacatttagttttaagttaattttgagtttttttttcatcgtagtttatttctagcattttcttttaaattattaagaatgtatataaatttttatttaaaatttattttttggttggtgataaataataataataagcaaaaacgatgattgtgtaaatttcttctttagtgaacttttaacttcctagttcctactagaaaatgttgttcgtttccaaaaatttaaaattgttgtgtgattaaaaaaatgatgttaggacactcccaattcatcgagtctatagatataattatctatttatttcaccacgcatatatagtttccacattagtgtctttggacgagaaattaaacaactattttccactcacaaacaagtataggaggatcagctatatcattttagtcaatgtgtccatctgtgtgtactatcaacttcgaataaatagttatttaggtagtcgtcccttgacaacattctaagttgatgtgatcggatcagtgaaaaagctgcattccattaagtagaacaggcacatgcatccaatctatccatggatcatcaaggcgggttgtctatcgagggggattgctccccaagtgtatcgtcatcatcgacatttcctcattatgtttactcaccctcccacaactacctatttgtgtaatagaaagcttcaccaaggtaggagatgagtagtgggatgtcatctagtagagattggggtggaagtacgggagattagggtagggatttagcaaggagatagactagcggtgcgcaaaatcgttgagggagagaaagtgtggacaggagaatggagttttcacaggaataggcaagcgaggaagaacattagcaattcccacgcgagggaggcaccacttcgagcacacgacgaaggcgcgagatacgagcgcgatgaataatggcgggaatggggcgacgtgcagggatgagagatcgagatgggtgttgagaaaggaagtagacaatacccagccaagtaagggatctagactctaccttgggagctataaggatggaggaaactacaggcggtcaaatgttgagttgaccatcggtgaaacatcgagttatacatgataaaaaatcagctattgaacatttagaattttaatgaaatatggtgaaaacacacattaaacatgtcgccatcacgtatgaaacattgagtttcaattgcaacatatgtttttctttcagcagaatataatcatgtgttatcttgttataaatattagataagtagtttaggagaaaaataattttgaagatctatacaagcatggagtagaaacagaataagtagtatgctagattgctaggagagagaataggggcatgggcgcccaatactttaccgaccattggtgaaacattaagttattaagttatacatggcaaaaaaaataaactattgaaatatatttttatgaaaaacaatgaaaacacacattaaaatatgccacaaaaccgtgtatgtaaaagtgcacctaggcccccattggggttttggacgattgatgacaaaatcgtaagggaactaagtgtgcataaagtgtattgaacatgtgttatttccaaaatgaaaagaaaagaaattgcaatggtaacccttacaaaagataaggaaacgacactgtatagaatttgacatttttgtttacaatgcatgcatgggtgatgcttggagctgccgaggtgccgtctgtccatggagcatgaaccatcataattttatcatgttccttttttttcagagtctaggcatgccgcgctatcaagaggggtgtgtgcaatgcgagacaatgatcaaaagtgttcaaaaatacattcttaattgttgtgttgaaaatgtcaaagtcccacacccttgaatccttgttttgggctttaactggtaacctggagtacccgaggccccgagcattaccatgagtttcctggtaggcttttcgtgtgcctagagctcctatttcgaaggccccgaccttgacttggggccatctttcttgtagtacgtccacaagactctgggagttatctcggagccacccataagccacttcgctgcccggagcctcgatcccggggacctcgggctagtctgagccacactcagcttgtagtcccggagaatctaggtggatatcccaaagactccagacaacctcctcaggtgtctagaggttgttttccaggatctccgagatccacttcacggccacagcagcaacacttggaggctccgaggctcaagcctaaatacttcgagatcgggctgtcagcctctcaacggctagtggttggttggtgggggtaattatacccccccggcaaaccaccaccctctccccctctagctccccgtttgtgttctctctctcttggtgctctccccctctccatctctcttagctttgaggcacatctttgtgggattttggtggcctgagtgcttgtgagctagagttcacccttgagcacttgagatcggccttgggccttgcacgtgcttgttactcttggagccttgggccttgggcctggcccgagccaatcgccggtttcctggtcaccgggaggcgccttccagcaagggtcgccatcgtggagtccgcagtcgctaaaggcggggagtcaccggacgctttcggtgtggagtcaccggtcgccggcagcagggatgcgcccggcgccgataggggatggcatgacgcccgggcgccccttctgtccgctgagtaggtctgggccgccggtaccgtaccgcgagcctccattgtcctacgaaccatcggtgctgtcccattgcaaacggaaggccggactcttcatatcgtggaagagctacctggggaggagattctatggttgctgtcctaagagggtaagttaacactaacccttgctgtaaattttagctattgatcagcaatctccttgttatctattgaataattgctattgatcagcaatctccttgttatctattgaataattgctattgatcagcaatttccttgttatctattgaataattgctattgatcagcaatcttagtaaattttagccaaagaaaaggagataaatctatttttggtaggcttgtaagatagatgagagctattattcaaatatgtgtggtaacttctcagtgatataacaattcaacttcaagtattttagctatcgattcttgtcaatttttgttgttcttttttttctaatatgttcatattttgtttgcatatagaatgagacaaggtgcgatttctttcggtggtacgaaccgcaatttgatgaacaaggtggatttcttggtgactgagcttgaagaaaaaaaaagattaaggaagaaggtattcaaatccgtttgggtgagctgataaatgacctcaattttaaatgaaggatgttcagccttagagatgtggagatgttgttgccaatctctgctattcgaaaatgcttttgcaccgctgctagttatcattcttcactatcttagtttcagtcccagttagtttctgcagtcccagtttgtgtttgaactatatcgttggttagtctctatgtgttaaaactccatctgtaataactcttgtgtcaaccttatcatggtcacgccatgttgttggcttcagtgctatccaatgccggcttcttacatgatgttactgatgttttgcactcaaatgcgatgtttcaataactgccgctaggattaaattgaagttgtatgaaaattggcatttcgtgcctaaatggaaaacatggcagtaaatgggaccaaagatactagaagcggaggatgcaagaatggatgtttgatgctaaaatggaaattgagctgatgtctctgccactaaaaaagaaagtaccaaaatagaagattaccaaaactggagcttgtgacggtgaaatggagcatatggctctctaatggagcagatcagggaaatggagcaacatcagggaaatggagcatgtcatggtgaaatggagcacctcagggaaatgcagcaatagcagtgaaatgcagcacatcagtgaaatgcatgtcacatgctccatttgcctcacttgctccatttcagcagcatatgctccatttgcctgacgtgctcatcaggcgtgaaggggttgcttggggcgtgacttgttccacaccggaccacctccttctggccacaacggttggcaaggctaaagagctgggccacgatcagagccatcttctccagcatgcgcttgttgcaaacgcctgacctaaatgcgtgtatgacaacatggtgggcgatgtgcgggatggtgttgcagacctggctgaatcgttggagaaatggcacaaggtctcatccatgccctagcggagggcgttcaagtccacttccattccgggaagaggaaacgttccctgaaagttcgccatgaattggtggcgaagatcctcccaggagtagattgagctctcgaggaggttcatcatctgggaactcccctgggccttgagagcgatggggaagtagttcgccatcaccttctcatcgctgtcggctgcctggatggcggtgataatatctggaggtactccgtcaggtcgacggggccatcatacttctcaagcaggttgggctgaaacttggccggccattgaaccagctggaggctcggagaaagggttaggcagcccgagccacacactgcttcagtggaagggagcattggggttgcccgacggccttcctctagatggtcggggaatgcttctcccgttggctaatggagggagagcgctgatagtcaaaaaggcgcagctacccccacgtgggtggcacgctgcataggcaccctcacgctccccatgttatcgacgagatgtgtagaagacgtgcgcatactaacattaatgtgggggagtggttggagcaactccctcgccttgtcagctttccctcgatgtggctacgttcctcaaagggaaacaacttacatcggagatggttgggcttcgcctccggatccatcgcgctcgcaatgggcacactcgggccccctctcgaggcatgaagagtgcttgggccgctgcccgagtcccaaagacgattgggcttcgcctttggattcatcacgcttagggcaccctacgtactcggggcagcatcgggcacccaagccgttcccattgctagatatatattgttcatcgaatttggacgagcttctcgaaattatcaaagatgaaagagttcatgatgtcacaacttacaagggaggcccttgattgcttgtacttgtctcagtatcttgaagatgtagatcttatacgtcgtgatgtgtaccacagcgccctgatgacccgaggggaaaggaacccggttcccatttctttgacactatgtgacatgtggatagttagatggctaaataattactcacttaactcacattagtgatccatacgtgtattttgaaagtagagtgatctatatgacacatctaaacaagttggatgagcctgcatgtattttactctacaatatttattgcaaaatatataaaacattgtttaaatacggaggtatatcattcgtaagaaaggaatatcataaaccgaaggaagtagaagttaggagaaaaacattaccattgagaatcattgctcagtcactccaatatgcaccagtgatcaactcacatcaaaatattaagcaatccaaaatttcttttagttttttttctgcacatttatatcaacctttgtattattctgtcccaagcacaatgaactatgtgtaatttgggagacctgcacaaacataccatgaagagatggcagactttatcaatattcatgatagcagcaccacatttaaaagcaagaagaagctcaatggcactgaacattactatcgacaaagagtaataattggtaaaggcaacttacagaatagattgatatttcaatatagctagaatggtgaacaatcatagtgaggcttcatgtttgaaggtagacacaagatcaaggtgggtaactgggcataagtcaaacaccaagtcaccaacatttatcacccgcttttcattgatcaaaccattgcaatatttttgttttgtgcaagaaagaggaaagggcttcggcgtaggtgtatgagaaatcttcgacaattccaagttgggcgccaccagcgaggatgacaggcgatggagcggagtgagaatgcacgtagtggtgacaacgataggaggatgtgaccttcagagagagagagagagagaagatacatgcaacgatgttattagaggagcgaggaggcatcatcgctcagaggatggcatggcggctgggttagcgtagatgattttgcagtggcgggactcggcgcatcagctcgtggggtcagtgagttcactgaatgatccataggctcaatccgttatggatgtatgaagccattagttagaagaacccgacaactgcggaatgaatggggggggaattgtctatgcgtttcactggaaacatgtaagaaagaatgaaactcctccttttttatatcagtatctatactagtactacaaaagacaataatgatcagcccatgtacactaacttttgcttgttttacaaattagtgtatgatattatgcagtagaatgtctgttggaataaagtgaataacatatatttaaataaacatgtgcattttacccatagcaaaatatgggaattttgctaatagatatgaatgtacataatacgtaagtacatcaaattcgaagtactcctagatgtagtatatcggtcctaaaataactttatatttaatcatagtaacacaaattaagattttttttaaaaaaagctaaagtgttcttcatcaatgaaaaaaataggatcggtgggtggataagtaagagatattaaagagataaaactaatctatttacatatcaaagtaggtaaagagtaagaaatgaatatttgggacaaatcgtgtatatatgcttaaaaagtaaagttaatttagaacaccgaaaatagtacattcaatccaagtcgaacaaacaaacatatgatctggagaactctcttgagccctgtcaactttcccctccccttgctacagtagatcttccgttctccgcccctcccccaaaatacctgcatttcatcgaccgttggtgagggttggaggaggagtctagccacctcccatattagtatagtgtagctaggttgtagtatttcgtcaggttcttactatgcttttgggtatgtcccgtgtgatttctttttggcgaaggacccgggatgccgaagtggatggtggaggtgatggtttccagaggtggagctgtgagatgcgaaggtctgttaatgaattgagggatggagacatcttcttgtgctcgtgttagctacaggcgccatgtgaacgcggcgttggccttggagctttgggcggcattgctccgtgcggctgcggcgttgtccatgaagcttcgggcggcagtgctctgtgtagcagaggtggcctgagagctctgtgtagcggcgttgttctatgtggctgatggctatggagctctaggcggcagtgctttgtgcggcgcggcccacagcttccatggcttcgctgttgcctccgactgctacttttcggtaacggtgaagatcttccatggtgtctcctttctccaatctgagtatctcttcttcattggcagcttgctcctctcaatttgtcgcgtcctacttcagtttctgctggatttgagctcacagtgcttttacaaatcttcagcaatcctcagccttctgcaaagagaagttctattgcacccatctgattattcctgtgatgttggctacctgttctttggaatcttacttccttttgtttcaaaatagtagtatccatgcatagttcgagttgagcaaattatgctcctcagatctaatggaaaactccgtggaactaatttgttgagtccggtgacacctacatcaagatctacggctcagcaactaacctccaattggtgccatttccgtggtgacggccgtaggagctttccggtccgtcaagcggtgagcattccgtggtgacagccataagagctttctggttcgtcaagcggtgagcatgtaaatggaggcccaagaaactcaatcgatatgatactctactgctgtttagtctcttctggaagtttgctttcttagattggttagtctctaccctactaggatgtatcccgtaaactctatcttgggtaataaagttgtttaagttattaaaaaaaagagaacaaacgtacaaatcggttggttcacaccggcagagacacacacccatcaatcctcgcccgcatcttttggttgagctgtagaagaaacaccagagcagagcataccagtattgcacgtacaaaaccggccgggccggctgggtgggtcggagtggacacgtcggcgacggaaccggttccccctggggtcactgacatgtggtcccatcacactcatcatcggtcggggtcgtggacgcgggggggggggggggggtg

SEQ ID NO: 27726 - DNA, 19239 bp, Oryza sativa
  unsure (1)..(19239): unsure at all n locations
gccaccaccgtctccgagtgcctccacacctgtcagttcctcctcctcctccctcctaccttcctcccaccacgccgtccgtgttgaattcaattcaattgagctaggatccggtttctcccacgtccccgattcggcgccgtacgtggggatttcgccgtcgccgtggctcccgcgcgttgacgtgtcgcggccggccggggatttcgccttcatgggaggatatgccctcatgtcatgcctctgtgccttgctaggcgtgacccgatttccaacgtttcccgtgtgctagctacctgctccacttttctagtaacaccgtaacacgcactccaggaggggaatgccgtgttgtttcacgtaaatcattcacccgtctcatggatcgctgatagctctgccatttttcctttttttgattgagatagttaagcagctcagattcactaactgtcttactgaaagctcgggtgctccagcatggtaatctaccaagactgggatgagctcactattcatcttcgggagacaaggctggcctaaatatgctacttttatgtggccccaagcaaatgctagcgtctgtttaagattcgggagaatgctgcatgcatttccgggttgtcgatttggaaacattttgctcaagtaattaatgttaggctgtccattgtataaagcagagtgaaatgctacagtagcaacttaacaaccaacgtcattcaccaacgacacaagtagatcctgggttgaatgttgttagtaactagtagtaattcaaaatccagttgtgctgctacttgcattctttatgagataatttcggctctcaaatttatactttatcctcctaatctacatatgacatgccccaatatctttggtaaccgatagtatattttcagttggagttgaattcaggcagatgttacatatccgctattacgctattgccaacttattcgttccacttttaatcaattggaacagtgctgctagtgcacatctggtcagcatagaattcgccttttgatattttcagagttcatttggaagaactttcattgtttggcctctttttgggataactgtagttttattagtggttcttcggtcttatgtgctaccttttctatggattcttgaccctatcactaatttcacagttaagtttacaacacaatagtacaagtagtgagaaaaccagttatgcgtcttgacttaatttgataaaaaaaaggtaaaaaaacacaatatttgattgctcatagattccacagctctaattttttcaccctgatgcagtttgcagaaagtgtatatatgagaagttgaatgatgaggaggtagaatcctgcccagtatgtaaaattgatcttggctgcactccagttgaaaagcttaggtatgcttatcatcatgtatatgcactcaaattttattgagattgcttgtccctgtagcttgtaaggtcaaaataactgtgtatttgcacttcaattttgactgtactgttaaatttcctgcatcttctatttattactcctatatgatatgactaccaagtggggcatagtatgaatagagcatgtcaacttggtactttgattgagatttccttaataaacaaaacactaggaagtaatacagtgggaaaaaagtagaaatgttacatcctgaatgccttggtgactgtttgtttaactccaagtagctccccactatttgagtaaaatatgtacctcagggtttaaacagtatcacctgggatattatggaatcttagacactttttagttaagctctacgtaatacagtaagcaatcatacaggactattttgtacagtgttgattctgttgacttcagtttcatgctttttgttctgcagaatgtaatctggaacagatattctgcctcttgtaaattcatatgctctaaagaagaattttgttttcctgctcttatttctgtagttccttgttgagtgtactgatcccaaaggtttgctctcattttactgtatgggtactttgtagcctgtgaagccattggtacttgtttgatgatttatattgcatcctgtgaaattgcattattaaagtatttatcattgaaaatgcatctgatttattttttgcatatgtcctttagttggaaaataaatttgacgtacttctattcatgtgattctgcactggtgtttgtggcctacacctacttatactcatttctttatgttccaacttcagggctgatcacaatctacaagatgtaaggtcaaaaatatttccattcaaaagaaagaagattagtgctgacgaagtagcagctcctgttttacttcccagtaaaaggaaagagagatctatctcttctctggtagttgatacgcctacagtaacaccgacaggcttgacagggcgacggacaagagcagttaccaggaaagctgctgccttgcgtggccttggtcctggtattgatgatcctgtgaaaaaggaaattgataatggtgaaaagcatgctcagaattcaagcttgcccactaatttgggcaaagtgccacaaacaagaagacaggtaaacagaccacaccttatggggtacccatctctcatgcactttaatgaaagttacattggacttggctgtgaaatagtgatactaattactaagttttcaaactacaatagctagaagaatgcacatgccagcaaaaattgatcctgttgtatgcagatgtcatcaaacgcagaggcatcgaaccattcctccaataaagataccgaaggtgatcgcaaggacctggccgataagactgatgagctctggagacctttaaattgtttggtagaagctgcaaacaggacaaagtcctcccgatcaagttcacagagtccatttgttaagagagagcaacttagtgactctcctgggagcacatctgttaacaaaacaaagtctagggaatatatgcagaaatccaaaatagaggatgataagaaagatgtacctttgctaaaaaggaaaaaccaaaggactggacggaggagagaacttcatgcccaatctgatagtaagcctgaagctgcagctacacaaaacgaaaagaaattcagttctatatggttttcacttgttgcatcatttgaacagtaagaattggcgattcatcgtaatataactttggtttaatatttagggaaaaaaagaattgctgccatgaacttttatctgatcctgttccttttttttcctgattattttcagggaaggagacccacctttaccacagataccttcccattatttgcgaataaagtgagctcccatctttcccagcgtttccttaaggtttatgaaaattatagtttaatctgtacatggccttcatatagatcttgtttggatttatcacactggactgtcagtagatatgttatgataacaacaccaatatccaagaaagaaaatgcattagggaggaacaaaagaaagagatacttacatgatttgtaatgactaggtgcaagctgataatataaaagaaaattctttgcatacttgagctgattggagatagaagtcacttggttagtttcagtgtaaattattgtgaatgaggactttgatcttccactgatacttgaccctgattcaagaggcagcagagccgaggtctgacatttggcaacatgtgtgtttccagcttctgcacttctctgctagtctgttagctacaatcttggtgttgataaactgtttctttaactacaaatatcgtgctaaaattcgagtctaattaatttttagttggaaaatatattttgctcgcaaacttctgctaggtgctagacagtgtggctgcattcaagagttggaagatatgctggtctatagtagtgttgtatgatgcagattcagttgtataacatctaggtcattatattattttgcgacttgatattagctggcagatctgattatggctattccacactgtgttttacaatagagatggaaacatacctgcctcgtcaatccagaagtacctcatgcagaagcttggccttcctaacgaggcagaggtaagagctatatctgcctcgcatttttttttagattactatcatgtgtgactggtattgaagtagatcttttggacactcttgtgctcatctggacacggcaggctgcagatttgcttcatttctgctctagtttctgttatgggcctcttttcgcaatttgagctacaaattatgcttatcagaatccatgtcatgttgatgatgggtcaatttaattcataagaccataacttccagtttgctgtgtatttgtttttccaaaactgtcattttcctattttctttaatcgtccccagactgtatatcattttttagataatggaaacttttattgaactcagtcaattacatcaaggtgatacaattatcttgagaacacttccggcctctgcataactaagatgcacacagctaaacatacaaaaccacactcaaaaggaaaaaagaatgacatggagtattgaggaccatcaatccaaagactaaattgccacccatgaacaactccttggccatttcctccaaaagcataagagccaccaatcctaagactagatcgccatccatatccttgggtaaaaaactccttgaccaccttctccaaatgtagacatgccgcaaccaccattcccacgaaccatatccagactgcatatcatgatactaattgttactccctccgtttcatactgtaagactttctaacattgcccatattcatataaatgttaatgaatctagatatatatgtctagattcattaacatttatatgaatatgggcaatgctagaaagtcttatattgggaaacggagaaagtactatatattttcctctccccatagtagaatacctcggagcatttttaacttcctgaaaagattcacacctataaacatcgctgtacttgtcgcaacattttctttatcatggaacttgttttacttagtagtgaagatccactgtaaggtcatctgaaaatatcgacttgtctggatttacaggtcgaaataaattgctgcgggcagccagtgaaccctacacaacccctgtgcaatttagtagaggtgtggttgagggggcgatcaacacagacaacacagaccatgataggctcccctgccaaggagtttgtaatggtgctaacttatgggcggccaaaggccatcacgccatgaatggcaccacaaacacaaggctcaagccatttttcgcctagaggcgggtcccgtttcctgccattttattgggcccatggaagaagaggtgatccgagataaacctccttgatacatacatagcctcacaagtcacaatgcggttggctcacttggcagccagcccttggcgtcacattcatatgcattcattgatgttattcgattccattaagattgtctttttcttcattatttatattatacaaaaaggtgtgtaaagattagcagaaaaaaggctgttgtgaattatctgtatacctgtagtcattattgctgtttaggttggttataaagagtctatatgtatgagatgactagataaagtggatgtggatcgcaaaatttgtcttccagccgtttcatggactgctgtaacagttactagatcgttattctttttggagagcccagctttcattcaaagcataagagtacgttacagagcagagaaagagaagaaagacagataaaagtaaaaaggggcaaaaacctggggattccagcttaacatgaacagagcactatagctgctggcacagctcaaaaacaagccaggaaacacaccaaagacacttaagtattactcaattcatcagatacttaagcctgctatctttcggatactggcaagcagtaagtcccttgaagcgtccagagtactcttcttcgttggcgctagttttctccactgtaaatgtaaagaaacaaccttgtaaggtaaatgagaagcatcatcgatcattttgttgttgaaaacccagtcattttgcaaaagccaatggcccaagagccagcagcaaacaatgaaagggaagtaatgtttgaatcacaactttgcattttcagtttatccatcaactccccccttgatctaggaatgccactccatccaaaagcatctctaacgcagcaccacatgattttggatattgcacagttaaacatcagatggtctacatcttccacttcacacaatttgcaattagggctggcattccatttcatcttctccacacaatttgcaattaaacccttcgcataaccctccctaaccaatcacaccgcacctcaggtttcgcccccattcctcaacaggcagcgggcagccccctcttgtacctagataaacccggaagaagcatagactgtcgcagggcccatccatactccatcacgcccactcttgctcggatacgttagctaggtcaagccacactacagatccagccgttgccatgttggcttgtggtaagtacgggtaattcttccaggatttcccaagaacttccccttaattgtcatgggtgcgactagcaaaaccaagcacccataacccaccatttaagcatattttagttcaattattaccatggtggtaatccatcattaaattaaggactaataatttatgtgaaacccataatgtgctaattgatctaagcatggctaagcatcatctaaaccaatcatctaatcatttcatatcccagctatcaaagatataggttaaaaatggctgagtacaataggtatccatcccacataacatataaaataatacaattttaagaagaaagcgggaatttataaaataggtacaatatgatcaatatgtatgtatgacttgccttgctcctgagctggagagacatatgcaaccacttcgaaatacatgggagcttcggaactgccaaattctacacgacaaacaaagcacaagcaatacatgctataagtctactgaaataggaaaataaaccatttttaatggattctagatatttttatgaatttattgagacttaaatggattaaatcgaagctcagatgaattagatataaattttagaatattcattgtgtatttactataaaccagaaaatccttattccattattacgtgttgacgcctgtgggcggacaaaacaaggggatacgacaacagcaagcgggcctcatgggtcagcggctcattgagccgacctaccgtggtccagggccatgcgggcggtctactgctggtccacgataccggcggcctgggtcggtcacgaaactgactgagtgacgcaactcggcacggccgagccaggaaaacacgggaaacacgatgtgcgacaagcgaccggcaaacgacatggcaggaaatggccagggcgacatgacgctagggcggcgggcagttggcggcaacacggcacgagccgacacggcggcaacaacggcacgtggccagtaggtggtggcagacgcaggcaagcgccggcaacgcgcgacaggcgcggcggcgggtaggcaacggctggtgcgacaaggcgggcgctcggcggcggcatgcggcagcggctggcgcccgacagtggctagggcagcgcagcgcggcacggcaaggtgtgggtcacattgattcagcttgccacgtgagctaaagccgagcgtttaagtccgtttttgtaaattgaggtaccgattatatatttgactttttagttaagggacgaatttcatactcagcaaaaaaaaaaaattgagggaactagaatgaacttattccgggtgctgctgttccctgggtgctgctgttccctgacggcggagggtgtccgaccagcccaactgtgttccacgtgactgtcctcggccttgttgggtcgaaactgtgcgattcaagactccaagacccatcatggcagatatcctaaggtttctttaggggaaaaagttcacttgaggtccctcatcttgtcgtcgagtttcaaaatcgtcactgaatcggaataccagatataatgtatccctaatcttacaaagccggatcgtattgggtcccaaggcagtattaagagcggttttgaatgatgtggcgttgacatgacgcttaattttttttaaacaataatcatatggggatccacgtgtcagtgaaacaatatattcttccttcctctctcttaccatcacgtgttcgaaggttgtaaagcgaggtcgcgaggcggcgagggagctgggacttgggccgtgctttctcgagccggcccaaggcacgatggctcagtacgaaggaaagcacggcccagcacgatacggctatgggccgtgcctgggccgtaagttgaggcacgttgggcggcacggcacagcacggccattgggtcatgcttgggccagcccagcacgaaaaaggcccgaaggctggcccgagctctagcctagccgaacgcacgaggagtcgtaagtcgccacgaggagatcaggaggcaggatgatgcaaccacaaacaaagctgttgccggctacgagcgcgtacgcttggccacggagagtttgggtcacatgacgacgccattgccggctacgagcgggtcgcggagagtttgggtcacacgacgacgccattgccggctacgagcgcgtacgcttggccacggacgaagccgtgcttcgtcggcccctcgcgacctcgccgcctaaccgtcggcttggatggtgagagatgaacaagctaggaagattatatctttttcactgacatactggtcccacgtcggtttttattcgttatttttctttgccatgtcagcgccacatcattcaaaaccgttattaatacttctttgggacctaatataaccctgttttgtaatattagggatgtgttatatttcggtttaggaatgattttaaaactcgtcgacaagatgagggatttgaagtgaacttttttcgttccttagggcgtttttatccaccaatctctccgtctcgtcccacaccttcgtctcagccgcggcttgaggtgcgtacatgcgatttcctttgctctattccttgcccccgatttggattcgaatttgaagatttgtcgactcaagttcctgttgtttgggatgtatcgattgttattttatatcggatcttgagatttgtcgatttaaatcgtaagtagtaggattacggtggattgattcatattttgcaatggattcatagtatcatgatttgtcttttcgatttgtaatagtagtagtagtattggggatggattgattattattttgccatggattattcgtatcctggaattagtcgatttaaatcttagggcatgtttaaatcccctagtaaaatttttcaccctgtcacatcgaatatttagacaaatgtatggagtattaaatataagcgaaaaaataattatgtagattgcgtgtaaattacgagacgaatcttttaaacctaattactctatgatctgacaatgtggtgttacattaaacatgttgctaataacggattaattaggtttaataaattcgtctagcagtttacaggaggaatctgtaatttgttttattattagtctacgtttaatacttcaaatgtttatccgtatatccgatgtgaaacgccaaaacttttcatccctagaagtaaacacagccttagtaggaatttgtcgatttgagtcctagtaggaatgatcgatttaagtcctagtaggaatttatcgattgtgatgggtggtgaactgattcatattttgcgatggattcatcggatcttgggctttgttcatcaaagcgcttgaggtaggatttgggatggattgattaagttggagtaggatttgttcagcgtggtagtgagttcatcagatcttatgacttgtcgatttaaggttgattaggatggattgattctgatttaactcgagttcgaattgcagaaggaatacgtcaagtaggcgatttggacgcagtaagtacgtccatgctttatctcatcttggacgactggatcttccgcaagattgatttgtcgtctaaccaacctgatgggcggcaggtacctggaggcatcgcgagggaagccgcctcctccctgccaccccccttcttccgctggaatgcacaacgtgggatgcccctgcacttcgtcgccatcggctccaagatcttggccatgcctcccatggaagaaaaaagggatactgatcacctcgacgttggcggcgcctgcttcgacgtccgcaccgggtgcgtcgtcttcgtccctcggcacggcggcgatcagcacggcgacccagtatacttccagatcggcagtaggctcttcacgctagggtgctcccgcttccagctccttgacctactgccgctggcgctggatggcgaccctagaagtacaaggcggcagcaatggtcatggcgcgatctcccgatgccgcccttcctccactccatgcgtgctctctctcacgtgcttctccctcaagaagaccagaccatcctcgtcggcgttgggttcctctccccaagttcttcctccacctacagctttcgcattgcggaggacgggagctcagcctggaaatgccttggtaactgggggctgcctttccatggccgcggttactttgaccctaagctgaatgccatgatcgggctctcgatggatggacgcatctgctccggccaattggtgtctgatcactgcccggacgtgaagtattgcagggagaatctgttcagccgagacgcgcgtaggcgccaccctcgtctacatgggacagagaagcagattttgcctggttgagtctgttgctgtcaactacttatgtcaggagggggttttcagcttcaagcttgagggtccgttttttcgctacatgtttcggctgacgacttttcgtctgaagtttgatgatgatgatggacacctaaccactggtcgcagccgacgggtgcgatactattatgcccctgcaaatgatgttagttattttgcctgtcggtttcccgtagctttctacatatgaacgttttgtggtcggtgtaaacccgagattgattaaaatcgggcgatcgggggaggtgggaaaaatcggtcgctccctcttcccgcatgcgcgcgctcccctctcctcatctggacccacccacttatccctccccttgttccacaaaaatgtttcaccaagtgtacttataatggaatttggtttattttttgttccactggaaaatgtttcacctagtatactcacaatgtttcactatgtatagatctaatgttgcagtgaacgaaacattccattgcaacaaaaaaacccacatattttggaaaccccctattaagagaatttggtttattttttgttccaccgaaaaatgtttcacctagtgtactcacaatgtttcactatgtatagatctaatgttgcagtaaactgaaacattctttcactatttgttgaaacattgtttttatataaggtaaaacaacacccaatttaaacaagtgaaacattttcgatctacttagtgaaataattccgatatacctggtggaacatcgtgcaacatttaaaaataattcaataataagctttttttcgtcggaatatatccatgtgtggtcttgttttgaagatttaattgcaacgaatttaatggtgcaatcggatcatgatttggataagtagtttagaagaaaaatcagtttagtagttttgcatgtaaatcggacgcgatttttcttgaaatcgtcgggcgcccgagccgtaggcagccgtgtaaacctgcagttggaccatgtatccgtgtttggtgtaaaccagtagttttatctgtggtttgttgtgggtggatgactgttacattttctggtgattgttcctactatttctaaggcctggtttagttctccaaatttttttcctaaaaacattacatcaaatctttggacacatgtattaaatatagataaaaacaaaaactaattgcctagttagggggaaatggcgagacgaatcttttgagcctaattagtccatgattagccatagctataagtgctacagtaacccacatgtgctaatgatggattaattaggctcaaatatccgatgtgacatctaaaaattttcttttctgtaactaaacaagcctaaaaaatgtttggttgtacctattgtactaattaatgttctgaaccagtatctaggtagatcgcatatgaattgtaccaatgtattgacttttttgaaacgctttcacaatattgaaacttaattgttttttttaacattaatcacaatattgaaacttaatggttcttttacattaatcttagagctttttgaaggtatgcgtaagctactgctacttctaaatttgtgttgaaattcagatataggatgaggactccgactttgcttgaattatgagcgataagctggtagggtttgaattcttgcggtttttttacctgcctcaggctagccaacttattgtgtttgaagctcgttaaatcccaattttttggggtaactttcttcatatacaggatgaggacacatatccttctttgaaggttcaatcccaatatttttgggttgagtgattgaactttctccagactagttaggtgcccgtgctttgctacggggtaaaatatgtatccgcttaaagttatactaagtaaaataatgtcaaataatcattaaatgtaaatttattataataaaaccttaatatagcccccacattcaaagagaccactcaatctccacacgcttaacctagaaaattcaggtttctctgccattgcaaaatggcaagtgcgttcttaccccccttctttatgttttaattatgattttacacctttttatggtttatgtttttacccttgttttttttcaaatgcaccttcactctacccctattatgttaagataacttaacggtgtcaattcagccataaaaggacaattatacccttgggcattttcctaactttttgtataatttgcatgcatttcaaatgtgactaaacactgacaaaatttgacaacattttaacacaaattgtacggttgcaaaacttcactacaaagattcatcacaaattccaaccaaatagcaaatactgtgagatggcaaaaaagaaaaagaagatcaaacggcaacgacatcgctcgtctttgtggacgagccgcccgcagtgtgtcgttgttgccggcttgcggcgccaagctgctcgctgctcgccaccattgaggggaacggccgtccctgctgcgggtaaccgagacaccctgccctttcccttttcgcatcgtcagattcgctgcctgcccatgcgctgcgtcggagctaccgcggcctccccatagcatctgctatggccttcccacacgctggtcccggatgtgacgtaataggaattactatacaagcaccatcaccgatttttgttgagttgtgatctaaattttttttagaattacacagtacaacacagacacttacaacgcacgcgcactcacccatataaacacatgcacgcaaaccctacccctatgagcatcttcgaagactgggccagtaaattctgaaaagattgacgaagtcaccacaggtgcctcgctgtcgacgggtacgtcgcctaccactgaaatttgtgatccaaatttatttacatttaataaaggccagcttttgccggagtgaagcggatgcccaggggtgcggggacggagcccccgcggtacggatcgtcatcccttttagggttccaccatatatatacacctcttgtaagccgctgtacggtgttgtaatctcaccccgatatattgaagatattttacatgtgtagattggagataattatacggatgaaacacatcagatgatggtcaacgacgtaaatgactagaacaaacaacatatcaaaatagggaaaagataaagtactctcaaaacatacatgtatactctgaaaacatagcaatccacatgacatactacctccattttttaaatgtataacactgttgatattttaatcaacacttgactattcatcttattcaattttctttttgtaaatataaaaatatttaaatcatacttaaagaacatttaatgataaaccaagtcacattaaaataagggtatgtttagttctcaaacaaaatttttcacactgttacatcgaatgtttggacacctgaatagagtattaaatgtagaaaaaaaaccaattgcataattcgccaggaaattgcgagaccaatcttttaagcctgattatgacatgatttgacaatgtggtgctacagcaaacatttgctaatgacggattaattagacataataaattcgtctagcaggttcctgggggaatatgtaatttgttttattattagactacgtttaatacctcaaatgtgtgtccgtatatccgatgtgacatgcaagggtaatttttttccaactaaacaagcctaaaataataataatatatttttttaatatgacgaatggtcaaacgtataaaaaaagtaaacagcggcatatatcggaaatgctcttcgccggtcgcccggcttggggggagccggattggggcgcttccccccgcgccccctccccccacgtgcctacttgggcccaaccatttctgctccccttttttctagaaaagatgtttcacctagtgtatttacaatgtttcactatttataaatctaatattgcagtgaattaaaatactcttttgcaacaaaaaaaaacccacatattttggaaactctctattagggaattggtttattttttgttccacccaaaatgtttcacctagtgtactcacaatgtttcactatgtatagatttaatgttgcactgaacgaaacattctattgcaacaaaaaaaacccacatatcttggaaacccctattaagggaatttggtttagtttttgttccaccgaaaaatgcttcacatagtgtactcataatgtttcactatgtatagatctaatgttgcagtgaactgaaatattctttcgctatttgctgaaacattgtttttatataaggtgaaacaacacccgatttaaacgagtgaaccatttttgatatacttagtgaaacaattccgatatatctggtggaacatcgtgcaacatttaaaaataattcaataataagctaaaaaattttttcgtcggaatatattcatgtgtggtcttgttttgaagatttaattacaacgaatttaatggtgcaatcggatcatgatttggataagtaatttaagagataaaaccgtttaaagtaattttgcacgtaaatcggacgctgacgtcagcgcccgattttacccctcccgatcgggcgctcgaccgggagtcatccccgacatatatacataaaaaaatagagggagaactaattaaaaatagtgaaagtaaaagaataggatccgacacgggtttttgagttgctacatgtgcatactccccagctcagtaaggccattcacagtgcgtcaccaagttttggtgtttcttacatgccacgtagaccaagaactgtattagccacacatctcacagtgcaaactccacaaggccacatacatgtactagcttgtagtgggtcccaccactactacttttacagtttcaccttttactttcccctctctctcccccaactctttctttccccaccacagagccgggcggagacaggtcgccggaacttgggcggagcggcggctcaagcgcaggtcacaaagggggtcaggtggcgtcggctcgtcggggcgcggcggcggcggcgccgtggccttccacggcggggcgggggcggggcgggccggccgggcggcggatcgagggatcgacctcgaacggcggcggtatgtcggcggcggacgcccgacttggagcacgggacagcgaccaagcggactgagnccggggcgggttttcccccagcctccacgcctccgccttcctcctctggcccgagcggcgacggcgttgggcggctgcgtcggttggcgccctccttcgcgaatccatctccatccccgccgacggacggtgcggcgggagcttggcggcgcgcctacgggggacgatgcggcgggagctctggcggcacgacccaagcggcgccggcgccgggggctccacctctcctctcctcgccgggccgcgctgggcggcggacggcggggtgtcacgagcggcatcggcaccggctacgggtcgacgatgaggtcctccatgcggctggctgcggatcgacgacgagctcctccgtgcggccggccgcttctcttctcctccattgccgtcccctctcttctcctctgccggccagatccggctcggcggctaatccgtcctcgtcttcctcgcgctctccactcccttggccggcgcgccgaagagatcggcggcgtggagcgtgactcggcgacacggcgaggtcggcggcacgggagggggaaatggccggagctcgggagacaaggcaagcgggcctcttctcacaacctgatctgcacccaatcgccgccgccgctctcggttctcctttgctgccgccgccgctctccgttctcacggcgaagccaggcctcccgcacggcaccgcgacctcgtttcccacgccaccagtctcgattgcgccgaagaacgggtgaccaactttggtcacccgcgcttgagttttgtgggcccatgctgtaacgtggcggtgaatctgggctactcgccaacgtggaagctcaggccgaatgccagctcgttgcactgtaaatggcctaagagttccccgtaagtgccttcagtttggcacggatccgacacgggtttatgccatcaacaaacattatatatattgttggagtttttttgtttaggtgggtatgaacttgtaacaaatttttgtgttactaattaactgatcatgaaagcttttaaacataatcgtattgattaacaacaaccgtatcccacatgccaatgccatattgatcgaaaatatgatcatacaagttttgtttttattatttattttctcatgaaaatttgtatatataattggattggttagtaaccaaattatcacttttcgtaccatgcatccttgcatctgcgcattgcttaacatggatggcatatacgtgaagaaaaaaaaatcaaccaataacatataaagaaacttgtgaactctgagtgacatataaggaattttctaaaaataaaaacaagttctgcacttcgtatgcgaatgtagtttcttgaaccaacgtcttaatgtacaagtgcagagcatatggcctacaataatatacagaaatctaaaaatctgaactatatatggcctacaatgtacacaatggatgcaaacaaatgattgtgatgcccatctgatactcaaatggcaataaaaaatattgaggatttagttccattaaaaaagaaagagagaaaaactgagcaaatttcatagtagccgccgtacattaccacccaaaaagcagcactatctcaaatttctacagtccccagactaccccaaggtttgctgtccatggaggcgaaaattacaggattcatatcatgcacacggggaatggtttacataatgcaaatattattttgacaatccataccacggtttacatccagaatgccacggggtacttaagcattgcctcagtaacttgtagaggcatgctgtagtaccaaacccggcggctgttaccagttgtcagggctccattcctatcatactgcagcgaaaaggtcgtcaatcgcagaaagcacttcggatctagctgatcctcctcacccacctcatcagcagaatcctcgtcattcgcctcattagaatcatcaaaatcgatctcattcacctcatcaacagaagaaacctcattcgtctcatcggaatcagtcaactgatcagctactatatcatcttcgatgtggatactctccaggaggcagaagttgctttcaccaccacccatgtagacaagagtggcaccaatgtgcctctcagctgggaccatgctgaagagcttctccttgctgatcttcagggctggggggcggctagcaacagtgtcgtcggtagacaccacatcacaagagcagatgtggccaacggtgttgaggtcacctgaaagcccaacccaggcatccagccttgggtcgaagtagccgcgtccagtgaagggtagctgccattggccatgtcgcctccacatcatcggctctgccgttctgaagctgaaggtggcagggacgacgacgccaggtgactgctcaacgctgctgacgaagatggtttgtttgtcagggtgcacagcgtaggaggtgacaaggtcacactgaaaggctggcttggggagattgaggcacgagaagttcttcttccagttggcatcatcatcagcatcatcatcatcatatgtcggtggtggcatgtagagcatgtcaaaggaggcgctaccgagagtaaacaacctgtattcatcaatgggaatgtagatgatggggtcgagcagcacatcctgcagcattggccaagagccgacaacgaaggcccgcgcatgaacgtcaacgatgttcacaataagtctcttcttcttctttttcccgtgagcaggaggaggagtagccagaatcttgtggtcgaaagcacccacgatggacttaggctcgccgcgccgtgcctcgaagcggagcaaggcggatggcagggtgtgcctgccggtgaagacatgatcatctcctcctcgcgcgacgtcggcgggtatcagcggcggattgatgtcttcgtgcgagagcttcatcttgcggatgctacaaccctgcgaccagtcatccaggacgagataaaggtgccgtggcttttcattggaccgccgttttgacatacttgtttccttttgttcgtcatccccttggcaatccaacgcttgcaccagtcaatccaccttaatcatagtggcttttcacattttggtccttttgaaaaacttatttcgcaaatagacccctgaaaaaacttatcccagaaatggtcctttttggggcgcc

SEQ ID NO: 27727 - DNA, 941 bp, Oryza sativa
caccgccccccctcacccgcctccattcctgtttctctgtatgaagttgcaacggtgttatttttattttattttttcggatgttttttcacactcaggatcacgatacaaccaaccaaaaaaaaaataaactcgaactaccacttagctaagtctgaaaatagctagcataccacttagttgcaccttcactaaaattagaccataactcctttagtaaaaccctttgatcagcatgttaaacataatgcactctaccactatatgaaattacttaatctaattcaaaatataaccacatgaaatgacatatataagttaaacagtacagagagatgcaatttttttatttttattttatttttttaatatttttttcacacttaggagaacataggaaccaaccgtataaaacataaactcaaacggacaaaatatgtgacttgtagaattttccaaaactctaccgaaacggataaaatatgtcatctattaaaataggcgtaactttctcatacggactcggaatcaggcaaataatatatgcacggacatttacagaaaaagttacatccgagttcagcaatattaaaacctccaaattccgcttgcaagattgtgtttttgaggagagaagtttttcggtatagctttagaaaattccacatgccacatatttcgtccgtttgagtttattttttatatggttgattcctgtgagttcctaagtgtgaaaaaatatcaaaaaaataaaataaaattaaaaaattgcacatctctctcctctgcactagttcggagagaggagaggagaggaaaaattctataggtcacatattaggtccatttgagttcaatttttctatggctggctcttgtgtatccctaagtgtgaaaaaaatagcaaacaaataaaacaaaaataaaaaatttcggggtgg

SEQ ID NO: 27728 - DNA, 710 bp, Oryza sativa
ccccgcggctggaagtagcagccgccaaccaccgacggcgggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagtagagctcaggcggcgaaggcaagaggaacaatggcgaaaggaaggaagcaaatccttttctcgatgcttttatacccttgccatcgctgggcctggctcctcgtttctcgcgcccactacctcgtccctcgtatctcgccatctcgctccctcgtttcccgtgcccccgcttccactaatcccattcgcccgcttacggcgcatgagggctgcaggaat

SEQ ID NO: 27729 - DNA, 943 bp, Oryza sativa
ggcgccagctactctggcgccccaaaaaggaccatttctgggataagtttttctaggggtctatttgcgaaataagtttttcaaaaggaccaaaatgtgaaaaatccagaaggcggaaactggcgctccgggggccttgcgccggattcgatagtcaaaaagtatgaattactaccgaactattacggtaataagatttacccttctaaatacaataccggacatttgatatcacaaactcttaaaatcggattatcactctaattcgattcgaagcggttttcagcctacgtcgcacacacgtgatgatacagtcagcaaaaacaaataaaaaccggtggagcccacttgtcagcgcttttttctctctcctccttctctgcctctctctcggggaaaagaggagaaagcaccggcaggcagggaccagggccaatccaatagtgagggcaccgaggacagcggcgagtagaggtagaagcagctgtgggcggcaggcgaggagccgaggatggcggcgggcaggggaggaggcaactgctcacggcgagcgaggtgtcgaggaaggcgaccggaggggcggaggtagctgcgggtgacacagggggagccgaggagggctggaggtggcagaggtagctacaggtgacagatggggagcggaggcagctggtcgcccgacgaggatgcagcgtacgtactacacgccggggcagccctcgcccggctctgatggcggccacggccgcggcgagggcgacgagacgtggagcgaggcggcgggatcctccttccccaccgtcgtggctacgcggagctcggacatgtcggggttgaagaaattggacacggcgatgctgctacagctgtccccttgcccttccctgcgcaaagcccgctgaccggttccccctcctcttctcgcgccgccgccaaccacccg

SEQ ID NO: 27730 - DNA, 3120 bp, Oryza sativa
ggtatttcagtcaactgcgatagtgggggaggtaattcatacttttttctttctaaaaaaagaaagaaaaagggtagcactgcgctattactggttttgttacatgttctgatgtcatagttgttaaaaaaaagaaaagaaaagaaaagaaaatacatttcaaatcgattatgaactattactatacgttttatcttcagtgattggaggtaattatacgagattgaaaatatacgattttcttaatttagctgggaaagtctaatttgttgctagtgttgctatgagaaagaaagttcaaaagaacccatccaaacaaaagatcctatccacatttaaaattttatgaactagagtgcatcggcaagcaattttttttcggaggcaatcctgattatttgacaaagtaaataaacgatatactatgttctggtattataataaaaaaaatcctttgcaaatacatgcgccattttctagcaggcacgctccagccaaacatgaactttggtcggtaccatatatgcttcacaaatatcaactatacacgcatacaaaatgacaatgtcatgtacaattaaatcgacataattgtctcttaacatctcatctcaagataacatatttatttaggtcgtcacacaacttacaccatacacatgctaaattataagacaatctcctaagagcaggtacaatagcagactataatccagctataaacatattttaaagagataaaagagaagagagaagagcagcgggctatagatatatagccagttatagcacgaactccaagacgtaatacgtgtataacacgtaggagcagttattaaaagtataggaagcaactattgtatgaattggctattacattggttatagatgatttggagctagtagttggctatactattaaacttactctaaattacatgctttcataattctccatccagcacggtgtatatataaaagatgcacacatgccttgaatatacaaatcatcataaggtttcgggaatgtactacccagattttgaactttcgagctattaaaatgataatgataggcaagtcctgtttccctattttggttcagaaaaataacttctttataaggatggaatcccaaaattgaaagatatccgtggcatcctccttcatttggatttgcagtgtcaagaatgtcatcgttgtcggagtcccactcaaatttatttactcgtactaccacatctttcttgatatcttagtgatttttgtaccagacactctcatattattcatagtgatatttcctaacgatgtgtttcttctaagcttcataatagttgtccatgtcattttgactgggatatccaaagtagttgtggtagtgcaaagtccacggaccatcattttgtatacagctttcctgacaccttagaaggaaactaagatcattgtcatgcttcagttcccatgtcatctgaccatataactcattgaggaaccaaacccgtagtcggtgctcaatatcgattaatgcatagtgcacacccctcattgatcttccgacaaaatggtttatatattgacatactttagtattcatcggtaactcaagtacttggtgcttgttattcgacaaggatattctgcattagaaaaaaaacaatatatgggtcataaataaaaccattgaaaaaaatataaagaaagaagagaaaacaatataagcacgataaaagtatgatgaacttgtacatcataataaaatctccctggcaatgtacataaagtgtcccatgccaatagactgcattatgatgatcatatggaaaagccaatgccatatcagtaactgtgcaggcagccgcaccgtctcgtacaaacaatcgctctccccattgcctagtccttgatgagaacacttgcaacacacatagtaacacacatagtgatggtggccgttgcaagctcttaagcataggatctagcacacgaaatcctatactcggaactcgtgggattttgaagatctcatagtgtgttgatatggtagggtcgaacacaagatagctgtcaaaccggtagaagtccttcatctagacgggctgaggtggggctggaggagaaggcgtccactgccgggtagcagggttagccacgccagactctagcagaaggagtctgttgcagtgatcctcgactaggttgtcgtcgggcgtgtagtcggtgaacaagccagagatggcgaggtgtgtggagctgggacgggataggaaaacaccgaatgctgcatctcatggaagttgatgtagatgccggcgagcgagagagggaggaggtcggctcgcagcaggcggcgggtatcgatgatggcgcgccatgccttgcagacgcagcgggacgcggcgagccatcgcggggcgaggcggccgaggacgtccgcgagcacgtcgtccggtaggagctgcgtcacgtcgtggtgcatagctcctccatcgaatctctctctgttcaattaattcgttgctcgataggtttttgggtgcgtgtacgcgtacctcctacttgtgggcggtctgttaatctatggacgagagtaaagcgcgattccgcgtttgttttccactccgagtaaagcgcgcgctgggcgctggagtgagagttttgcctgatacatacggagtcgatcgagggattcttatcggttggacttgggcgcaaatccgttctgctcccagacttgggcacaagaccactgcaatactaacacccagcatgaagaagccaacaaaagattggacggctgctgcatgcatgcatgcgcgccgtcgataccaatggagccatgagcaggcggcctgctgtgctgccaccgcgacaggttcgatgttggcgacctcaattccgatcgcaggagcaagaagggattactgatcgaatgtctggctggatgcatttctagttttttttttgggaggattactgatggtatagttgttaagaacaaaaagacgaaaaactcgtcccactcccaccacccgggtacccgccctctatgcgccacaccgctggcactactaaaaaaccgtttttgcaaacgggcagaatgcattttcgcatgcg

SEQ ID NO: 27731 - DNA, 1527 bp, Oryza sativa
gtcgccgaggtcggtcatcaccggacccgagccggatccgctgcgcccgagcttgccgccgccacccgccgccgtcgtcatggccgaggttgtcgtcgccgcggggaggtcgtcgtcgccgcacctgagccggatccgccgccccccgagctcgtcgtcgccgaggggagctcgtcatcgccgtgggggagggcgccggcgccggatccgcgtgggaggagggcggccgacccctgatctgctcgggggagggccgccgccgtcgccccccgcgtgccgcctctcgagcccgccgccgccactgccgccgccggcctctgtgcgtggagaggagaggatttgagagagagggagagatgaagagatgaggactgagagagagagagaagtagtagataaggccggttgaagtagtagttgaaatatttttgaacggttgagagggaaataggaggcccgcatataaaaatggagcacttatttttacatgcggaccacttaagcgtccgcatgcaaaaatcatgtgttttttaaactttaaattgatttttatgacattaaatcaactcatgtcaaaaagttgtcaaaaacaaagttgtagaactcattgagatctaccaattttattttggtcatttctccatccgagtttgattggactatacaaaatttgaattttaaaatataagaaattcaaataatttttcgggtagtaaatgattttaaatgaaaaagtcatcaataataaagttgtataactcatcaagatttacaacttttgtttttgtcattttttatatttgacattgtttcaacagtttgaatttgaatttcaaaatatgacaacttcaaacaacattttcaaatactaaatgatttcaactgaaaaagtcatcaataacaaagttgtataaatcaacaagatctataacttttattttgatcatttattcatccgataaagtgatttgtaagattgttcacgaaatgtgcatatcatatagtttataaaaaatatatagtttataaaaatatcagagagatgtacattttgtgaacaatcttataaataactttatcggataaagaaataactaaaatagaagttatatatcttgatgagttatacaactttgttgttgatgactttttcagttgaaatcaattactgcttcaaaatattatttgaagttttcaaattcaaaattttaattgataaaataaagtcacaagaaaaaaaaaagccaaataatagcagtaagaacacaataaggatgattttagaaacatttagaaaaaaaatcatctaatttggagttcatatgagtgagatacaccagttttaaatttttcaaattttatttttgcatacgtcttcttaagtggcccgtgtggaaaaatcgatttttccatgcgggcacttaagtgagccgcatgcaaaaatgagctcatttttgcatgcggcccacttaagagcccgcatggaaaaaacgaatttttccacgggccacataagaagacgtgtgc

SEQ ID NO: 27732 - DNA, 1079 bp, Oryza sativa
tttttccatacggaccacttaaggggccgcatgcaaaaatgaccatcgatttttgcagacgccactagttgtggtccgtttgtaaaaatcaagaggtctcgtatagaaaaatcactttttttaagtagtgtgggccgtcgtacggcacgcccggagcatcatgcacctgtcttaccgggtaacgatcgagctgttttctttcttctgtcgttgttgaaagattttttttttgaaacaatgtcgtcgttattttcttagatttggaatatatgactcttaccctttcttttcgtatgcagatgccatccgctgctcaggagcagggttcactttatcggtttgtgcttttatatcggggtcaccgaaattccgaaattttagaaatttcggaaatttcggtccgaaattttgagcaaaatttagttgaatttgaacaaatattacccaaatttatgaaaaaactgaaaaattgaaaaattacagccgaaataatatcgtatcggaggggactgaaatagagatggcaacggggaattcaccgtcggggtcacatccacgtccccgtccccacagtgttaaaatttcaccgtccccgtccccgcgaatcaccacagggctacatttcacccacccccgtcaccacgcggtgaattaatccccgtggttaccccgtagagagaatcagagaagggacggcggacggcgaatggctggaggcggctggcggagagaccacgactggaggtggcgggcggcgcgacgaggctggaggcgatggcggcgggccgcgcaacgagggctggaggcggccggtgtcgcgacgaggactggatgaggcggtgtgctcggcgggacatcgcgcccgcgaggggacgcggcggcgcgttcttctggagcggcagcgacggctgtgtgggcggcgtggagttttggaggggagagggagatggttgactagggttggaatatatatacatgtggttattgggcttcaatttgttgcgccaaaacgactataaagtctaaaacaggtcctagctgctgtgaaatcgggtcaccgcggtggacggggacgggga

SEQ ID NO: 27733 - DNA, 16222 bp, Oryza sativa
ccattagattctccatggatggtagatatcaaccattcccatcccctaatgtgtgaattcaccgcggggaatcggtgattgggttctcattatcatctctagaccgaaatgaccagaattttcaaaatttcggaaatttcgatccgcaatgtctaaccctgctcaggagcactcccttgctgtcgcacgcccggatcatcacgcagctgtgtaccccatggatggtattatgcctccctcaactctgtgttctttctctgtcatatatcttagaccagtaggccaaaccagcgcgtctccacctccctggatgaggccatgaggtgaccttagccattagcaagagccgtgttatatggtactgttatgttcaacacttgtagttgatttgttctctaggcccctttttttttttagataatagattttcattaatccagtctctatatccacgaaggatatacacagccaaaaggaaacaagagtacttagactcatatctcaacaaggagaacacaacacaaaaaaaaaaacaaacaacctcggcacatcctgcttctctgtctcccgccatattctcctgaaacggccgcccctagtgtgccgttgatgcaaacctccatttgtgccatcttcatcaatttcaggtaagctgacgtcacgcgccgcttattagcccactttcaaccgccgtcattcgtcgtatagtcggaactagacaactagacacgaaccgacgggatcggcttccacttcgccggattctaggcatctactatccaaagtgctcaaaccatcactgtctcgagccgccgcaacccctagggccgccggtgccgacgggagccgatgcgtcctaggccgcagcagcccctagtgccgccggcgctgacggaagccgtccttgtcctgcatcgtagcccccctagggctaccggcgctgacgagagccgccgcagcccctagggccaccaacgccaatgggagccgccgctgtcctccgctgcagcctttagggctgccggcgccgacgggtaccaccgccgccacagcacccacgggaaccaccgccgccgcagcgtcgatgggactgccgccgtcctcctccgcagccctagggccaccggctccaacggaagccgctgccttcttgggccgccacagcccctaaggccccctccgccgacgggagccgttgggccgccgccatcctccgccgcccccagcaccgtcaaagagactccgtcgcctatgccttgccacctccccgccgccactgtcctagccgctggtcagctctggcggcagcatggccagatctgggagctggggggggagaggaagagacgagctggggggagaggaagttgggatctgggcagaggccccgttgccactgtcctcgccgctgcacggacgtgcgggagctggctctagcggtggcaaggcagtggaggggagggaggaaaccggcggcggcgcgggatggggtcgctacccgtgtcgcccgtgagagcgacgtgggggcactctgtttctctattctctaggcctctatatagttgatttgtgtacttaaatctaatagagtaaagtgcattggcggtccttaaacttgtagggttgtgttatataggtccctagactctcaaaatgcatatctaggtcccagaacttgtcaaagtgtatcatctagatcccaaatcgacacatctcatttaggatcctacatggcgctgatgtggcatgccatatggatgtgacgtgccattttctttattttcttcatttcttttttctttttcttcgttttcttctcgttcttctttttttcctttcttctgctcgggtcacagagaaaggagaagaaagggaaaaaaagaagaaaaagaaaaaaggaaaaaatttaaatgggacccatttgtcagtcaaaatgatgtcacgtcattccgtgtggcatgccacatcaacaccacgtaggatcttgaaggggttgtggcgatttgggatctagatgacacactatgacaaattctaggagttggatatgaattttaagagtttagggacctatatggcacactgctataagtttaaggaccgcccgtatactttactcaatctaataatctaaagggttaccctaatctaaagctggctcttttgctagcttttcattggtccacttttttttaactagggcggcaaggcccccatttctcttactagaaatgaaagtcattacagatagtcttgaaataaaaaaaacaaaaaaaagaaagaaagtcggtccactgaatataacagggacagcaaaaacatgcagcctaaccattacaggcctgactagaacatagaacccagtaacatagaactaaaaccattcagacagtccaaaagctttgacacagcacagaagtaacaaaacaggcccagctgccgaagaggactatgtcaagccaattcttctgatgcctcctcgccagccgtgacttgaattgaagacttcatttgccacctgtcttagtacactggttcccagctgcaaacttcttcaacttgcttcttgtttctgcagacaagtcgaggagtccaccagattgcaagccatatacactaagtcactaggatcatgaggaaatttcatttcaatacaagctttgtttctagatttccaaatagtccagataacatcctctatcacgatggaggtattgtgtgctgggatgcggagtcgaatttggaaggagtccaaatttggtatgagtggttatgtaaagtttgtttcttgtacgagaaggtttcctagggggattaggacttctagtatgagtttggttcgtgactttaggctgcctacctcgggtataaatagagggggagcgtgaggcttccttgcttttgagagcaattgagttgatagtttagttagggtttcgagtttactcgagatttttgtaaggtgtgctgttggcgcactttgtaaacacagagagaatcaataaagtcgtcttcgatttgtgttttctcgggtgcggcggtccaaccggcggtcagactagcggcatcgcggcggtcagaccagcggcggcgacaagcagcagcaggcgatttttggcggttagaccgattgatctatatcggtgagaccgacattcatcaggcggtcagaccggcgcagctacttcggtcagaccgcgatccgtcgaatttgagggtaacttttatttccgctaaaagttttggtttttgggcataccaaccattcacccccctttggttagcttagttcttgctgttcgatcctacaaatacaagattttttgtaaacttctctatattattgagccaataaccaaaaagattatgtctatttagacaaggcttaagattcagagcaacagcaatgacattccataacaatctggccaaaggacactcataaacaggtgccgaattgtctcctccttatcacaaaaaaggcattcctccaacctcttttgaaaaggttatctttggtgagtattttgtttctggtaaacaaccaaatgaaaattttaattttcagaggaattttaaaactccaaatctttttatgtggataattgacctgttgcatgttgagagccctataaaatgatttcacagtgaatttcccatttttggacaaagtccaccaaagtttatctgtacaattgtcatctaaattcaaatgttcctagataagaagaatcgtttcccaatttctaagtttgtccccccgcaaatcccttctaaattataaatttatactagagaaaaaacacctaacaatcatatgtgagaaaaaatctagagaaaaatatcacatatggattccaaaggcttctaaaactatcttcctttccaaccacacgaacctctactcctttgccttctataaatataccacgcctattcgatactactcctataactctaaaatatatctaaaatatatagtaaacctaaaattattaggcaaaaaacaaatataaaacaacgaatttacattcattatcattctttaaatattctatgcctactcggtactcatataactctagaatatatatagtaaacccaaaattattatgcaaaaaaaaaaaaaagaaagaagacaaccttgtttttatatatcacggaataggatcagtaatacctcctcagctaaaaaaaataattgtgtttttttgttaaacatgatatgtttaaaaactatgaatatattaaatgattgatctttaaaaaattcaaatccacaagcaaatataattaaaaccaattaattttgattaatctcaaaatttattttacttatttggatttcatcaaaatttatgtataaaatgacacattaaatttggtatttttgcttgacatgacatataagtcctaatttttttataaaaaatatgtttttcacttgtatatataataaataaatcatttgtaaatccataaatgttttttaatatcatacatccatttgtcaaaactaaaatagtggttcaaataagaaaaaaattatatacatattttaaattagggagcacacaaattttatcatgtagtgtttttgagtgataagtatatgtgtgtgtatatgtatatatatatatacacacacacatatatatatattctgactagcaagcgtgccaacagcacactgattttctggttcgcatgtaaaatagttcaacggtgttgttttcttctctattacaaatctacaaataaatgaaaaaaagtagtcatctaattaatcacatcatcagatcatcccattttgatattatcattcaattctttagattacagtgaatagcaatatcccaaagccaagatactcaaatcacagtttgtggtagcaccctaagccctattagagttgattaggtagagagtggtggtccacgacgccccgcctgctcgcccgcatggccttgctcgctgccaacactatgctagagtatttgggcttggtttgcgctaccacgaaacgctgccataaacgctgtctctgctgatgctttttgtttgactggaatctctgctgatgctttgtaagatgagacatctagttgaaatgcttgtgcttttatttgctgttgaaatcatttgctctttttgcctcatctttccctcccagcacaggatgagcattaacttgtgaagctgacaagctggcatcacagctagctgattcttgcatgaatgggtcttcccccgatattaagtgctgcgagaaaattgtagacctgtcccttcaaacagaaggacgcagccctgtgctacggcttcaatggttaaaatatttctgctgttctctaatcaatgaaatttcaaataatgtgttcttttgcatgctagctagtactaaactggcactgtttcacgcgtgcagaaacaaaagacgagcagccaaatctttcgccttcggctggaaatggcgttggcatagccaaagtgaagcagcctaaggtgatgcttgatcccgtggataacttcagtaactgggattggtacttgatcccgtggataacttcagcaactaggattggtacgttatggcaatcttgtaggtggtgactggacttcagatcgtgtacgcactttttcgagaagtagtaaattgcttgccgacaatccttgcacggaataatattcctcgtcaagtgtaagaggttagaactcttggatctatatatgagttggggtcgatggtcgatccatgtatctctgaattgtagctgctgccttatgcatctctgagttaattgtaggtagttgtaggtagcagctacatatgtatccctgagtattcttgtatcttggatctctaaacttaagtctggtacttatttattgaatggctatgtattaagcagtacgtagagcgtgatattgttccttttcttccctgtcatttgctgttcagatggcaccaccttgcatctttgcattactcagctgtccacactaacgattactggtggcctctgaagccagctagagttggaaggtgttgactactcctaccattgatttcatggaaacattagttatggaaaagtaacaaaataatcgccaatgctgttggaaaataaatattaaaaggtgcacagctaagttaaaaaatgaacttaaaaatgtcattggttgaagttgaagcgactgattttgctgggaaataagtccactttaggtctctcaatgtggattttgaatcacgtccctaaacaacaataccaaatattacacgtttcccaaattacaataccggtgtaccagtgtgatgacgctctctcgtggcccgattttctggtgaggggataactcttgctttgatcgagtgcgacatttgcgatgtggctaccaaccagaacaagtccaggacgctgtgcaatcgctacaccacaaacgatgtcataccaaccgtgacgcgcatttgatgatctctgcaatgcaaacgagagaacactgcaagaacaagataaaatgcaatctaaatattgcaaataggtaattaagcacaatggaatagttgcgaatggagtggtagcaaatcaacacaccaactattgggggttctgaatctaaagtcgccgactaatcgaacgaggactaaacaaaacccaattgttctagatggtgtacatagatatttatagaggaaaatatatctagggttaagtgctaattcgtggaggtggggggagacacttccgagatgagctagtctattacaaggcccaaggcccaagttcggtttcagtaacagcactgccttgttttgatgattcccgttgactcggaatgaatttggatatgatactagatgcgtttgaaaggtagcaagataagctttccatcaagtccaagatagcccaaatcggagttggcatgaaggtgctaggtctgtttgaagtcggtgctgtatccggaggttgaactggattccaaaactcattggactttaatatcttgtagatcctctgttcactcgatgtattctttggccatgttgtatatttctcatgcttgggtgtatgcatatacttgatggtcacattatcctcctcttcttgtttggaaaccgttatcgatttgttattgcaattgtcgtcataggagagatcaattgaaaaaatatcaaacaagcaatcattgtgtagcatcatttgttccttataaatccaatttacatcacgaggaaaccaactcaccgtactgaatgaatatgtcttaaaatgatagcgagacttgaccttcgaagttaacagtgcacagcactcaccttcttgaatattgtcatcgatatttaaaacaacgttaggtgaatttatcccaatagcatcaacgttgtgcaatccatttggtttctcatatttttccatatttaaaggaggattcatatctaaacatatataaacacgatgcaccatataacaccctctattattatatttaccaatgacatgataattgttccaagaataacatggaaaatcataaattttcttctctaaggtatttagatcacaaagaacatcaaattcgatataacccaaagtacataaagaagacaataatttcagctcttcttagtcatcagcaataacaaagacacgtttattttgagtggaaacaaaatattcagaaatagaagtaacgtgttctttcactagttgtggcatgtatataagtgaagcattgcacaactcttcctgattacaagcattatcaatatcaacacaatctgaatttttagcttgtgataaaggcaaattagaaatctgttccactagaggttgcttaacatagcataattagtggacaattgtagcatatcacaatctttcttaccttggtccatttgaccatcagttaaattacctgaaacgctctcttgaccaaatttaggtgcttcattcttcttttcttcaaaattgtttttaccttcctgcacgatgttagatataatagaaggcacaggaatattgtcatgtatcatagctatttttgtttctttctcaatctgactttcaatatcgcaagcaagcagaagtaactgaaaaagatggctatgtgttttattttcaagcctatgctgaatttttaaatcaagcccgtgtaaaaatcttttaattgtatctcctctagactcctctataccagcatacaatatacaaattttaaactcccggtggtactctctcggttctactctcttgtttcaaattttgcattttcatttgtaaatcacgaatataataaccgggcataaatctagctctcatcattgtttttaagtcattccaagaaccaggtttattgccgataagacaaatatcactccaccaaagagatgcgaaagaagtaaaagaacttgttgctgccttaatcttttgttcctcggaccattcataatattcaagttcatcttctactactaactcccaatcaatatagtccctaggattaaacttaccaacaaataaaggcaacgatatcttattttcacaaacctcatcatgtacctcttctcgttgtgaaagccaatgttttatttgttcaatcccattctctttgtacacttctgtcattgtcggtagcaaataagaaaaacaaacagatgcatgtaacttcttattaacaacaatattttgtttgtggggttgcaattcgctcagcactgtagcatataccaagttctcataatgttctcaaataatgcaaaaacatatcaattaccatggctgatttgtggcacaatgacacgtttgatgagtggagcgattgcaaagtcggacttgtaaagattagtagtatctggatcttggtaggcttaactaaacagatttgcgaaattaaataatagtccaaagtactagtcaaaattgctggcctagcctagacttaatcccaacttaagcaaacaaatgatcaccactcagactagaaacaactagattttatcacaaagctctcccaagaaatccaacaactaaaaaaaataattctaaattctttttatgattttttttgtgcggctttttttttctttttttttgcaccgttctgccttttctatatttttttctttgttttttttaacaaacggcagctattacacaaaatagctgggcaaaacaaaaaaaatacagaccacctagcaaactcacactaaaaaaagaacgaaatagcaaaacttgctagtctgcatgcacatacaggaaagatgggctcaatattcggtacagaattaacttctcccatgcatgcccatcaaatcaaggagagaatcaaacaagcaactgatccatcaaggaaacacatgcgcaataaaatactccatccgtcacctaatattctatgcaatgtttgaccactcgtcttattcaaaaaatttgtacaaatataaaaaaaaagttgtgattaaaatactttggataataaagtaagtcacaaagaaaataaataataattctaaatttttttaataagacgaatggttaaacagtataagcaaaaactcaaaatcccttatattatggaacggaggaagtaggatagctcggtttaaagtatggtaaatatatctgggttgtttttttttcacttggttgcacgataaaatctcggagggaataacaaggaaaaacaaattttccctaattatctggcacatgcaaccgagaacaaaataatctcagatgcgaacggaacctcagctcgcaaaccaatctgctacccatcaatcttctgcgaaactttctctacggtggcgacgcacacttgcaaactcaaaccaagactaatctaggcttaaaccagcacttgactcgacagtgcatcaaaactcagtaaagcaaaaactgaatgaaattgcgtggctcaaaactaatgtttggtgatggaaaaaaatagtgtggctatatggtagacgatgggtagatgaaataaaattgcaaactaaaatcctcaccaggcaactgatgctctaataccaactaatgacacactctctcgtggcccgatcttctggtgaggggataactctcgctttgatcgagtgcgacgtttgtgaccaaccagaacaagtccaagacgctgtgcaattgctacactgcaaacgatgtcagatcaaccgtgacacgcggttgatgatccctgcaatgcaaacgagagaacactgtaaaaacaagataaaatgcaatcaaaatattgcgaatatgtaattaagaacaaaggaatagttacgattgaagtggtagatctaatcgacccagcaaatcgacacaactattgggggctctaaatctaaagtcgccgactaatcgaatgaggagtatagacaaggtgaatagcacctggcaaaattcaactaaacaaaacccaattgttctagagggtgtacatagacatttatagagaaaaatatatctaggattaagtgctaattcgtggaggtggaggaagacacttccgatatgggtctagtgtattacaaggcctaaggcccaacttcggtttcaacaacaacaatgccttgttttgacgattcctgctgactcggaatgaatttgtatatgagaccggatgcgtttgaaaggtagcaagataagctttccatcaagtctaagatcactcaaatcggagttggcatgaaagcgctagatccgtttaaagtcggtgctgtctccagaagccgaactggattccaaaactcattggactttaatatcttgtaaatcctctgttcactcaatgtattttttggccatattttatagttctcatgcttggatgtatgcatatacttaatggtcacatcacatcacagtgtacatgagatcctaggtactactgtccggttttagctaacgtgatggttgagtcaacgtgaaacccacctaaaccccacgtgtaagcttcctccctctcccctctctcccctccaattgttcctcctcctcgtttcccctctacctctcttcccagcctccaaggcagtgggctggcagtcgatagggaaatgggtagctgagctccatcatctcatcacaacttgaggccacaacagagcacacgagaaggagcaccctgttggggtcagtcggactcggtcccatcaccatggccacacggccacgctagatgccctgaggtgcaacaacacatgattttttgcagcgacggcattgatgggcaggttgaacccaaccggagcccgacgcatgtctgctagtcatggaacccaggcatggacgggagccccatggcgaacaccgcccgtagatcgtagatcgggtgggaacatgaatcccatctcagtctcggcgcacgcttgctctgtgttagacagccctgggagcacagccatgcgacaacactacgctcgccagcgcgtggaacgaccgaacgagtggagcccatggtgcggcgaggccgatgtcgacaagggccctaccacgatgtgcatggacaactgccgaagctctgccagggacaaactggcccacactggtggagaaaccatctttcgtcggtcggccgaattccacgatagtcccggttgcaacaaaaaccgggactaaagatgatctttagtcccggttaaaaagggtaacgggcatatttgatctttagtaccggttggtgttaccaaccgggactaaagatgatctttagttatctttagtcccggttcaaatgctgtcagggcttgttaggcccccccgggatctttagtcccgtttcgtgttaccaaccgggactaaagatcgtaactttagtcccggttggtattggtataccaaccgggactaaagatcccggtgatctttagtaccgattggtaacaccaaccgggactaaagtcccacccctttatatatgtcttcttcctcctccagcccgagcaagcttcaaaatttcttcaaaaaagaggggaggtcatgccaaaatttatagtgaatttactttggtgattatatacaaatcggaggtgcctaaaaggttagcaacttcatcctccaatgttttttttggtcatattacatttggagctatgttttgcacacttttttgtttaaaaaaatttgttgtaagttgataagagagaaaatttgtgtgggaaaagaaagaatatacagaaattttgtttatttgctaaataaggttttataaaatagttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgttattattgtacgaatgattatttgtgtacgatttttttttcatttcatgtagatggatcggcaatggatgtacgctgaccggcggtccaaagagtttattgacggcgtgcattattttttgagagtggccgaagctaacaagcagaagagttttatttgttgtccatgcaataagtgtaagaatcagaaggagtattctgcatccaggactattcatttccacttgtttgagtcagggttcatgccaagctataattattggacatcccacggagagcaaggggttgaaatggaagaagatgaagtggaagacgacaatattccagactttgctcagtacgctggatttgaaggaaatcaaacgggcgaggaggacatagatgctgatttataacgacgttgcggatgatcttggtcagatgttgcaggatgccaaggaggactgcgaaagtgaaaagggggcccataaattaacaagatgttagaggaccacaaaacgtcgttgtacccaggttgcgagcaggggcacaaaaagttggataccactctagagttcatgcaatggaaggcaaaaaatggtgttagtgacaaggcatttggcgatttattgaaactcgtcaagaacattcttccggagggaaacaaattgcccgagacaacgtatgaggctaagaagatagtctgccctctaggactggaagttcagaagattcacgcatgtccgaatgattgtatcctatatcacagtgaggagtacgagaacctagaagcatgccctgtttgtaaagcactacgatacaagattagacgagatgatccaggtgaggttgacgggcagctaacgaagaagagaattcctgctaaggtgatgtgatatttccctataataccacggctaaggcgtttgttcaggaacaaggggaatgctagaatgatgcgttggcacgctgaagaacgtcaacaggacgggatgctgagacaccccgcggatggttcgcagtggcgaaacatcgacagaaaatttaaagactttggaaaggacgcacgaaacatacggtttggtttaagtacggatggcatgaatccttttggagagatgagcagcggccatagcacttggcctgttacgatgtgtatttacaacctccccccttggctatgcatgaagaggaagtacataatgatgccgattattattcaaggccccaagcaacctggtaacgacatcgatgtgttcctaagaccactggtcgaagatcttaaactgttgtggaagaaggaaggtgtccccgtgtgggacgaggacaaacaggaggagtttaacctacgagcgctgctgttcgtaaccatcaacgattggcctgcacttagcaacctatccgggcagtccaacaaggggtacaaggcttgcactcactgtatggatgaaacaaaaagtacgtatcttaagcactgtaggaaggttgtgtacatgggtcatcgttgattccttgcagcaaaccacccggtacggaagaaaggaaagcactttgaacatacggcggaccatcgtacgaagcctaaacatcgcagcgggaaaacagtgtttgctatggttaaagatcttaaagtagtgtttggaaaggggcctggcagccagcctatagagagcgaagatggtcacgcggcgatgtggaaaaaaaactccatattttgggagttaccctattgggaattcttggatgtccgccacgcaatcgacgtgatgcacctcactaagaacctttgcgtaaaccttcttggcttcctaggtgtatatggaaagtcgaaagatacactggaagcacgtaatgatctgaagcatatggaacaacgcggcgaccttcacccggaaccacaggagaaaggcagccattacttgagtccagccagctacaatcttagcaaggcagagaagaaaagtatgtttcaatgcttggagagcatcaaggtaccgtctggatactccacgaatataaagcgaataataagcacgaaggagaagaagttcacaaacctaaagtcttatgactgtcacgtgttgatgacacagctgctaccagttataataaggggtatcctcccagacaatgtccgggcaacaataacaaggctatgttctttcatgaacgcaatttcgcagaaggtcatcgatccggataggttagaagcccttcagaatgatgtggtgcaatgtcttgtcagctttgagttgatatttccaccttcatttttcaatataatgacgcatctgctttgtcacctagtgaaagagatcggtattctcgggcctgtgttcctacacaacatgtttcctttcgagaggtacatgggcgttctgaagaagtatgttcgtaaccgtgctcgtccagaggcaagcatcgccaaggggtatggaacagaggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaagcccatttcacggttttacaacaatcttcattggtggctccttacatcgaggagcacttggctctagttcgcgctagaaacatcggtaagtccgatgcatggattacacggcatcacattgatactttccccgcatggctgcgacaatatctcatgggtaacgagacgattaaccagcaactggccttcctggcgaggggtccatctggctcgatcgcgacattccagcgatatgagattaatgggtatacattctacacaagagcccaagacatgaagagcacgaaccagaacagtgctgttcgtatcgatgccatgggacacgatggtacaactggcacgtattacggtgccatcgaggagatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacgcaagttttttacgtgaaggacatgtctagcaaaggaaagaagggcaaagggcctgacgagccgaagcgccacgtggttctcccaggcaaaagaaaaatcgtcggagtagaggacaagactgacgaggattacgatcagtttgatgggcaaccccctttcacggtgatggttgaccctagcatcctcctatcaaacgaagacaccccttactcacgtagcgatcacaaggaaggaacaatagtgaggagaaagtacgtgcggacaaccgtcaccgccgatctattgccgtaattgttgtaaactattttggatgtattgaatatgctagttatatatgattaattataatttttaacaatttaatatcatgcatatactaattatatacgattattagaatttttaaaagttttaaatcatgcatgtgggatttacatatattagttacaatttttaacaatttaatatcatgcatatgctaattatatatgattattagaatttttaaaagttttaaatcatgcatgtgggatttacatatgttaattagaatttttaatgcattatttactattttagaaacacatatgcaacgaaatttaatattcagtgctattaactttagtcccggttcttaaccctaaccgggtttaaaaaataatttggaaatagcgggaaaatatctttactcccggttggtgaga

SEQ ID NO: 27734 - DNA, 6842 bp, Oryza sativa
aaacgtgaacgaacgcgaacgaacgtgactgaaacgtgaacgaacatgagtgttagtgaacgaacgcgaacgaaggtgaacaagcgcgaacgaacgcttaacgaacgcgaacgaaacgttaaagaaacgtgaacgaacgcgaacgaaacgtgaacgaacgtgaacgaacgtgactgaaacgtgaacgaatgtgagtgttagtgaacgaacgtgaatgaaacgcgaacgaacgtgattgaaacgttaacgaacgtgaatgcacttgaactaaaagtgtgagaacgaacgcgagcgaaatgtgtacgaatgagataattaaactattgttgaacttagcatatatatatgattatatatacttgaaaacgttaaatacattatatgttcctttgcatttagactaatacattttttttgcatgttgcagagaagacgacgtcgtcgtcgtccctcaagccgaagtggtagctagccctcgaaggaattcgcgcaggcaagtgatgtaaagatgtgattgttagagatataatataagattgttggatttctaatataagattattagattattagagttagcatatgtgagtgttagagattattagattattagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatattcgaaacttaattagacttagcatatatgattatctaccgtacaaatacatgacacttagacttagcatatttgagtgttagagatagttagagatttaatataagattattagaggtttaatatacgaaacatatttgattgttagagatttaatataagattattagagatgtaatattcgaaacatatgtgaatgttagagatttaatataagattattagagatgtaatattcgaaacatatttgattgttagagatttaatataagattattagagatgtaatattcgaaacttaattagacttagcatatatgattatctaccatacaaatacatgacacttagacttagcatatatgattatttgagttttaatacaagattagtagagtgttaatattacgcttagcaaatatttcttctatgaacagatggctgatcgcgatgaggaacagatactgtacgatataatcgcatcgggaagcagccagtactggaacgaggaagaggggaacgaagatccaaaccagtacttgaacgaggaggggaacgcagagagggatgcagaggggaacgaggaggggaacgtggagagggatgcggaggggaacgaggaggaggctagtggaagtcatccctccgctggacagaagagggcacgcggacaacgaggtgccgcgaagaaaatagagggtcggcacatcataactgaggtggacgcagacggccgacctagtgccccggcacaagcagccaagaattttgtacgccacagcggttgggttgtgagggataacgtgcctgtcagcaaggtgtactggcgcagaacaagggcacgcgggggtgatgacagcttcatcccggaatcagagaaagagatgctgtggaccacaatgctcgagacgttcacgctccctgcgggtacagagaacatagtgaaacagtggactcttaagaaaatggcagaacagttccagaccttcaagggagatctgtaccggaaatacatcctgaaggagcagacaccgaacttcgacgtattcccgaagctaagggatcactgggacgagttcgttgcttacaagacaggtcaacaagggcaaggcgatgatggaaagaaacaaagaaaatgccaccaagaagaagtaccatcaccacttggggtcaggcggctatagcatcgcgatgccaaactgggaggagatggaggcaagcttgcttgagaggggtatcgaaccgaccaccgctaagtggcctgatcgatcgaagttctggtactatgctcacggtggaacgctcagcccagttgatggctccttggtcttcagcgatcagatacgcgaggctgcgaatcgactaacggacgcagtcgaagcctcttctcagggcacgttctgacccgacagagagaaggacgagctgtcactcgccctacagactcccgagcatccaggacgaacacgagggaaaggcgtgattccctggaagatgggattcaaggaggacatccacacgtataggagtcggatgaggagcaagagagatactgaggcgaagattgcagatcttgagtacagggtatcgagctatgagctcagcaagcaagaggaggtggcccggaaggtggatgaacgcatggcagcacatcggtcacacgatccccagccgtacatacctcctccaatggtcagcccatcaggcaatcatagcagctgcgcctcaacggggcaggtagtatcacatagcatggacgccatgcaaacccaggatgaaaccacctgccccgttgatgagatcacgcatcggacaccatgtgagctgcatattcccttcaagaacttatcaatcaaggtatgctcgatgtaatatatgatttttgactcgtacgttccgcaagttgctgcttatgttgattactaatagataacttctcatcacgtgaaggtggcgtcgggaatggccatcccaacggacatttcagggacttaccactgcagaccgattccagcaggatactcgagggtcgaagttgagctggtggaagccgtgtacgaggacctcgagttggactacccaggaggagatggtgagacgcatctatgagacacaagccacgccattatactatggcgcaagcggtacatcatcctccctgggcgacaagcggcgtctcgtgcaccatctcctccggctccgccgtctcctcctgcaccatctcctccggctcctccgccacctcctcctgcaccatctcctccggctcctccgccacctcctcctgcaccatctcctccgcctcctcctccaccgtgttcgcctgcacctcccaagacaaggtctcgccaagctccacctccagccagcacaagggcaatgaagaaagccaaagttgacaccaccaaaaacaaggagccaccgtacggttgcagtcaagaggagcttgacgcttatgtggcaggagaagtgaagaggcaactcaagcctcagagtcctgaaaagaagatacctattgacccgagcgtgaagaatttcttgaagggaatgtccaccgcaaacaaggaggccttaaagctctcggactatgaccgaacacttaggaaagcctattacaagaagtccaaaccagttcctcaacttggagaacaaccacaccaagtggtcgagccgttggtgaccggcgaagactttggcataacggatttcatttcggacaccggtctaaccatggctcagttggatggaggcgcaccaatcccgaaagcggaagtggcatacaagtttgagctcggtaaaccgcttgtcaggcctgagcagctacagtccctaccgacacaaatgtataaattccatgaacggtacatggaaatgagcgccaattgtagagagatgttcgaagcgaggatcagaaaccccgacttcttgcaaggagaagatgttctatggatccatttcaaggatgtcttcgatctgtaccatcgggatgccctcgacgtctctcttctgagcgcatggattttgtaagtatctttgagttcgatttgtttcgttcaataattagctcctggcatatatgtaagcaataataattttctttcattgttgtagaatggagattcaaagggcccgatggcggagggtttacgatactgggttcatcgaccctcgaaaaatcaacaccgaaatgctcgacaagtacgaaaaagacacagaggacaatctcgtccatctcctaacgcagcagcattacaagacgttcatactattgccgtacaacacagagtgagtttttattgtcgttcgaacaaatttcattcccatacatatcacatgtacattctgatatttatctcatctcacgcatattccagattccactgggtcctgttctttttcgacttggacgcacgcagagtcactgtatatgactcaatgaataaagaggagaaggtttttgacaaggtcttccaactgatagacaggtaatataatgccatctattccaaagtcgcgggactctgttgctattatgttgatctcgggtaatatttaattaatcatagcttgcaactgcacatgtagggcttgggatcggttccgtcaattggtccgcgggacttggaaagaaaaacttggatggaggtttcattttccagtgagtacatgcatgatccaaaattatattgaattgaatctctagttacagttaatataaagagtatattaaatctctcattgtttctcatatagtgtgcaaagcaggacaagggaactaacttatgtggctactacgtatgcgagtttgcccactgcctatcaaaccaaatatacaccacacgagagctcgatgtacgtatacataaatcattcaaaatttcattgtgtatcgatttgttaagttgtttattaatttcatatattgatatgtcattatttttcgaatgatagcgtattcacatgagggaaaaactcccacacaaggattttatcacggctgttcaagaacaactgatggggttcatcaacgaagaagtccttaatcctgatggtgaattctactacgacggatcgacaattcgtaacgtcggtccttcctcttctgacgtaacgcaggcgttgaagtcgtagctatagctagcgagcaaatgaattgtactatacatgcatgtatatatatatatatatttatatatgtaagtacatttactttagtgttaatatatattttggtaacatatatgtacataaaatgttaagtgctttaaattataaatatgtgtgtaatatatgtatttatacatatatacatacgcatatatatatatatgtattctatatacatgcataatatatatatatatatatatatatatatatataggacactcatatggggcaccatggtgcccgggcaccatggtatgaaatacacaaattcgcccaaatgtttcaaaattttcaaactgtgagtatatacctacttataagtattcatttcatacctatacctagcaacaaaacaactcaaatttaactttatttcacaatccattattacatacctaactaattatatgtttggatgctatatacctaggatcaaaatctaacaaaagtaagtttgaatttagtaaatttcaatcatggtgcccgggcaccatggagcaccaaacaaatttactatatatatatatatatatatatatatatatatatatatatatatatatatatatatatatatatatatatatatatataatcaaccatgtagcaaacagggccatgcaaataaaaaaatggtacatagatctttagtcccggttatttcacccgggactaaagatcgctaactttagtcccggattcgtagtcccggttggacaaccgggactaaaggggggttacgaaccgggactacaaacgatttctccaccagtgccagtacacgtccaccattgcaactgcctccatatgttttttctaaaaactaaaccaacaagagaactacctattatatttcaattaagcaggagtaaaaacctagatagggttacagaaaaagaaaaaaacaaccactcgatgagtagaacgctaagtccctcaaccgcggccggtacaaaccacatagcacacggagcaccacacaactctagccaaactaccacggcggaatccaaaggcgagcatcaacgtcaggatgctgaagaaacggcacacggctttgacatcacaaggcacatgtcatcattgccaagcttgccgcccagcgaccaagcagttccgacttcacggcgatcacaacatcattggaggtaccgccaaaacgagcaaaacaacaccaagctcacactttggacatcagccaaagcccctggggcgccaaaacctacactggcaacaccaacattccttgagagaaactgcaaatgttatcgttgccaagcattgtcgcaccctaacgacatagtagctccgactccatctgacagagacaaacgaagaagctggatgccaccaatacaagaaaggaacctaggagaaggcctcgccaaaacctaggcatctagtgcttcgagctgacgcgggagtccaccaacagcaatcaatgcaagggtaagtttctccaagacgatgcccccataaaggatatgacgtgaaacgctgccaccgcctgtacgggaaccggaacacagttttcacctggagaattggtagcgacgaagaaaaacgccatcacgacgcctccaagaagggaacgacgccaaagacgccgttgtcgtcacgctagccaagggctaagcaaggctttcgccagcgattttcatccattaccaccaccacccccacacaataaccgttgccgcaccaccacgtcatctcctcagccaccagctggcccagttcaccaccccacaggtcctccccgcacacactagccttgtgacgtcaccgccggtacgcggccctccacagaaacaggtaaccgtgcaactgtccaccatgagctccggggccacaaggggacaggcgaagg

SEQ ID NO: 27735 - DNA, 6844 bp, Oryza sativa
ccgtcgagcgcttccagggccaccggcactccacactccgcccggctcgccgcgctctgcccacctccctcacgctggaggggacgcgtcgccgcggtatggccccactgccgccatcccagctccccgccctgttgtccggcggcgaactccggcggcggcgaggtagagagaggggaggagggtgggtggcggcggcggctagggtttgcccccgagccaccgcacgcgtgagcgactcgtgggttgtccgagcatatacaagtaattaagtggctagttcagaaaccgcctccatatgtcgatcgtccctagaaagtgcaatagtaaagcttccacaatggctatgtgttaacaaccaaatttggtaatctaagtatcggaggtgaagactagatcgaagtggaatccaagttcgagatcgtatcggaaacagagcaaggatcggctggactccaaatcggctacaaccagatcggctgagtccgagtcagaaagggagagccgatgcagccgattccgacaatacgactcggtgtacatcgtcgaattgagttaatgtgcttcacggtgattgccgcgcaaggatggagtcctgagaaggcaattgtatctattaattaggatattttatgtaatttacctagagatatgtttggtcaaaagtctgccgtaaagacttatggtatcttagagtttgttagagataatagtcgtgtccggtatggacatatcttgtaattctcgggtataaatagaccccgagccttatgtaaaagaaaacacacgttcaatacaacttcggcgcattgccaccctttttacttgttatggcggtttgcgttctcgggattagtgcttccatctttatgacactctaatcttgtttgtgtaatccgtcgagttatcatatatcttacataatctttagcaatatcattatctaacctacaatcggctagtatctgtcggtggagtacagccgattcggttagatattgacgttgatttagattatataggatatccaccactctatgaaacttccagcggcttgattgtctagatattgttcttcttttcatacttaatgctgcatcagttgagtttgatttattaagtcgtgcttagaatatcaatctctagcctgccttctggttgccgattagggtagtatcggggtttcagccgatcttgcctgatttaactacttttattctatatgcttgattgatacgttaaatccgccctttatgttaagatctcattgcattcgagtatattaggcttctgtttgatatattttacttgctttaatatcttgatatagagtagtattggagtattagccgatacatgctagatctatttgatcggctatgctataaacatatatagccctgttattaatatatatttcaatctaagtgatttatactgtctcggcatggcgtccgatctatcccaatcacttgacttaagtatatatcgatatagggagtatatatcattaatatctacagccgatcaagtaggtttagtttcttcttatttattcatgactgccgatcgatgcctatatgacatcggctcaaagataaatgatatgtcatcggcacctagccaatcggctatcgtttataggattaatcgcggtttctttgtctttatttcttgttgattgcaggatcaaatcaactggcatgctcatacacccgaaggcgagttttggacctgcactggagttaagcagatctcccaggccgccgtgttcgatttttacgtcaacacgcttttggcacgcccagtgggaccgattagaagtcagaagacaatttccctcgtggctgagaagctgccaccttcaccatcctcggctagcccagggattgttaaggaaaagatccagaggcaaggcttgggggacatcaacgaaggaaacattgtgactgttgacccagaaaagttcacacctgatcaaaagaaggattttgaagcaatgatgcaacaagcgcgagaccaattcttaaactcattcatgcagactcgcaagggaacatttgttcagaaatacaaggtgaaagtagttcctgatgaacctgagaccagtacttctaaggaaggagaagggaagaaagtctcagaatcggctcaaccaagtgacaaaggtgctaccgacggctcggctcaagagaatcagggtgacaactctcagggggtacatggagttcaaggtgatggtgttcatgggctgcaaggaggaaatcttaatcaagacggcgagacaacacaggatttcttcaacaactttcaagatcgagtggattatgccgtgcacaatgctttgatcaatcagtctggagtattagttaacaccttgtcaaacatgatgaagtcaatagccgacggatcaatagccgagcatcaggctgtaggcccgatttatttacaaggaggtgtctttccaaactatcggcctttgatcaccggcgctcaaccgtctgtacaaccagttcctcctattgcaccttcagctcagccgacagcaccaccgttgactcctttacctgctccagcagcatcggcaccaggacagccgattaatcctcgactattgatgagggagcagccacagcatagtgggcaggcgacaaatcagctgacacaagacaaggttgctgctatgtttttacgtcctcaacctactattgatccagtccagcaacagctgattcaacagacgccgccaagacaccaggttacacagccgattcagcaaacaccaacaagacagcaaaccatccagccgattcactagcaaggcttgatgaatcaatcggctggacaatcggctggacatgccttgactcaggttgttgttccagagcatttggttcaccatatgcagccagatgttacggcaatgcctcagattgtacctgagcacttggtgcagaatattcaaccgaattaccagaattaccaaggaggcaatttgagttatcaatatcgacctccttctccacaagtccaatatcagcaagaggggctaaaccagccttagcttactccttagtataatcagttcgaaccgacgcagcaacaatcgcaaggagcagctcagcaacgaccatgggccgatgtgattgctgacgtgatgagggagcagtttgggcttaaaccgaaggatactggaaacttgtatcggcaaccttaccctgagtggtttgaaagagttcctcttcctaacctatttaaagttccagatttctccaagttttcgggacaagatggtgtatcaacttatgaacacattagacgattcttagctcaatgtggtgaggcatcggctgtggacgctctgagagttaggttgttccggttgtccttgtcttgttcggctttcacttggttttcttctttgccgtatgggtcaataaacagttgggtcgacttggagaaacaatttcacagctatttctacagcggagttcatgagatgaaattatccaatttgacagcgattaagcaaagacataatgaacctgtggatgagtatattcaaagattcagggagatgaggaataagtgcttcagcttgagtttgactgatgcccaattagccgatttagcctttcagggcatgattggtccgattaaggagaaattctcatctgaggactttgatagcttgtcacatcttatacagaaggtaacattgcatgaacagaggtttgcggaagctaggaagaactctaagaaggttaatcatgtgtgtcctttcatgtacggatcggatgatgatgatgatgactctgagatagctgcagccgaatgggtaaggagtaaaaaggatataccgtgccaatgggtgaagaattctgggaaagaagagaggtatgattttgatattaccaaggctgacaagatttttgatctactgcttcgagaaaagtagatccagcttcctcctggtcatacgattccatcggctgaggacttgggcaagaagagatattgcaaatggcataattctgggtctcattctactaacgattgcaaagtgttcaggcagcagattcaggtggccattgagggaggcaagatcaagtttgatgattccaagcgactgatgaaggttgatggtaatccttttccagttaacatggtgcacacagctggccgaacagccgatgctagacgtacgagaggttttcagatgaattcgaccagagttataaataagtatcagagaaaatacgacaagcagcaagagaggtgttatgaagaggatgatggtagtttcgatcctcattggggctgtgagttctttaggttctgctggaatgagggtatgaggttaccaactattgaggattgtcctggatgcggtgatgttgcggaaagttcgagccgatcatacaatagaaataatcggctgaagcaaacaagagtccctgttcatcaaaggttgggcccggtaaaccaacatagtttcttggaggatgacgaagataggaagattcagtggtgtccttctggtatttttacaaagaatcagaagagaagggtgcaaagcttgaggaacagggaacgctttcaggaggtcgagcaagaaattaatcatcggctaaggaaggcaaaaccgaagcaggagtggcgtgttaagggtcaagcttttggggccgatgatgtcgtagccgatgaggcagagatgttggcaaaagggaaaagtgtggtaacagcatcaattaacatggtttttaccttgccagtcgaatttgggatcgatcaggctgatgtcgatgaagtggaagaggaatcggctaagttggttctatcgtcagaacaggcagtctttgagaagcctaaagggacagagaatcggcaccttaaaccattgtatataaatggttatgtcaatgggaagccaatgtctaagataatggtcgatggtggggctgcggtaaatttgatgccttatactatgtttaggaagttgggtagaaataccgaggatctcatcaagacgaacatggtgctcaaggactttggtggcaattcatcagaaacaaagggtgttctaaacgtggaaatgaccatcggcagtaaaactattcctaccacattttttgtcatcgatgggaaaggttcttacagcttgttgcttggaagggattggattcatgccaattgttgtgttccttcgaccatgcaccaatgcttgattcaatggcaaggcgacaaagttgagattgtgccagccgacagctgattgaagatggaggacccaagctattactttgagggcgtcgtggagggtccaaacgtctacaacaaggacacagtagatgatctcgatgacaagcaaggtcaaggtttcatgtcggctgatgatttagaagaggtggatataggtccaggtgatcgaccaaggctgatattcattagcaagaagttatcttcggagtttaggaccaagctgatagagcttttgaaagagtttagagattgcttcgcttgggaatattatgagatgccaggactcagccgatcaatcgttgaacatcggctacctctcaaaccagggattaaaccacaccagcagcctccgaggagatgcaaagtcgatatgcttgaacctgtcaaggctgaaatcaaacgtttgtatgatgcgggttttattcgtccttgccaatatgctgaatgggtttctagtatagttcctgttgtcaagaaaaacggcaaggtgagtgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcgggcctgatgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtccctttccccccctctccctcttgggccggtttggcccatctccttccccctccctctcctctccccgcgcgcgccgctgacgggagggcctgcccgccaccctcgctgacgggtggggcccacccgtcatccccttcctcccgccggtcccgccgacttccccgcgccctagcgccgccgccggccggaatcccggcgcctcccgccgttcccgtgcgcaataaagtggggggaattattccccgggatccccttcccctttccccccatttttccctccctctctcccttggattcgtttggaaacccctcccctaacctcgccggcgccattaatagcggccgggtctcccgcacccgtttccccctcttccggccgccctctctcactcctaaccctatataaaccctccccgagctccccccaccgtttccgccactcaccgccctctctcccgccggaatcgagctcgcgccgtcactctctctctccgccgtggccgccgagctccggtccgccgccgccatcgccccggaccacctcccacctcggcgccgcctccttcggcttcgccgcatcctcgccgacctcgtccacctctccgtttcggtcgccgaccgccggagcaccgtcgaccctgtccacccgagccgcccgccgccttcctccggtccggttgctg

SEQ ID NO: 27736 - DNA, 8913 bp, Oryza sativa
  unsure (1)..(8913): unsure at all n locations
gggtgcacccggtccaccgtggaccgtggggctgccgcgtgggccccactcccgtggacccggtccgcgcgcccctatcctcggctgacgcaataaaccttttttttaattaaaatttaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgaacaaggcaagtcacatcatccttgaacatattgaatcctagtttataaaattattttgatttaaattattgcagtatcgctttatttaaattcctgcgttatcactgttttatctagccatgcctatttacctttgttatgaccctattattgttattgttattatttccttgttcaccctagaataaacaaaaccccaacttgaagaaatgtcacatggcttctaagcttaaatcaatggaaatggaaatctctaaaggttttcttgtccatttcattatgtcatctctgccccaggagttttctccatttacgatcaattataatgcaatgaagatcaagtggggcattgatgaattaatagctatgtatgtacaagaagaggaaaggcttaaggcagaaagagttgaccatgcaaatctatttaaacactccaagaagaaaaagtataagaaatttaagaaggagtatttgaagcctaagcctagtcaatttaaagaaaaagggcaatcttcgaatcaatcccagcagaataaatctggaggaaatccctatacagaagaaaagggaaaagaaaaggatgggtgctacttttgtggaaagagtggacaccgccaaaaggactgtattgggtttatgagatggctcagtaagaaagatactgatgttatttcttttgttgatgaatccctaaatattgattatgccaccaattcttggtggattgactcaggagcgacaattcatgttgcaaattccttgcagggattcgctatgaggaggacactaagaagaggggaaagaagaattagagttgctaatggagaaagaatctccacccacggtgactgccaacgaggtcctctcgggtgagccagtgaggaagactgcagtgacctcccaagcagcgtggggctctgcatcgtcaccatcctgctccgggagctgcttgccctggtagtccactccatgcggataccccaggacaacgcacatgccccgtagctccaaaacaaagctagtcaggtccaggccacgacggttgatgctgccggccatctacaaacaaaaacaaaagagaaaagcaacattttaaagatcagattttgacgataaatgaagcagcaagacagagagagactagaggattttcacaaataagaaaggatttttatttcgaaaatattgctaaggcttgggatctaaagctcgtcctagggtcaagggggctctgataccaacttgtcacgaccggaaataacccaacgagcgttccttacgtgcgtgtattattccttgtcccaggaggcaaggtacaccaaaagttgatacatttcagagtttatcaagcggaagcataaataattaatttattacatgggcggcgagaggtggaaacggacgggagaagcacggggagggtttatatagggttggaagggggagaggccggccggaggggaaggaaaccggcgcggcgttctcgggctccatcaatggcgccggcgggattaggggagggtttccaaacgaatccaagggagagagggagggaaaaatgggaggaaagggagaggggatcacggggagtgattccccccactttattgcacgaggggacggcgggaggcggcgggattcgcggcggcggcggcgctagggcgcgcgggaggcggcgggataggcgggacgaaggggatgacgggtgggccccacccgtcagcgagggtggctggcgggcccgcccttcagcggcgcgcgcgcggggaggtgccgagtgggccgcggggagaggagagagaggggagggagatgggccgagccggcccaagagggggagggagggaattttaaggtttttctttttataaaacctttttaactttgtttatttcttcttaattattatttgtgctctgaaaattccactaaaatttatttacacattttaggcttttaggaaatatacaaaaatcctccaagccttctttgacttttaactttgcacattttaattgttggaggctttcacacggattttaattattctaggcataatttagaggatgtattttagagtcgttttgggacgtgacagtgaccgaccgggaaattcttcccgggtgcacacgagtgaggacaaagtgtgcaaaaaagacatgtgttggtttgtgagggcagtctatgacctatgaaagctatcagatgtaagcgggcctgtcctggggaaggcgggacattacagtattatagccctgccgttcctatagaaatccagggaatcccttttccctcggatttgattcttctggacaccaagaacttggatgtgatccttgggatgaattggttggctcaattccaaggagtagtggattgcgcaagacgcactgtcactctgtaccgagggctggaacaaccggttgttttctttgcacccccaacctctgtcggcagttccgaacttcatcagattggactgtcggaaacccccatcgtcagagagttcagagatgtgtttccggaagaactacccggtatgccgcccaagcgagagattgagttccggatagatcttgctccaggaaccactcctctgtacaagcgaccctaccgtatggcagcaaatgaactggccgaagtcaagaaacagttggaagagttgaaagaaaaggggtatatacggccgagcacttccccctagggtgctcccgtgatttttgtggaaaagaaggacaagacaaagaggatgtgtgttcactacagagctctcaatgaagttactatcaaaaacaagtaccctcttccccggatcgatgatctgttcgatcagcttaaaggagccactatcttttctaaaatcgatcttcgctccggatatcaccaattgcgtattcgtgaagaagatatcccaaagaccgcattcaccacgcgatacggactgtatgaattcacaatgatgtcgttcggtctgaccaatgctcctgccttcttcatgaacttaatgaacaaagtgttcatggaatacttggataagtttgttgtggttttcattgacgacattctggtgtactcacaatcagaggaagaccatcagcagcatctccgtctggtgttgggaaagttgcgggaacaccaactgtttgcaagctcagcaagtgtgagttctggttgtccgaagtcaagttcttagggcacgtgatatccactaaaggagttgctgtggaccccgaaacagtaaccgctgtcactgattggaagcaacccaagatagttactcaggttcgcagctttttgggtttggcaggatactaccggaggttcatcgagaacttctccaaaatcgctcgacccatgacacagttgttgaagaaagaagaaaaatttgtgtggagcccgcaatgcgagaaggcgttccaaactcttcatgaaaagctggtctcctcgccagtgttgatcttaccggatactcgcaaggactacctggtgtactgtgacgcttcgcgccaaggattggggtgcgtattaatgcaggaaggtcatgtggtagcctatgcctcacgccagctacggccccatgaaggcaactaccctacccatgatttggagttggccgctgtggttcatgctctaaagatctggcgacactatctcattgggaatcgctgtgaaatatatactgatcataagagtttgaaatacatcttcactcagtcggatctgaatcttcggcagaggagatggttagaactcatcaaggattatgatgtgggaattcgctatcatcctggtaaggcaaacgtggtcgctgacgctctaagtcgaaaaagccgttgcaacactcttggcgtccgtggcattccaccggaacttcatcaacagatggaagccctgaacctaagcatagttggtcgtggattcttggctatgctggaagccaagcctaccttgctcgatcaaatccgcgaggctcagaagaatgatccagatatgcatgggatcctcaagaatatgaaacagggtaaagccgctggtttcacagaggatgaacacggaaccctatggaacggaaatcgggtatgcgttccagacgacagggaacttaaacagctgatactttaggaagctcatgaaagtccttattccatccaccctggcagtacgaagatgtacttagacttgaaagggaaatactagtgggttagtatgaagcgggaaattgcagagttcgtggccctttgtgatgtgtgccagcgtgtcaaggcagagcaccaacgaccggccagacttctccaacctctccaagtaccagaatggaaatgggatgaaattgggatggatttcatcaccggacttccaaaaacccagggcggtcatgattctatatgggtagtcgtggaccgactaaccaaggtagctcggttcattcccgtgaagaccacctatggagggaacaaactagctgaactctacttcgctaggatcgtgagtctccatggcgttcctaagaaaattgtatctgataggggaagccaattcacctctcacttctggaagaagctccaagaagagttgggtacccgattaaatttcagcaccgcgtatcacccgcagacagatggacagaccgagcgtctaaatcagatcctagaagatatgctccgtgcctgtgttctagattttgagaagacctgggataagagtctcccctatgccgagttctcctacaataacagctaccaagccagcatacaaatggcaccctatgaagcgttgtatggccgcaaatgccggacaccgctattgtgggaccaagttggggaaagccaagtgttcgggactgatatcctgagagaagctgaagcgaaggtcagaaccatttgggataatctaaaggtggcacagtcccgacagaagagctatgcagataaccgacgccgtaacctggaatttgcagtggatgactttgtgtaccttagggtcacgccattgcggggtgtagacaggttccagacaaaagggaagctcgcacctcggtttgtgggtcctttccgtatcattgctcgacgcggagaagttgcttaccagttggagctgcccgcctccttgggcaacgtgcatgatgtgttccatgtgtcgcaactcaagaaatgtcttcgagtgccatccgagcaggccgattcagagcaaattgaagttcgcgaagacttgacctacgtggagaggctagtgaaaatcctggacaccatggagcgcaggaccaggaaccgggtaatccgtttttgcaaggtccaatggagcaacaacgccgaggaagaagctacttgggagcgtgaaagcgagctgaaggcagcccatcccgatctcttcgccagttcttccgaatctcggggtcgagattccgtttaaggggggtaggtttgtcacgtcccaaaacgactctaaaatatatcctttaaattatgcctagaataattaaaatccgtgtgtgaaagactccaaaaattaaaatgtgcaaagtaaaagtcaaataaggcttggaggatttttgcatatttcctaaaagcctaaaatgtgtaaataaattttagtggaattttcagagcaaaaataataattaagaagaaataaacaaagttaaaaaggttttataaaaagaaaaaccctaaaagtcccccttccctcccttgggccggcccgacccatctctcctctccccccctctctctctctcctctccccgcggcccactcggcctctccccgcgcacgcgccgctgacgggcgggcccgcccgccaccctcgctgacgggtggggcccacccgtcatccccgacctcccgccgctcccgccgcctcccgccgaccgcgccggcttggccgccctcgggcgcgccgagtggctgccgcgtggggcccggccgtcagccgcccgcgccctcgggtgcggctgacgcgtggggcccacggcgccggccggtgcgagcccgggtgcgcccggtccaccgtggaccgtgaggctgccgcgtgggccccactcccggggacccggtccgcgcgcccctccccctcggctgacgcaatacacccctttttaaattaaaatttaaatgaagaaattcgcaaatattcatttaaagagcatataaacttcaaatggtcataacttggccatttgaactcggaattggaccgttcaagtctctaatttttccttaagaagtgaagaacccatttttgtgctttgttccatcttgttatatggagtttattagagtaaaagccttttcttttccgttggttgtgtagacgctgcagcttcggaagatccgctcttcgtggaggctgaagccgacatttcggaaagcgagcaaggcaagtcacattatccttgaacatattggatcccatcttataaaattattttgatttaaattattgcattatcgttttacttaaattcccgcgttatcactgttttatttagccatgcctatttacctttgttatgaccttattattattgttattgatattattaccttgttcaccctagattaaacaaaaccccaactagtggacactctactcatggtaccactagtatgaatttaggtagatgcttcgccgcttaattaggtaacattaggtggttttacaactctagactttgggaatattcatatcacctggacactatggaatggttggattattgaggaattggattcacacctccccctctattcaaaaccctcaaaatggttttaggctgggctcagggtgcatggttttgatagtagcacctcggccatataaggaccggtcttccggcctctgttgcaaagcactaccgtacttccacatgtctagtgggtaaggcttagtttgtggctcagtctggttataaacaaaagtacacgaatggagatggatgaagtcgggggtcgatggacatctctagggcaaatgaaggctacacgagctgcagcccggtagtcgagatgtcatggcacagggccggtgtcctactgctaggggctcagtcctgcctacctgtcccggaggttccggccgtaggtggggttggatcggtactcttgtctatggctaggatgggtaaagatgtacacctctgatcagagtataacctattcgaatagctgcgcccatggttatgggcaagccgagcaatgtacccaagttagtgttttaattcttaaatcctgctgaactactaaaatgtggaatggttggcctgggttggcttgggacgagctggaacccagggtcgggttgccagttcggtctgaatcatcgtaggccttgggttaaggcaggttcgtgtgggttcacggccttgattaataatattgtatagctctagaatggtgtttacaaaatagctttgagcaactaagtgtcttttaatgctgtttactgcaaaccctaaccctttatattataacccccttgtactcccttgcatttactctgcacttatgggtgtgtcttgttgagtacggtggttgtactcagtcttgctcaatttttcccaaacctagaagaggagcccctggatgatgaaggctttggtgtctagctcgtgcctgccgtcaagcgcctgtggtcatcgcagtcttccgctgtttcccgtttgtctttgtgtgtgctgggccttcgccgcccatgtaataaagtaactattcacgcttccgcttgataaactctgaaatgtatcaacttttggtgtaccttgcctcctgggacaaggaataatacacgcacgtaaggaacgcccgttgggttatttccggtcatgacaccaggtgacatcggctaccatattacttcttctaatcagcaatctcaatattcctcttttctaggttttagctgatatgttttcttttgacatcaggcaatttatggaagaagaagaagaagaagaaacaacaagtaaagtcttggtgcctctagccgatgatgtaaaagcaaccttgctagatatctcgaaacggcttgagggctccctagaaactctagtgactagctgtggatctatcagggatagatttcatgaaatccatgaccaaattccggatgagttagccgatgccatcacgccagcggcatacctcgagcagcatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27737 - DNA, 357 bp, Oryza sativa
ttttggttgagctgtagaagaaacaccagagcagagcataccagtattgcacgtacaaaaccggccgggccggctgggtgggtcggagtggacacgtcggcgacggaaccggttccccctggggtcactgacatgtggtcccatcacactcatcatcggtcggggtcgtggacgcgggaggggggggggggggcgcgagctggcgcggctggcacgccaaccaaaccacctcctggcgctaccatcgctggcccactttattttattttttccttttatttttgcactcgcttggtcgctctcgccacgagcccacgaacccacacgcaggaggaaggagagccacgacgcagcgca

SEQ ID NO: 27738 - DNA, 439 bp, Oryza sativa
ttcttcttgttgcgctcgagccctcgccgacctccttgggcatgtacttctcgtcgtgcttggcgagcacctcggggcgctgaagaagcactcccagtcccgggccttgtcagagaccttcctccccgcggtgtctcggcggaggtcgtcggtgaacggcttgaggaagccctcgacgacgacggagtggcccttgccgaagaggtcgggtagcgcgcccccgtagcggacgaggacgtcggtgatgaggtcggtgacgacgaactcgatctcggagaagaaggcggaggggtgggccacggagccctcgaggacgagccccccgaggggacgcgggacttggaccggtcggtggcgtagcgcgcgagcgcgtcggtcggggtaaggtagaagacgagctggtcctggaacgtggcgagcacggtgaccacgaacccgg

SEQ ID NO: 27739 - DNA, 272 bp, Oryza sativa
ttctagtaaatttcacacaacaattgaccattatcgatagtaaaatgctcaatctcgcaacagaccacgacatagggtcgtacattcatcgctattccccggatagactgatctcctacgaatcgctaacaatgcagcgctgctcaatgcggaaaaaaaagaaaagagaaaaaaacatttgacctgaacggcgcggaagccggagaacctgaacttgacccgctcgcggagccgatccgatgagccgcgacgatcgagctccgtcgacatct

SEQ ID NO: 27740 - DNA, 542 bp, Oryza sativa
caatcacacattgaccaaaagtttgaagtttgatccatatccattggtgcccagtagtatataacatcctcattattttcgccagccatagtttcctctaaggtttcttcggctttttcagacaaggatacctgatgacataagaatgtttaaaacttatttccatgtcattatcaattgaaaacggcctcattcaagtgttcaagcaatctcagcacatggaaagcatagaacaacaaaaggaaaacataggcatggcaagccaaaaaaaaaaaggcattttcatggagatgaaaccaaatagaacacatggaaagcatagttccaatactttttaacatctgaagcaacaattgtattgcaaaattgcatttagctggtgcagcatagaattgcctacatgataagcatcatgagttcatggctagagggaactgttgctactgcttaaaaaatcctctatgaaaaggtcgaggaacctattttattatattgtatgtccaggcaaactggaaaactgagatagtttgggagatttggaa

SEQ ID NO: 27741 - DNA, 719 bp, Oryza sativa
aagtaattattaatttttttctatcatttgattaattggtatatatacttttatgtttacttttagttttacatatttcacaaaagtttttgaataagacgaatggtcaaacatatttaaaaaagttaatgacgtcaaacatttaagagaaagaaggaagtatatagcaattggtcacaacatatgcccatcgtcttctgcccaccaaaatataaccagagaaggaccacacttgtgatcagtcacaattgccaagccaccttgaaccatcctcgaccgatcttctcgatcgcaacgaatgtcatcccccgtgtgactaccttcgaatgattgtcattagcttatagtaggattggagttgagtcatccatctagagaggcaccatcccttcactaacctgtcacaaattggatatatgcatgaggcatgtcgttaataactactcatccctttcatattataagtctgtcagagttatgaataccacatatcaaatagtagttgactaaatttcggcaggacccaccacatatcatatcttatatgaaaacaaccttcggatatagaaggagttccacataaggaaagataaatagagttctacatggaaacgacaaggattactcagattgtatccatattggtttccctagttctacttggaaaagggaacacaatgggtataaatacaagaccctctaggaggagagggggacgg

SEQ ID NO: 27742 - DNA, 491 bp, Oryza sativa
tgtgtcttgtgacaggtagtggagagggcaaccagatggcgagcggtagtcgatgatggaataatagaagggtgtagcggcatggtatagagatgggctcgacattgcgcagtagcagccatccatcatctagcaagcacgaaaaaaatgcaagaacattctcgttcatgttatagagacgacgagcaaaagaaaaatagcaaaaaacctccatcatcggcaaactccaccctatcctctgcggcgaaccacatggagcatgatgtgcaaatgtaggacctatgcagcccatcaattcagatcaagtaatattggagattgcacgttaatctgatttgcaaaaaaaaattggggcttcatgcgtgaaggtaaactagagtatgcagatgcaaatcggagtgctatttccttacgtgcttgttctgtcaatgtcgccgacgtggagcagccgccgattgttgctcttgacctaggtgaacgcctctttacta

SEQ ID NO: 27743 - DNA, 716 bp, Oryza sativa
  unsure (1)..(716): unsure at all n locations
tcatatggggctccaaaatttcaaactgaagctgcggaggtgaaggcacttgctgctactactacattgaagaaacttgcagatatggctaaggatttcctgagaagtggcaaaactgattctggcacaatctggggggggggcatcgccaaagtgtaaccagtactagaattgtttccaagaccaaaccaaccaaggaaatggatatgattcttgatgctgaaaaggaaattgccgggctcttttcgttgacagaacagctcattaccgaggctggaatagatgttgctcaccaagcatagcttcagaacccagaaatgtatatcatattgcagttttgcaacatttagatagttgctgtgaagattcagctgaaattgttagcgttttcatttcttttgctttgggtctcatcgccctgtttgctgttggattgctctgctccaagtgcgaaagggagacatcgatgttgatatgcctcttactgtttacatgatatattgcatctgctgaaatcctagaaaaaaaatgataaatttgtgatccaaaaccccttctctagtcagccagtggcggatttgctgacaacctaggcagctgcctgtaattcatattctccaaaactccttcagaccggagttaatgaagatatccaaagcctgtaaaattgttgctnnnnnnnnnnnnnnnnnnnnnnnnnnnnnnnnnnnnnnnnn

SEQ ID NO: 27744 - DNA, 589 bp, Oryza sativa
agaggtgtaccactgtacccacaagacacaaccccacatcatgtcaccatgtgcctcaataccaccacggtacctcggaaaggagttgtgacaataccccttgcataacacaatccactacggcgcacctttcctggatcataatcacccccttataaacaaggtatggactccccagcgacccccgtgggcttatctccgccacttctcagtctggtgccccgcaatgaaccatgctacacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattcagccatcattaaataacagtgagtcataagttaacccaatagtgagctaatgtttctaagcagggctaagcaattatatctaatatctagttgaaccaatatataaagctcaactagtcaagttataataacccaaggtatcaaggaataaag

SEQ ID NO: 27745 - DNA, 779 bp, Oryza sativa
  unsure (1)..(779): unsure at all n locations
nnnnnnnnnnnnnnnnnnnnnnnnnnnnnnnnncccctctatcaattcggccggagatggaaaggagcgacggaattttggaaggagacggcggctgcaacggctagggtttcgggcggcggcggccgaaggaggaagacaggccagacaggtgggacccacctgtcagcgggagagagagagagagcggcggctcggcggactgggccgaactgggccgagggagagagagaagagaggttttgggccgactttcggcccaaagccaaaagaagacttttaaaaacctttttcaatttaaattattcatgaaatgcaattccatttattaaaaatactcccttagctcaaataaatcccagaaaaatctaggaattatagaattaagcaaagtatttaacaaaattttatatagcccaattttatattgagatttaacaaattaaaattagatcttctcttttaagcttttaaaatcatttctaataattccttttaaacaacaatttataatttaaggattttaaacaagaaaagcacttaacaattataattagatcattattgatcaaataattactgaactgttctttgtatcatttaggaatgagctctgaaaaatccgagaaaattccaaagagttgatttaatcatggagaatttaataaaaattaaatccatccatgctttatattaaggaaattttgtttcccacatttaacttcacttgtaaattaaagatcatttaatataaattctattaataatttattaaataa

SEQ ID NO: 27746 - DNA, 584 bp, Oryza sativa
  unsure (1)..(584): unsure at all n locations
gtcgaggctaaacttaagcgaatggtgcttgttgggcttgcatgcagtcagaacaacacagaaacagagcccgataatgtctaaagtcgttgagctgctcaaggaagaatctgttgagaatctttccaacttggagaataatgagatgttcaagcttgatctgaccagctccttccaggactcatctcattcgtctcatcctgatagttcagactgcatcacaaaagagaagaactcaaaagcagatacaatagacgaggcagttgattcaagtgagacagtaccttcagctaggtagtttgatgcatagaattataagttatctgtcattcatcagcaggagttattggtttccttccgtggagcattgtgtgtttacctctgcatgcgtgtttatgccttgtttaccggcaggtttgggtgcttcccttgtcatctcacagatatacttatctgtgtgtatggttaattgttacaatctgttttcggtatggttgtaccatggcttgtaaaattctgcatannnnnnnnnnnnnnnnnnnnnnnnnnnnnnnnnnnnnnnnnnnnnnnnnnnnnnnnnnnnn

SEQ ID NO: 27747 - DNA, 2263 bp, Oryza sativa
  unsure (1)..(2263): unsure at all n locations
nnnnnnnnnnnnnnnnnnnnnnnnnnnnnnnnnnnnnnnnnnntgtccagctacgaagcgagtacatagcggtctccagcgcttcgacccgctctggcttgcgcgactgcttggtgatctcttcggcagagacactggagcggtggagcttaaggtggacagcaagttcgctctggccctagcaaagaaccccatttttcacgaacggagcaagcacatccgggtgaggtaccacttcatccgaggctgtttggaggaaggaagcatcaaggcgagctacatcaacaccacaccaaggactagcttgcggacctgctcaccaagccccttaggaggatcaagttccttgagctttgttctaggatcgggatggcccaactttcccacaagacgacgcacaagacttaggaggagaatgatgaaataagtcttgcgttgttggtcttcttgtgctgattggttttgtgttctttttgcttttcagcttttaggacaggactagcatctttcagtttgggatgcctgttaggacagcatctcctttcactttttagattagcaagccagctgtaaatatgtatcccaaccccccggatggtatggcatttgtgagaaataaacagaaaattgtcccaactctcttagcgccatcctctcgataagagtaaggattctgttactaacactatcattataatagtatttagtatatttttctttcatgtgtttaatcacgtaaacaagattaatccataaaaaagactatagctatcaagtattttacacgttacaggacaaaatcttgcctcatctttcacccaaatatcactatcagcatgctacttattttttctggctcctagtagactaggtgggacaaatacactgaagagaagcacaatagtcatctgtctttgtgaagacaatgtgattttcaatagcctcatattccggctgtatgctttcttttgtgttcataccttccaattatgattttttctagcttgtaatcatgcaatccttgacaagactattggtataagcgaaaaaaattgataactgaagctaagaataagtcagttgtctactcagaccaaatccccattagacacggccttaaaccgcacgcaggtccagtttggatggccatcatgttcaaagaatatctgaaggtagcttttaaaaaacggcaaccattttatactgctaattaataccactagacttttttttttcaagacgacctacacaagacaaaaaagtttctattgatatagcaggaaaaaattacaaggttaccactagaccatgaacaacgctagaagtggatgtcagttaaacaacaatcatcaacatcactgggtccctccaatgctttgccatttttctaatcaattagaaaaaaaaaagaagacaacaaactaaagtttgtgcagtgtggactgcatgattctcagatttcttcctgttctttttttctttttcaagattgaaagaggaacacctcacctgtgatccatcccagagctggccccagtagacgctgccaaacccaccctcaccaagcttgttgtcatagttgaaattgttcgtcgctgactgtagctccttcagcgagaagatccgccatgtcgtctccttcttcttcttcctccggccaggtagaaccctgagtatagaacaagcaaacagatcaacaaacgagcttcatttcctcttcaaactctcaagtacggactcttcttcccaaaaaaaagaattggcacatttttaacggattaattagatataagtttccactatgtcattctatttcagcttgctgaccaacaactgcaatccgagagcgaacagaaaaattccccaatacaagcagagaaaattccacgcatcatttggttcatccatccaatgaaaacaggtgaatgttgcggtgttgtatgctcgcatgattaatcagcaaatcacacacaaaaccacaaaacttgatcagcaactcaccatttccccaaacaaaaaccattttctgcttcaagacacttctcagctcccagcagaaaaaattctccccagaaaaaaaaagttcttcttagctaatcaatcgagtaatctgttttgagcaaacccatcgaatccaccaacagaactaatcacaaacaaaattgcaaatgtttaccgacgattccacccaacaagtcaaaaccacccccaccctcgtaagtcataacccacccaaatgagcaaatctcccctctcccccccc

SEQ ID NO: 27748 - DNA, 4267 bp, Oryza sativa
ccgccgcgcgaggcagccccgcttcctcccctcaccgccgccggcgaccgcgagacagctggttgaggagagagagagaggagaagacgaggagacccgcggcttcctcctctcgtggtggtggtggtggtggtggtgtcggctcgtcttctccacctcgcactactcgcgtcgtctcgtcaccgcgcggcgcacgcaaaggcaagctcgggggcgcggtcagctcacccacgtggggaccgaccgggcggggtgcgggtcggacacgtggcgggcggcgagtgggccgttttgaacccggtgaggtaacggtcgggtttggggtgtgggcggtaacgtcacgcggcgggtgaggggtcggggtcggggtggggtactggagtggctgacgtgcgggggccaccaccgggggcgatgatgacctggcagcttgaaggggtggggccctcggctgttggtgggatggctacgtttgaccaaaggaagattcctgtggcctgtgggtgagacttttgctgaggtttgtagtacttcctctgtcccaggaaacgcgtcgttctggcgatcgtcccatcgtcccagtaaacatgtcgttctgctgcttctgcattactctctccgtctcgaaaaaaaaaaaaaggcaaactttagatttctgtgtccaactttgactatctatcttatatgaattttttttataattcatattttcattgttgttagataataaaacatgattaatattttatgcgtgacttgtctttttaattttttttctaattttttcaaataagacgaacggtcaaacgttggacacggaaaccagagtttgtcttttttagacggagggagtacgaagtaggagtgtgcaagttaatgtggtttttcttgtggttttttaatgcgttttgtagtacagggaatagattttactaaattactaaactaatgcactaatgagactattaaagagctataggggtgtttatatcagggtgtaaagatttgacgtgtcacattgggtattatataggttgtttcatagagtgttcggcactaataaaaaaactaattatagaatccgtcagtacataatttattaagcctaattaatccgtcattaccaaatgtttactgtagcaccacattgtcaaatcatagagcaattagactcaaaagattcgtcttgcaaattagtcacaatatgtgcaattagttaaatttttagcttatatttaatactttatataggtattcaaacgttcgatgtgacggagtgaaaaattttagggtgggatctaaacagggccgtagtttttgaccaattcatttgagtactttgaatatttcaggcgttctactgttagtactcctgttgtcttggtttgtctcatttagtacgtgaatttttagtgcgccacaacttgatgaccacgaccgatttggtatcactatcacacactcgatgattatatgttggtgtttataccacgaccgatttggtattacttgctccgttttaaaataagaacattttgtcctcttttttccttaaaaaattaacttttaacaatcatggtatcgaagtttataaaaatagagaataattgcattcgaactaaataaagtaggagacaattacaatggaatttaataaagttggtataatttattctttttgcttttgtattgctaagcgtgggatatgggtgaaaaatgaacttattttgaggggatggaggccggcggggtaaaatatataggacactttggctttgcaaatttagaccgacgtgttgttttcaacaagtcaaacaagccaatgctagtaaaaggacagtggcatatccagctatggcgtatgcagaatgtgcgttgatatttaggacctattcagatttgaggaattttgtgggccaaaattttagaagaattgaaccgtttgctgtaaaattcatacgtttcgaaggagcatttataatttgatctcaaacaagggcgcaaaagttagagagactgctcaatgaaggcattttactttgtgttatcatactgtataaaaaccatccatgcgtaccaagcaaaaattttcacaatttgaccctttgcaaaaactattttacaaataaaccgtcaccaaaacttatttcaaaaataacccttggcgttgaactaagacatctcagtgctaaatagcgtggcgctgaatatgcgttggcaagccgacttagtcacccatccgcggtggcacggtattcaacgccagttgacatggcgctgaggtgtctaagttcagcgccaggtgatttagcgctgaccaaaagagtcaaatttgaaataagttttgacagcagttcatatgtaaaaaaagtttttgcaaagggtcaaattgtgaaaatttcaacgtaccaagggactaattattgcctactattttattatgggatttgcccatatatacatacccagagaagggaagacaaagatgcaataccaaacaataagataagaatggaaagagacaaatgcccctcacaaaatccacaagtgaatgccatcacagctggtagccccagaaggccagaacaggactcctgttggtctcattgaggttagctagccagccactatggagtggagtagtgtattatggagcatagtgacccatcactttaataagcaccggtgattggcacgcttcaatcatggctttgtatctttgtgcttgcaaaagtctcaagcaatcccaaagcaaagcagatggtaagatgttctgcaggaattttgtaatgtcatcatccaatggccatggctttggccccaattgacctgttctcacctctgcctgccctcatcacactaatttttttaaaagatgatcatcaaactaatttaatccactaccatcaattatagttgaaaaagaaagccaaattggaccattgctttaacccgaaaaagaaaactgaaccggtgcttcgctcgatctggtccaattcaaacactgtttatgtaatcgaaaattcgaaccgctctaaactatttgagttgggcaacttcattgtgaatcatgaattaaagtagagattttggaccggttggcatggaaaagagttgggctccacgtatatgaatgaaccaaagaaaagcccaacgaccagaacaccacaattttaaacctaaatcacttaaaatggcgcaagttcatggttgaaaaaaaaacatataaatgtcataccttatggcctaacttttttttttcaaaacacaattaaaatgcaagcttttacaacacaccctacgtccctacacatatgagcacctccgaaaaactaggacagtatatattgagattgacgaagtcatcacgggtgtttcgctgtcaacgttcaagtctaggaagctactctcacttctcggagtaacatatttttcttagacgtatacatagtatatgtgcactcctatttgtccatatttatttttcaaatttggtttcactctccagataggactcttgggcttgtttagaaggaaatggcccacgcaaatactggcccatcacgaggcccaaatctgcgtgtccaaggaggaggagagaagcagcaaagcccaacttcatctgcctcgtctcgtcctcaccccgcctcgccgcctcaaaccctctccccacctgcatcccctctcctccacggcggcggcggacaccaccgcacaatgaggagctcccctgcggcgagtggcaccacgccgtcgaacatggacagcgggagcgaatctgacagcgcccccgaggagctcaccgccgtccaggtacgcccctcctgcctacgagaggaagccgaggacgacggccgtcgcgcgagctagagctcagctaacccctgtatccgagcgaggcttcgtgtgcgtcgtgctgccatgcgctggatggatcatggatagcacctcgtttgctgcgcccgcgagagctgagaagcacaagtactagtttagtagtgagctagagctagggttgttggatgtttacttcgatctcaccttcgcgatgcctcgtcttggagatcttggagttcgtgctgaccgttgctcgctgttgatgcttcgtagggggttgagaagcacgacgagatcagtaaagttgagaaggacagtgccatcaggtgtgtgcccctttatccctttgttccttgcgtgtatgctaggcttgatgattggatggataagcactctgctgattgtgcttcccttattttgatttgtgttg

SEQ ID NO: 27749 - DNA, 736 bp, Oryza sativa
  unsure (1)..(736): unsure at all n locations
nnnnnnnnnnnnnnnnnnnnnnnnnnnnnnnnnnnnnnnnnnnnnnnnnnnnnnnacaaatctatatatgttgttctagtttgtttaaagtaaatatttttaaagttattaatggtcaaagttataaaagtttaacctaaccttgtctaaaacatcaattattatagaaccggagagagtatctttttcattgattttcccgacaccaaaattctaaaaaagtcaagcaaagccagtggccaccgctgaactcaaaatagacgttattacataatctgataatcatcatgcatccatctatctcttgcagccatgcatgcatcagctctctttggaagttcatccctagcaattactcccatggcgacaaaatccaactcaccatgacaaagctgcttctgtcacttgccacctagtagtaaacagtaacacctctgcatatatgtatctgcatctgcgtgctgtgtgtgccatggccatggatggcatggagaaagtggcgtggtgcgcttgcttcctcttcctggctcttatggtggttaggttgaggacgaagcggcgtggcgacaataatggcggggtgaagttgccgcctgggccgtggcggctgccgctcgtcagcaacctccaacaggtcatggcgcgcggaccgctcgtgcaccgcaccatggccgacctggcgcgccggctcgacgcgccgctcatgtctctcaagctcggcgaggtcccccgtcgt

SEQ ID NO: 27750 - DNA, 670 bp, Oryza sativa
  unsure (1)..(670): unsure at all n locations
tgcaccaggacgactccgggatcacgtttcgatagaccgcctacgccaagcgcatcgttgagctggctgggctcaccgattgcaacccagctcttactccgatggaggagagactgaagctgagccgcgacagcaggacagaggaggtggactctatgcagtatgggtgtcttgtggggagccttcnctaggctccccacacacggccgaacttggcattctccatcggctacgttagtcggttcatgcagcgaccgacgatggagcactagcaggctgtgaagaggatcatccgctacgttgcggggactctcgaccacggtctctactacccgaggtgtcctagaaaggcacacttcgtcgggtatagcaacagcgaccatgccggtgacatcgacagcgaccacgccggcgacatcgacaccagcaagagcacaagcgaagattctcctctttctcggcaagtgcctcgttaactggcattcggtcaagcagcaggtggtgaccctgtccagctacgaagcgagtaacatagcgggcttcagcgcttcgacccgctctggcttggcgactgttggggatctcttcggcagagacactggaacggtggagcttagggtggacaggaagttccctctggccctaacagagaaccccattttttacgaac

SEQ ID NO: 27751 - DNA, 712 bp, Oryza sativa
  unsure (1)..(712): unsure at all n locations
nnnnnnnnnnnnnnnnnnnnnnnnnnnnnnnnnnnnnnnnnnnnnnnnnnnnnnnnnnnnnnnacgaggagcggagggccgccggcgccgtggacgacgacgaggacctcgtcgatgtgcttctcagggttcagaaggatgggagcctccagatgcctctcaccatgggcaatatcaaagccgtcgtcctggtaagtagacaagtacttgctgattaatactgtactaatctcccttaattgcacacgaatacttctgagcttagagtagtatttatcttaccaataattaatttttcaatcgtatctacaatcgtaccctaacgtacgttctcttccctaatttagtgaaggttcaatcacactttctggatctataatccattatattcgtgaaaggatgaaatataagacatattttaccaaacctcttttacctgagtgcacttaaaatttgactactgttaatgtcaaaatctacaaagttttaccgtttaagaataaaattaaataactttaactgatgaatggagcgagtatatatgaaaataaaaaaaaagtatgcacactgaacaaaggaaggaaattaaaaaggtttggggggcaacatattttttacatatatgggaaatatgttttttttcatgcatataggaactttttggtgctgggagcgagacatcagctaatacacttcaatgggcgatgactga

SEQ ID NO: 27752 - DNA, 736 bp, Oryza sativa
  unsure (1)..(736): unsure at all n locations
nnnnnnnnnnnnnnnnnnnnnnnnnnnnnnnnnnnnnnnnnnnnnnnnnnnnnnnnnnnnnnnaaacagggcctatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcatgccgccaaatacaaatccatcccaaaaataccaaaattcccgcttttgaagcccttccttgacccctcccttggatccaccttgaaccctcgtgtacaaatatacaaattgaattcaaattcaatctccacatcaaacttctctccaaaacaaaccttccggtaaaagtctattttacctccctcgtgatgatttgggccgaaacctgccgctggcccatctcttcccagctccctccatctccacgtgcgccgcacatgaccaccgaaagagagagcgctgtctctctcccttccctctctcgaacgttctctctctttctccctcggcggccccaaaccgctccccgccgtttgaatccgctcgccggttcccgtgcgctcgcgcgcgtggccgaccgtatgggagactccatcgccaccctcggtcgtcgcctgctccgaccaccaccgggtgtccgtgctcaccttcaaacaagtcccgtcc

SEQ ID NO: 27753 - DNA, 523 bp, Oryza sativa
agttcataccatttggagcaggcctaagaatgtgccctggtttggcatttgcgtaggttagcatggagcttgctcaagcctcattgctatatcatttcgactgggaactccgtagtggtgttgcgccaagcaatctagacatgtaagagaagatgggtatcaccatccgaaggaagaatgatctttacctggttccaaaggtccgtgtgcctctatagtttggctcgtaactgcttcacacaatatgtgtctcctgtgacccgtacctgccaagtagcgatcatgagcattccattgtgtttcatgcccttatggtgttatgctgctcaacttttttaatgttttctcgaaataagtaccatcatagttgttcatgtaactataaattacgagtttaatttgtgtcgtagttaacaagctcgagttgtttgtgttgttttccctttgctaaaatgctaaaacattcattggagagggagagagtggtgtaagctagtcctaaagaaaattaagaacaccaaac

SEQ ID NO: 27754 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnnnnnnnnnnnnnatttataaaatgcctctatatacaaattacaattgagtaagaaattcaaatttgtttttattttcatgtagatattataattgcatacttctatttataaaaatagaagataagagttgtatttcaaatctaattatacctttacctacctttgtgtgaaattatacacgagaatcctctagttattatatttcaaatttttctgcttgatctgggcatttttctctttgaaattatgtagctttcacttctatattgttaacagtagcaacatgtgtgtatattccaacatgcctccccccccaaaaaaaagaaaaaaatagcccatacaacatgtggattgaacatactagcgtagtatcgttcaactttccatctccaagttcatcctctgaggctttgaactctgtgaagaattaacaagagaaacgaacaaacctattaaccatgtagcctagtggttacagtgatctgagtagtactcaaggtcctgagttcaaatctcctatggagtgaattttctagaattttttggggggggcgtgttgcggggctaagttccctatttcaatggccgtatatatccggttggatgtagatgccgggtagaaaatacccttctcttaaagaaaaacataacaaggtgcaaacgtgcagtgcagatggcaacatag

SEQ ID NO: 27755 - DNA, 836 bp, Oryza sativa
  unsure (1)..(836): unsure at all n locations
nnnnnnnnnnnnnnnnnnnnnnnnnnnnnnnnnnnnnnnnnnnnnnnnnnnnnnnnnnnnnttttatcttatttcatgggttaataaatctttttcccttgatcccataaatcaattctctattccaaaatttcatgaatcattttccttataaatcatttcctttggtcccgcatgtcagagatggtcaataatattcttgagaatattatttctataaatttcatgaatcaatctccccttgttctacaaatatcttccttcgccagaaattctaattaaacttccaaaattcgtatctctcgatccaatcgtccgattgaccccgttccacttccagtaattccataaaattgagatctatttaatggcactattatttagtctaaatagggtctttttcttggtctcttgtttaggtttttgtttgtttgcgcatagttgcggttaccggattttcgtcgatcgtggatatcttgaagattcgtgaagcttcgtgaagaccctgagcaaggcaagccacctttgaacatattgagcctatatttgaacttaattatattgcttacaaaatattatgcattgataggactacacttaatttgtttgccccatctgaaaggcagaccggtgggcctacccaactcgttgcatctgatccttccattgttaattgttatatcatgttccttggtaacaactttttttagtggccctcgatattcgtgcattctgtgcgagtatcgacggtcgccttcaaacttaaaatctgagtaacttcttgggtaaaacttggtttacaaagctttggaaaacccgacgcttgggtcggtgcc

SEQ ID NO: 27756 - DNA, 1423 bp, Oryza sativa
ggcggtgagatggtccttttcttttttttcttttttattttctctcgaatcaagtgggatacatatcccaaatcaaaccccaaatacccaaatcaaacccaaaccaaagtaacatcacaaatcttatacatcacagatccatacaaatgtacaatgaatcacaatattgtccatacaaaagtacatcacagtgaatcacaaataaaaaaacaatgttgactgccgctgtcgccggccgccggccgcggccccatcggccgccgtcgcatggccgcctgccgcgcggccgccgcacggccgcggccccacctaccgccgcccacggccgcctcgctccgctgccgccgcacggccgcctgccgcgcggccgcctcgctccgccgccgccgcgcggccgcctcgctccaccgtcgccgcacagccgcggccccaccagccgccgccgcgcagtcgccttgctccgtcgccgccacctcgttccgtcgccgccgcccggccgcagtagagaggggaaggaggaggaggaggcggggatagaaaaggggagcagagaggggaaggaggaaggggaagggccaggggaggaaggggatatcgaggaggcgctggaggcggataccgagagacttaaagaggagagaaaaaaaggggacttaaaggcggggatagcatgggaatctttactcccggttggtattaccaaccaggactaaaaatacatctttagtcccggttggtaactccaaccgcgagtaaagcttccaaccgggactaaagatgacaaggcctgacagatttagaaccgggactaaagatcatttttagtcccggttggtaacaccaaccgggactaaagatcaaatatacccgttgtagccaccaaccgggactaaagatcatttttagtcccggtttttagtggaaccgagactattgtggatttcgggcgaccgaccaaagacggtttctccaccagtgaatgcatccgctagctagtaaatgtgctgttatttagaacagttaaccaatggttatgtactattgttagcgatttgagttgcaatttgcaactcccgtatgatcactccaacaagcacaacacccatgctgatgacgatagcacagcaatataccttctttgtctcaaaatataaaagattttaaacagatgagacaactttcaggacatcaatatactatctatctagattcatagtctagaaagtatctcatccgttcaaaaatacttatattttagtacggtcgtagtagtaattattatgcagcagaggcagctggaatttttggctatctatgacaaagctgacctttgaaaattgcaaacttcaagtcaaaccattaatgcaatacttaatgtatggctcgctttaactgcaaagctgactactgaactcacggtgaa

SEQ ID NO: 27757 - DNA, 689 bp, Oryza sativa
aaacatacaacttattgaagcagcttattataatctggagtccagcttattataatctgataagctcatttaggtgagctttttccagattattgggtgaaaaattactcaccatgccactccactccctctttagacttgcaaacccaataatctaggctctaataatctagaaaagaaacaactaaccgcttattctactacagattataacaatctagcttatagtaatctgactcaataatctagattataataatcttaagctgaaagaaaaagggtcttagacttttcggcttataagttggcttataaccctaaacaaagagggcctaatgtcccttcaatctcatgtcattcttaacgctgattttacacttaacaccctcaacttcccacacccttccgatccaccctcgcatcactcttccagcctcccctccccccaactccggcgatggccggccgcctccccggcgccgcctccgccgccgcggcgcccctcccccgagcgctcctgctactcgccgccctcgccctattctccctcaccttcctctccctccgctcgctccgccccgccgcggccccaccctccctcgccatcggcggctcccgcccttcctccctcgcgcggccgtcggtgtaccactccgctcgaggccttcgcggcggggtacgcggagatg

SEQ ID NO: 27758 - DNA, 517 bp, Oryza sativa
gtcgactctagaggatccccttaatgcttcttggacctcctttcttttaaattggtttgcgtgtgttttagcttggcgcatactagctattgagaggtcgatagtgttcttagcataggtggatcactttgacgtaattgaacgagtttaataaaagcttcgattatctaaaacaagtagcctattaccatggtcatccactggacacctggctgctcggtaacgacatgttattgggagaaatgcacggtgacccacagacatggaacatatgcatgcaaccaaccaatttatgaccacaaagctcccgagccatacagactatttaaagcaatcacgtcacactttcataataacaagcaactcgttgatctaggttagctagttcttgttgcattgaatcatccctcatcaaatcattaggatatatacttcatgatggccaacgtcatcgcacttatgcttgtggttattacagcgtcaaccttgttagcctcacccgtggaatgcgccaaca

SEQ ID NO: 27759 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnnnnnnntggaaattatccccaaaagcatatgtatctagcatgtagtttccactcacaaataaattcacaatctgatataacagccaaaattatggatgctcatggagaatggaatattaaaatccaggaatcaacaatgtatttgtctttgtcttacttcagcagcacatatgcatttttttttttttgccgggttagcacatatgcatttcaggagtaatatgcaacaacacaatgttttaactgtgagtgaaacagaaagataacccataaaattgtgaaatgcacataccctggagtatattccggaacaataactttcttcccaaacagcgaaaaagtatatccgatggtcgctgccgcatccggcggcgccgaagcatcaacaatctgtggcaaactgaaagatggacctgaagaaggctgcctgatgaagagtgaaatcacagtagcagtagctgccacacccagagcaagtgccactttagcaaggaaagaagcaccagtgctgcttgatttcacttccattgcatcgattatctcgctctcatcttccccaccaccagaagaagattcagccccggaggccgatgcccttgcagcgcaggaatcatactggagaaatacgcgaactgtttgtatttgcgagaataatcagatgacgaattt

SEQ ID NO: 27760 - DNA, 1589 bp, Oryza sativa
  unsure (1)..(1589): unsure at all n locations
nnnnnnnnnnnnnnnnnnnnnnnnnnnnnnnnnnnnnnnnnnnnnnnnnnnnnnnnnnnnnnnattgttaaatatacttttatatatacatatagttttacatatttcacaaaagtttttgaataagacgaatagtcaaatatatttaaaaaagtcaacggcatcaaatatttagggacagatggagtaatattattgttgagcggtgttcgcctggtatgtgggcgcaggagttgcaaaccagcatcagtgtgtcacttaccttgtttgccgttgagcaaaatttgctaagatgaaaatcatatctgaaaaacccgtaattagctaccaaaatcttcagctcaatttccatttgtattatacagcatcaggatatattatgccggcggcggctagatgatgtctacaccgtagggttgcatgtgccggccgcaaccacccacaggttttatctgatgcggtgaaggtcagtgtgaggcaggcgccattgcaccgaccgaaacacacgaacagcgacaacagcaaacagatactagagcaaagcccccacaaatttaactagattggatatttagttatgctgtgtgttcaccaacaagcgcgggccgagcgacagagacatatgctatcctccaacagtagcatagctatgtactcgctccatttcagtttaaaagaggtttttgacttggctcacaatcaaactactttaagtttaactaaatttatagcaaaaagtagtaacattttaaacccaagataaatttattataaaaatatattcaattattgatttgatgaaactaagttagtatcgtaaatattactatatttatctataaacttagccaaacttaaaacagtttgactttgactaaagttaaaacgtcttataacctgaaacgaagagagtatttttaaaaccacaggaggggaaaagagaagattgagaaaatacgcaaaatgaggtgagccattagcacatgattaattgagtattaattattttaaactttaaaaataggttaataagattttttaaagcaaaattcattttttttaaaaaaacacaccgtttagtagttcaggaaacgtgtgtgcggaaaacgaaacaaactctctctctccggctgccgaaggcagcctaacaagtttgaatgtttattatccattttcagtttttttttaaacattaaggttttactacaccagcgaataatctttttataggtcgtataaattgataacctcatacataagtggatttgcgggttagccacttatgttcatcagtgaataatctttttatacatcgaataaattgataatccgatatataagtgaatttgtgggttagtcgttgggtgagccaccacccggctctgccactataaaatctcccgaggaagatgacgaggagtcagtcaacagttgactagctgttcgattcggccatggccaccgagctcactgagtacttgctgctcctgccgcttctcgtcgtaccgctcctctacctcgcggcgtcgtcgtcgcggaggtcggggaggctgcggctgccgcccgggccgtgggcgctgccggtgatc

SEQ ID NO: 27761 - DNA, 12793 bp, Oryza sativa
  unsure (1)..(12793): unsure at all n locations
attcgagctcggtacccctatctggatcccaaatgattttgtgagcatcacggtggtgtcactgtttctgctaattgtaagctgtagcttctctgacctaacatagtcatgtaatctcagagtatcgcagcaggagaaagagcggaggagaaggtgggcccaacgaagaacatcctcaaaaccagataaaaaggagcctctggaggtagaagataaagacatcaaacagaaggcagagaatgaagaagatgaggagagcgaggagacccatactatgcctggcatgctccctaccaatgttatcgaaatgcttgcagcacgtgagaagtatgtgtacttcccttgcaccgtattcagtttttttttgttttttttttttcaattttgcggacttaattggttactgtcgtccttttctccttcaggcaaaccttctcatctgactccgaggaagagataacaaatcagaaggttcagaaaaggaagaagcggttgaaatcttccgggtacttttttcatgtcttgcagtctcatatgaattatgtggaaatgttacttatgctagttcttttgccaatgtttgtcaggcctgaaacaattctgttgaaagacgttcgctcgacacagcatgtgaagaatgcccttgctttcctggagcaaaggaaaaaccaggtgccaagatccaatgcagttttaaagaacgcgaacaaagctttgcgcctcctttcatcgaagggcaattttttgagttgaatatggtaattgcgagagcaaaggattttctcaatttgctgttaggtatgtgcttcggaagacatttatgtttcagagggatggtcttttttgtgcttttatttgagatgaattggctttcacatcccaggcgcacaacgggcatatcgatgagcatgaaactgtacaatacgaatgtttgcaaatgtaatatgtatggtgcgtcagtatttgacaattctttgggcatgagtaatttcttatatggaatattattgttcattacttctttgctaaagaaaatgggaattgttcagttaaacccgttgacatgaattatttggaaacttagcaaccaatcaaatgaggatggcatggacatccggaggtttgcatccacatgatgttaattttacttctgacttcaattatttttcaactcgtgtaatattaatttgtactccatctgtccctaaatatttgatgccgttgacttttttaaagatgtttaactgttagttttattaaaaagtttaggtaattattaattcttttcctatcatttgatttattgttaaatatacttttatatatacatatagttttacatatttcacaaaagtttttgaataagacgaatagtcaaatatatttaaaaaagtcaacggcatcaaatatttagggacagatggagtaatattattggtgagcggggtccccttgtttttggccccaggatttccaaaccaccttcagggtgtacttaacttggttggccgtgaaccaaatttgcttaaaataaaattcttttctaaaaacccctaattaagctaccaaaatcttcagctcattttccatttgtttatacagcatcaggatatattatgccggccgcggctagatgatgtctacaccgtagggtgcatgtgccggccgcaccacccacaggttttatctgatgccgtgaaggtcantgtgaggcangcgccattgcaccgactcgaacacacgaacnnnnnnnnnnnnnnnnnnnnnnnnnnnnnnnnnnnnnnnnnaaatttaactagattggatatttagttatgctgtgtgttcaccaacaagcgcgggccgagcgacagagacatatgctatcctccaacagtagcatagctatgtactcgctccatttcagtttaaaagaggtttttgacttggctcacaatcaaactactttaagtttaactaaatttatagcaaaaagtagtaacattttaaacccaagataaatttattataaaaatatattcaattattgatttgatgaaactaagttagtatcgtaaatattactatatttatctataaacttagccaaacttaaaacagtttgactttgactaaagttaaaacgtcttataacctgaaacgaagagagtatttttaaaaccacaggaggggaaaagagaagattgagaaaatacgcaaaatgaggtgagccattagcacatgattaattgagtattaattattttaaactttaaaaataggttaataagattttttaaagcaaaattcattttttttaaaaaaacacaccgtttagtagttcaggaaacgtgtgtgcggaaaacgaaacaaactctctctctccggctgccgaaggcagcctaacaagtttgaatgtttattatccattttcagtttttttttaaacattaaggttttactacaccagcgaataatctttttataggtcgtataaattgataacctcatacataagtggatttgcgggttagccacttatgttcatcagtgaataatctttttatacatcgaataaattgataatccgatatataagtgaatttgtgggttagtcgttgggtgagccaccacccggctctgccactataaaatctcccgaggaagatgacgaggagtcagtcaacagttgactagctgttcgattcggccatggccaccgagctcactgagtacttgctgctcctgccgcttctcgtcgtaccgctcctctacctcgcggcgtcgtcgtcgcggaggtcggggaggctgcggctgccgccggggccgtgggcgctgccggtgatcggccacctgcaccacctcgccctcgccggcgcgcccacgcaccgcgccatgcgcgacatggcgcggcgccacggcccgctcatgctgctccgcttctgcgagctccccgtggtggtggcctcctcgccggacgccgcccgcgagatcatgaggacgcacgacgtcgcgttcgcgtcgcggccgatcgggccgatgctgcggctcgtgttccagggcgccgagggcgtgatcttcgcgccctacggcgacgggtggaggcagctccgcaagatctgcaccgtcgagctcctcagccaccgccgcgtccactccttccgccccgtccgcgcggacgagctcggccgcctcctccgcgccgtggcggatcaggccgcgtcgtcgtcgtcctcgccggtgaacctcaccgggatgatctccgccttcgtcgcggactccacggtgcgcgccatcatcggcagccggagcaggcaccgcgacacgttcctgcggctagtggaggacgggctcaagatcatgccggggatgagcttgccggacctgttcccctcgtcgcgcctcgccatgctcctcagccgcgtgcccgccaagatcgagcgccgccgccgcggcatgatgggcttcatcgacaccatcatccaggaacaccaggagagcagagccgccgccgaagacgaggaccttctcgacgtgctcttgaggctccagaaagacatggactcccagtatcccctcaccaccatgaacatcaaatccatcttgatcgtaagctctcctccccgaactccggctacttccccctcgtcaaaaacgaaatcctcttcatgtaattcgctcgaatccaggacatgttcggcgcgggcagcgagacgtcagcgacgacgctgcagtgggcgatggcggagctgatgcgtaacccggcggtgatgcgccgggcgcaggacgaggtgcggcgagagctcgccgtcgccggcaacgacagggtaaccgaggacaccctcccgagcctccactacctccggctggtcatcaaggagacgctccggctccacccgccggcgccgctgctcctgccgcgggagtgcggcggcgcgtgcaaggtgttcggctacgacgtgccggccggcacgatggtgctcgtgaacgcgtgggcgatcggccgggacgcggcggcgtggggcgccgcggcggaggagttctcgccggagaggttcgagcggtgcgagagggacttcaggggggcggacttcgagctcatcccgttcggcgccgggaggaggatctgccccggcatggcgttcgggctggcgcacgtcgagctcgcgctcgccgcgctgctgttccacttcgactggaggctgccgggagggatggccgccggcgagatggacatgacggaggcggccgggatcacggtgcgccgccgttcggacctactggtgttcgccgtgccccgtgtccccgtgccagcgcagtagacagctggtgttatcttatctaagccaatatgagtaatcgcaattaatggcagaatttaccgataatggccgtctttagattattttttttctaaaaaggtcacatcgaatgttggacacatgtatggagcattaaacatagaagaaaaaaatcaattgcatagtttgcatgtaaattgtgagacgaatcttttgagcctaaatataccatgatttgacaatgtgatgatacagtaaacatttaataataacagattaattaaacttaataaattcgtcctgcagtttacaagcgaaatctgtattttgttttgttattaaactatatttaatattttaaatgtgtgtacgaatacttaaaaagatttggcccagcaactaaacacagccaatttcatgtgagcagtagtcaaatggtctccttgattaccgtcattagtcaaaatcgcagttcacatcatcacatattcacatggcgcgaaagattacgacacgctaccaattaccaaacccccaaacactttcccccctcaaagccaaacaatgattgaggcagccatggccggcggcgccatgccgctggtcgtgctgctccttgccaccatcccgctcctgttcttcaccatcaagcgctcggcgcagcgtcgtggcggcggcggcggcggcgaggggaggctcccgccggggccgtgggcgctgcctgtcatcggccacctgcaccacctcgccggcgacctcccgcaccgcgccctgagcgccctggcgcggcgccacggcgcgctcatgctgctccgcctcggcgaggtccaggccgtggtcgcctcctccccggacgccgcccgcgatatcatgaggacccacgacgccgcgttcgcgtcgcggccgctgagcccgatgcagcagctcgcgtacggccgggacgccgagggcgtcatcttcgcgccctacggcgacgggtggcgccacctccgcaagatctgcaccgccgagctcctcagcgcccgccgcgtccagtccttccgccccgtccgcgaggccgagctcggccgcctcctccgctccgtggccgaagccacctcgtcttcctcctccgcctcgctggtcaacctcaccgagctgatctccgccttcgtcgccgactccacggtgcgcgccatcatcggcagccggttcgagcaccgcgacgcatacctgcggatgctccaggacgggctcaagatcgtccccgggatgacgctgccggacctcttcccgtcctcccgcctcgcgctgttcctcagccgcgttcccggccggatcgagcaccaccgccaagggatgcaacggttcatcgacgccatcatcgtcgagcaccaggagaagcgcgccgccgccgccgccaacgacgacgacgacgaagacgaagacttcctcgacgtgctcttgaagctccaaaaggagatgggctcccaacacccgctcaccacggctaacatcaaaaccgtcatgctggtaatcaagctctccctctctctatctcaaaaaccttcgtgttacttgcagagtccctgatcatggatcacttcccatgtttcatgatcctaggacatgttcggcgccggcagcgagtcgtcggcgacggtgctgcagtggacgatggcggagctgatgcgaaacccaagggtcatgcagaaggcacaagatgaggtccggcgagcactcgccgggcatgacaaggtgacagagccaaacttgaccaacctaccctacctacgactagtcatcaaggagacactccggctacacccacccgcgccattgctactgccacgcaaatgcggaagcacgtgcaagatacttggatttgacgtacctgagggggtcatggtgatcgtgaacgcgtgggcgattggtagggacctgacgtattgggataagcctgaggagttcgtgcctgagaggtttgaacacaacgggagggatttcaagggaatggacttcgagttcataccgtttggagctggacgaaggatatgccctggcatcacattcgggatggcgcatgttgagcttgttctctctgcacttctgtaccactttgactgggagcttccacaagggatggcggcaaaggatctagacatgacagaggattttggagtcacaacacaacggcggtctaacctcttggtgcgtccaatccatcgtgtatcggttccagtagagtaaacatacttgtaagatatatttataataaatgtaattgccaatgtacgtatattagtttcagtttaattttgtttttttataattggtaaaagtcgagtttgacattatatgtttgtggagtgatatatatatcatattaatttatttttattttttttataattatttaggtgacatgaaaaaagatataagaagatgtatcctcaagtgatgaaaatctctctccagatatacaatttctatgtatgtcattacttgttcaatcttctataactagggggcagataacttggttcatttgggctcattatcctctaattttcctcttgggtggtgcatcagtatattctccaatgttaatgttctctctgaaacctataaaacgttttgcactaatcagtaatcaagtataatcagttcggtttccgcattttgaaagaggcatgaataagttgtgtccagtgtggttttgacgtgagatgcacggacacagcgcacgcagaacatgtgcacatccgtgcagggcttcgtacttgtagaacgcaaacctgttcgtccatgtcgcgttctcccagacatccgagccgtgtcgatcgcgtgagctgccatggccggcgaactcgcgttctatctgctcctcgtaggtctcgttgccgtgccattgctcatcttgctcggctccgagcggcgcacggcggcgaggacgcggctgccgccggggccgtgggcgctgccggtggtcggccacctgcaccacctcgccggcgggctcccgccgcaccgcgccatgcgcgacctggcgcggcggcacggcccgctcatgctgctccggctcggcgaggtggaggccgtcgtggcgtcgtcgccggacgcggcgcgggagatcatgaggacgcacgacgttgcgttcgcgtcgcggccggtcgggcccatgtcgcggctctggttccagggcgccgacggcctcgtgttcgcgccctacggcgaggcgtggcgccggctgcggcgcgtctgcacccaggagctcctcagccaccgccgcgtccagtcgttccgccccgtccgcgaggacgagctcggccgcctcctccgcgccgtcgacgcggcggcggcggccgggacggcggtgaacctcacggcgatgatgtccacctacgtcgccgactccacggtgcgcgccatcatcggcagccgccggctcaaggaccgcgacgcgttcctccggatgctcgacgagctgttcaccatcatgcccgggatgagcctcccggacctcttcccgtcgtcgcgcctcgccatgctcgtcagccgcgctcccggccggatcatgcgctaccgccgccgcatgcgccggatcatggacagcatcatccacgagcaccaggagaggagagccgccgccgacgccgccggtgacgacgacgacgacgacgacgaggacttggtcgacgtcctcctcaggctgcagaaggaagtgggcgcgcagtatcctctcaccaccgagaacatcaaaaccgtcatgatggtaagctcgacgccgccatggccgaacaccgaaagctcgacgcgcgcgccaaagatgtctccaccatttttctccctcgcttctttcacaggacatatttggcgccgccagcgagacgtcgtcgactacgctggagtgggtgatggcggagctgatgcggagcccgagcgccatgcgtaaggcgcaggacgaggtccggcgagccctcgccgccggcgccgccggccacgacacggtgaccgaggacatcctacccaacctcagctacctcaagctcgtcgtcaaggagacgctccggctgcacccgccggcgccgctgctggcgccgcgccggtgcgacagcccgcgcgaggtgctggtgctcggccacgacgtgccggcgggcgccacggtgctcgtgaacgcgtgggcgatcggccgggacacggcggcgtggggcggcgcggcggaggagttctcgccggagaggttcgagcggtgcgagagggacttcaggggggcggacttcgagctcatcccgttcggcgccggccggcggatgtgccccggcatggcgttcgggctggtgcacgtcgagctcgcgctcgccgcgctgctgttccacttcgactggagcctccccggcggcatggccgccgacgagctcgacatggcggagagctccgggctcaccacgcgacgccggcttcccctcctcgtggttgcacggcctcatgccgctctccccactaagtactgtaattaattatcaccaccatcaaatcatcagaatctaaaccaaaatatcttaagagttaagatgaaagcaaaccttaaccaaaagattaatttatcatcatgcccatgaacattggcatcagtaactgtaagttgatgaatggttcatatttgatacatatttccttttgttgactacttggatgagattctgaatctttttgtagacattttttgctgttgaaataactacacttttgacttgttgttcatggatggcatcgatattttctatctgaagaagactaaacctgatgctttacagtaagctgcactggacggcgaatactaatcccttatctcaacaatggtagagcaggtacaatagcaggctataaaccagctataaacatattttaaaaagataaagaaaaatagagaaaagtagcgggctatagatctgtagccagctgcagcacggactccaagacgtaatgtgtgtatgacaggtaagattaggtattaatagtatagtaaacaattgtatgaattggttattacattagctataaatgatttggagttagtattgggctatattattaaacttgctcttaatagcttatctactgcttgaccatggagtacgtcacagttgctgtcacatgaatacttttaacttttcttgcttgaaatttccaagctgaaagaaactcttacaaatagaaaccctagtgttttttttttaaaaaaacagattgctcaagtgagttcttacatttttttatttaaaaaaattcacttataaatagattggtagccaagttaagaccaaacagtagtagcaactagcaaaggcagctcagctcaagtttagagtgagaggtgagagctcagcggcgcgccatggcggcatctcggcttgcgctcctcctcctcgtcctcgccgtcgccgcggcgcgccacgcgctcccggcggcggggagcgacgcgcacccggggtacgacggcgcggaggacacctgcggggtcccggcggcggcggcggcggcggggaggatggaggagtacggcggcgggcggatcctggacatcacccacgcgtaccgggcggacctgccggcgttcgcgccgggggcggtgacggggccggtggtgcggctcagggactccatggcgaacgggacgctctacaacctgtcggagctcaagatggagtgccacatgggcacccacgtcgacgcgccgggccacatgaaccagggccacttcgccgccggcctcgacgtcgacaagctcgacctcgacctcctcaacggtacgccctcgccgccgccgccgccgccgccactttacttgttccccttcctgctcgcgcggcgacatggtcgaggttttgtgtggtgcacgtgatgccaccgatgccggctgcggtatccgtaaaggagattagtacagggggaatttgggataaatttggagatgaactcgaagacgagatggggaactatagataactattttgttctgctacctgcagcgctagatcagatcctctaccttaagtcacatgaatttattactaacatagtgacatgtgtgtccaataggtaattgttagtgacaaaggcacggtgacgactttaaaggtagatgatctcagtccgtacccaatacgtaatttgcacttacatatatatgtttttttttaaaaaagagaggcaaacttgctaaaatatgtttccacaaaaggtgtggagaaatactacgatttgtatagttcacaaataggataaatggtacttatagtacatatatcgctcaaaatatcaaatacttcctccgtttcacaatctaagtcattctagcatttccctgtctagattcattaacatcaatataaatgtgggaaatgctagaatgacttacattgtgaaacagagggagtacttctcaactttagtatgtgctaatacattaacatgttttacgtatctacgtgtacatttttctcagaattttgtaaagttcacacattataaaatttttaaatgggtgtagctattcctagatccagaaagaaaaaggctatgggtacagaactcatacagatgctgatgtggcatgccacgagtaaaccaagatttcttgtaactcccatatagtaaaatcaaacagttgagagctttgtttataagagttatgtaagatgtttttagttacaaacttacaatagtgaattgtccagtttgggagcagttctttacttttttttttgacgcaagttctttacatcgatatgaatctaagttaattgtctcctgtgcttctcctgtatacgtctatcgctctctgattacagttttgcctgagtggaaaaccaattctgtttggtttggcgtctagacgtttgtttggaattggaccccacctaactacatcaaaagttctcatcacaccctactcatttagtcattttgttattgcaaccaaatcgggtgtgtgctacatgcctacaattttttaaaataatttgaaacctagttggtgctctgtgtctgtcctttctcctaccaatcattaagatgagcatagaagccaaacctgtctttctgattttgcacgatctccctttgcatactgacagctgacaggatcaagtgaattagacagctccatttcagtgttaggtgctagtattagtctgccattgttccagttgcttctctcatgcagagttgcagagcacagcttcttgtcctgctgcttgcaaagatcaatttttcgttggctttgttccagcattgaagattcacctgatatgatttgatcaacaaaattaacagtttagctgaagaaatgttgtgaaatacttaatagtagctgtgaaatgcctattcaacaattctttcgaagtgcactctctgtaatgtaatgcattcctaaggaaattgcaaatgaaacttgagtgaaaatttgtcaggtagttatagatatttgaagttccccgcaaaaaaaaaaagaagttgatcgatttcctctttgctggacaggtcctacattattggttgatactccaagaaacacaaatataacaggtactattatgtatacttttcttttttccaaggagctacctgctctatcacgaatataattaataattatatgatatatctgatgaatttaccacattcagcagtgctgcccatgcccccatggtcccacagatatgacaaaaacatgaatatcacttctatgtcttgtatataaaatgcatcactgtttgcatgcactttctttatacagctaaagcaatggagtcgttaaatataccaaaaggtgttcgtcgagttcttttcaggacattgaacacagataggtatgtactcttttctggacatatattcatgcataatattcacaccttttcccatagtgcaggctcagtttttagaacaagtggtccgttgtccatatgctcattttcagcatttctcttttgcatctttacaatacagatatcattagttcatctatataaccaattaaactgtaagcaaatgatttgcaggaagctcatgtggaagaagggaggtgatctgagttatgtcggattcacagaagatggcgcacagtggttagttgacaacactgacatcaagctagttggtatgtaattctgagatatcttacacttaacagtggtattgataacttctttttccttgatcaagctagtattaagttacatttatggcctttttgtcggtgataaagatatgtatgcatttatcatttttttttgtttgatgagaatttaatgctatgctattggccgattggctactctgcaggtattgactatctatcagttgcagcatatgatcacttgatcactgcccatgtggtctttttcaaattcccggtacgacgctatccttgttctatttcagtacatctgtaaattggtcattctcacttctttaatctacttcaaaacaaatccttgacaaacattacagagctgagtactgactaa

SEQ ID NO: 27762 - DNA, 2656 bp, Oryza sativa
  unsure (1)..(2656): unsure at all n locations
nnnnnnnnnnnnnnnnnnnnnnnnnnnnnnnnnnnnnnnnnnnnnnnnnnnnnnnnnnnnnnntaagactttctaacattgtgcacattcatataaatgctaatgaatctagacacacatatatacctaaattcattagcatagacatgaatgtaggtaatactagaaagttttactccctctatttcacaatgtaagtcattctagcatttcccacattcaaattgatgtatatgcctagattcattaacatcaatatgaatatgagaaatggtagaatgacttacatcgtgaaacggagaaagtacattataaaacggagggagtaactttgaaagcatgccattgctgcattacttactgacaagttttgggacagtgcttgctttactctgttttgatgttgctgcaaagaatgtttacaccttcatgaatgggtgatttagagcacgatgaatctagcatgcaagattatattactggctgtaaccattggttgatttgctgaatttgttctttcagaatatcatcctagtcgaaggcctgaagctagacgatgtcaaggctggaatctacatgctgcattgcttacctctgaggctggttggatccgagggctcaccaatcaggtgcatcctgatcaagtgattgcttcatcactgctcctgataatggcgacactgcagatcatgccatctgatgctgctacatcctggctgaggccttgagagtgccaaggccagctcagtagaaaaacaataataagtgtaaacgtatatatatcgtttgtttgatcagtaataattcaataaagcacttaaagtaatttttcatgtaaaaatgcagcagatattaggaatgtggtgaaagaaactgacagactagtaatccctttgttctcaaatacgaggcgtattagctttttacatggtctacaatttgaccgtttatttatatcataatatattatcaactaatgcggaattaacatcatataaaaatattttttaaatacggatctaataacgctacatgtatgacgtcaaacctatgttactaatttaattattagtaaaaaaattcaatgttaaactttccaaaaaataagagtattttataactgatggtgtaacagttattgagctggtttagtacctatctctactattataaaaattgaagatgtttccgcggtccgtcatcatgtttgagtcggttttaattttatgttttagttttaatctatatttcttctctactattataaaaattgaaaatgtttttaccggtattttggtacgtcatccgtatatgagttggtttttaagttcgtttgcttttggaaatacatatccgtatttgagtcggtttctaagatcgttcacttttggtaatacagaaggaatcatataataaatctgtttaaaaaactcgcatgctaacttgagatgatcggattcctaaccacagctcatgattttctatatatatatatatatatatatatatatatatatatatatatatatatatatatatatatccaaacgaactcctacagtaaatttcgtcttaactaaaccatataataataataagattaaaatagttttcacccgttgcaacgcacgggtatttttttctagttaagtataagagtcaaagattagtgttatcattggttacggcatggtacgggacttattgtcgaggtctagtaatgaaaactgcttgatatatcaaacaactttactactgtatttctcttttcaatacagctcgaatcttaataaaaacatacaaaatgactcaggatgtaagtgcacatgcatttgcagcgtcaaattcctcttcaactctacaaatacacacacattattactgacgagagtggaacatacagattaatattaataagaggaattgcacaatggactaggctttttttttctttaccacagttgaataatgggccatatatttacttcatgttttcacttaggactaggttttctcacactttattctcattggactagtttagacttggatctttttttctcatcgatgctgtccatccacaactcgaagcttgaccatgaccatatgcaattgagtctcttggtggcatcctacaggactttgcgtaacaccacattcaccttaggagaatgggcataaggtatagggctgacggataggccggccgacaacgatcatctcgagccacgggttcaaagtgtcaagtttggtaacaaaccatgattcaacgcaaatggttttctaaaaactagtctaatatgctacttagataataaaacatgacccagagtgaaatttggtcataataatatactccctccatcctaaaatataagcatttttactatagtgacgagtcaaacgtttttaactttatctattaatagaaaaaaaatattaatcacgtaaaattgatattattagatttatcattagacaaactataataatatgtaactctttttatttaaaacatcttacttttatagatattgttggtcaaagtagtatcacaaaaaccgtgtcacagtccaaaatgcttatattgtgggacggatggagtaaatgtaaacttatatatgttgtcggtcagcaaaattccaataaagcaaaa

SEQ ID NO: 27763 - DNA, 11016 bp, Oryza sativa
  unsure (1)..(11016): unsure at all n locations
atccgcaacaataatctagcgaagtagctaaacagaacatagccttaattcacgactagacatttctaaatatgagagctttcttagagggttcccaattagtataggaataaaaagatcaattgatcgatgtagttgcttctttaatcgtatgaatgaaaaaaaaatgtggataaaacttttatatgttattagcagtttaaaagccaaatgctggaaatagagcacgatgaaaaaaaaaacaaaatcaactctaaacttaagtttcagctgataaattaagtttcgaggttgccactctcaagatctgatccaagggatcaaagatgtagtaataaatgtttcatccttgtttcatcaagttctacggagtactagcaagggtcagccacagatataaagaaatgaagtgccggggaaaatagaagtccatagatcgcatggtgcatggtgaaattaacccctgaaagtttgctgatcacaacaatattctactcctacttggttcagttctctgtcttgttagtaacatcgtacattactttacatgagtaagaaatgggcagatccgtaaaggataccgtatcacaggcaaactagaaaacgcagcttacaaagagtgcaatatggcggaaaaacaaaactattcttgaaagaatgaactaatcagtctattacctagcaactccattttgatgatttatggtcgatggtcgccaacttctctgatgcagatgctcaagatgacacctacgcacaatgatccatccagttgctgatatatgagcataagaatgaatgcatgttcagtagagcaccggatagttgtcagactccgcatcatattcatacggataaggctttcatgtttgtatctgcccagacttggatggttgaatttagtacttgatcacatgatgtcgcaaccatagttcatacataaccatgtggaacgcgtcgtaaggaagaggaggtgaatgccacacaaagtgtttctgtacctgcaatcccaattaaacatgttacagtatagtaccgcactgctgaaacttcagtgcctctaaacaatggctgaatcaaattatttacacgcaaacagacctgagggcagctaatgttctgaacaagacaagtgacacattacaatcttgaccaagtagcttatttgtactatgaatgtgatctactatatttattttccattacagttaagtacaacgctgaattacatgcttccttttgtaaataattcggcggcttcatagaaaaaaaggagggtcaagagttgcaaacctgaacaagagatttgtgcaattcaacaaactcttcctgtgatatagatttaagtatactttttagttgatatacatcacgctccttaagtacaacagcaaattttctccagtctaggatatcattgaaaggcaaatcgtagtagtctgacaaaataactaaaaggatgaaacaaaatggattagaactcaataatcagaagggtactgaaaatatcagttcccgtgaaataggaaaaacagcataagtagagtggcatgtattatgaatgtcactgggtagaaatactaaccaggaacacaaccgtagtgtattgaatcagatatacgggcactattaacttgagagccaccaggacaaatacagaactttgtgtggtagaactgcttctggtaaaccagctctccaatagctctactgatccgattgttactgatagcaagctctgtatcattctcccagacttgtgccaaaatgactcttattttagaattgcgatggccagcccaaaatccaaggattgtcctgttgccatggcaaaagcaacaaaagacaaattttgtaggagtgcaaatagatgttcaaaccatagcatcgtcacaaatttatggtcatgacaactttcattttgctacaaggtgattcgttgcacatgaacaaagtgctgaactaaatgtaaaaccatgtagtcttctgaattaatcataggttgtaagattcaaggcatgatcaacaagataaccacgtgagtaagtgtgagtgttttacagaatttctcaagtaaacagatatttttcacttgaaggcactattactagaaaagtctagaatcatacatggaggcacacatatatagtcagtctaggaaaaagaatcattcagaagtcccaaatgaacaatttttttatgaagacaaccatagaagaatataagatcacatatatagcataagaagcagtaagtgtcattccaacctgttctcaacatcatttcctccttcaggcagagcaaatggctgcaatacttgaggaagagcgatatccttatgcggtataaagtcaacattatagcttggagaacagacaactctaatagaattcttcaccatgaatggaagtccttcaaaagccctaacacctacatcatggcaggtgacaaagaaatggtccgctccaagtgtcctgttccagtaaggatacttgtttatcaagccttccacataatccttaactattattgtcatgttctcatatgaagtaccctgcaaagacagacatatgcacgtcaacaattataaaagatcaattacaaaagatatggacaaccaacatacaatttcagtcacatctaataacaggaaattcgttcctgtatcagatgaaaagaaaaatgcatttcaatgtttgtaagccgacaaatttccgaaaccaaagatcttgcaccagactatactgctgactagaaacctatcggcacatctacaatatcgttctactttcgcttcaataatgacatgcaggtataaacaacacattaactaatactactttgagaaccgttactatcccaaattcacagtgcaatgttccagctataggctgaagaaaggaattttacatcataaagcgcattctactattaataaattcatttgccgattgccccaaccacacagcaaccgagcaatactcaatgcaccaaaacggtgatgccatcctaacacgacaattaggccctgtttgatttagattattgagtggaatgttgtcacggattatctacttgattataggagtaaatcgaatattatattaagaaataaacttaacaaaatagcttgaaacaagtgatctaaagttctaaaccatacaatacagtagacgatattttttttttgagaaaacgtatttctcgaagcatggagcaaacaatctgtttcaataatccgatgaacgagctgaaaagaacatggccttacaatgctatggaagtgtaaatagaagtagagcggagaatggaccttgccgcgcatcttgtggggggagatggggacgaagaagaggtgcgccttgtcggggtcgccggtgcggaagcggctctcgcggatgttctggaagaagtagccctcgctggcgtacttccccgtgagcttccgcggcgtctggtagaacgtcttggggtcgccgtccgggtacatgtacaccttgaagctccgctccatctccgcgtaccccgccgcgaaggcctcggcggagtggtacaccgacggccgcgcgaaggaggaagggcgggagccgccgatggcgagggagggtggggccgcggcggggcggagcgagcggagggagaggaaggtgagggagaatagggcgagggcggcgagtagcaggagcgctcgggggaggggcgccgcggcggcggaggcggcgccggggaggcggccggccatcgccggagttggggggaggggaggctggaagagtgatgcgagggtggatcggaagggtgtgggaagttgagggtgttaagtgtaaaatcagcgttaagaatgacatgagattgaagggacattaggccctctttgtttagggttataagccaacttataagccgaaaagtctaagaccctttttctttcagcttaagattattataatctagattattgagtcagattactataagctagattgttataatctgtagtagaataagcggttagttgtttcttttctagattattagagcctagattattgggtttgcaagtctaaagagggagtggagtggcatggtgagtaatttttcacccaataatctggaaaaagctcacctaaatgagcttatcagattataataagctggactccagattataataagctgcttcaataagttgtatgtttctttcagcttactcccaataatctggattataataatctcaagctgaaagaaacagggcctaagcctgaacaaacaaatagttttttcgtttgtcttttttgaagccataagccactctaacactattaagccaaaagctaggttggagaagctttttttggcttacgtgaggtagatgcatgactccaccattaaacttaagacattaaatccaccagcttataatatataaatcatataagcaaataagctgacttaaaaatctaagccaataagcctaagcctaaacaaatagggcataattatttgtcacgtgccaattaatgatttgccactcgatatcgatatctatgatatgtgggtctagtggcaaattctttagaaccactcgtaaaagtggcaaaacgttaattattccaggatttgaaaacatgaattaaagatggttcaatcatgtttcaaaactcatacatatatgctcgtgaggatccatatagtatttgggaaaaggaacaacaatgtttactatttggcacattcacagattcactatccaactacgtgtgacgacgatcatttctctttgctcgtctcctatatttcttcattcgagatggttgtagcttgcatcaacgaagtaacccacgttatcatggatgacattgccatacggtgttgtgctctgatcattcaacaactttgatataaacaccaactccaatagtagtagggtattgagctaggatggagatcctctatcttaagtcacatgattttgagtcattgacatgtggaacttttttgatatggatctacatttcagtaatcctaaagtcacgtgatttaaggtagatgattgctatatgtggcggatgccggatggccttgagctcaagtccgaagaatagtgagcagctacaagcgaacataatagtgagcactaagcagtgagccatgcaagcaaggtgagctaacaatacgttatcccaattaattgcactgtaagctccatttatatatccatataagcaattaatacttactttcattggactgataatactcatcgagccatcgttttggacaagaacatgatctccaaaaatatcaataaatatataatgctattgaagtggagtaccttttaagagtaatctatgtatataatctccgtaattctaagataaatattttagaaattattcatattcaaagattttatagtttacaatcggccttgttaaaaacgacaagtattatcaggcctaaggtagtgatacaattaaaatatgttatatttgtaattagctggaaagataagactgacatgtgtcgtgcagatggtttgcttcaggctggaacagattagttttaaaaccacgtgcattcaccaccccctcttctttttctcatttggagaaccgtggagcactggggaagaaataaatttgcagattgattctatctagtaaaggcgaagataaaatcagtaacaatatggccaaagttccctgccagcaattaccacccaggaggccaggacagaattgaacataaaaggtaacaaaaaaaaacaactacataggagtatatcctaaaattatagccatcaatatatattgctcctatactactagtagtacaatgcatgatgtatccatgtttcagtaaataatttgaccactgtatccaaaggagccagaagctgggaaaagatcgagtaaaacagtttcagaagaatggcagttctatacttctatacaagctttctgaaccaatatacttctacatttcatagctcttcagaagctagcatacaaataaggaaaataatatataaaattgtacattaggggaaaagggtatgttagtgtgcatgcaagcctatgttcagatataagattcatggatgtgtctgaactcagaagaggactgagttggcatgcgtcgcaacatgcaatattgcaaatgaagtatcaccacattcagttactggagttgcgacgactgaggtagaagaacaatgcagtacatgcggctgctgcataagggaacacggtccacatgccctggtttcaaagcaaagcataatttgattagaaaaggtaaacaaagattttactctcaatttttcaggagaggggaggagatttaccacagctgccgcaacacttgcgagtgcaacaacaggccgttctctcaggaaaaacccaacagctagctgcaatgagacatcattagtgtcagctgtcgtaaatacagattgaagaattcttattcatgtatttaattcgattgatctgtaagatgtttgaatataacaatggtgtcagcctacagattaacaaggataaacattgtattgtaagacaaaacatttttttagttgccacaactgcattggaggaacatagaaataatttgcagattgattctatctagtaaaggtgaagataaaatcagcaacaatatggccaaagttccctgccagcaattaccacccaggaggccaggacagaattgaacataaaaggtaacaaaaaaaaaacaactacataggagtatatcctaaaattatagccatcacgccaagtagtaagtctctataaagttagatcaaacgtcctgagcaagtgacaactcagtaacttcagaagtaacagaaaattaaaatccaaattacctggataggaagagtaaatagacaaccacagcaaactccagcaaaataacagtctgctggtatgccctgtttgtaatcgtcagttaaaatatcgggtttatcagaaatttctgacagaatcactgtgagtgaagcctgggaaaatgactaaccaatgcgccagctagaaatcctgtaggattgcgaaccccaactgaaaatcgctcaactgcaccaaacatcacagatattagtgacttctcactgtcagtgattaatgaatgtaacccactggtgttgtttctggatgcactaagtgcagcactataatctggcatttcaggaaaatgctccttactcagatataaactcttgagaaattataatctcagatatataccaaatccaattaggttgccatacttttgcaccgcacgcgatatgcttagtgctttctccttcccaattccaatctaaaaacagatgtgcaaattatatctcattcagagtgaagaatactctttcagtctgttattctttaccaaaattatgaaactatgatataagtaaaaatggcaaataaatccctgctttataccttgctgcttatgtcttcagatgctcttgtttgcctaaaaagtttacctagatagaatggaaccatatcactaatacaaacgcccctgaatggaaggatgggtcaggtaacaaaagatggtccatgattaattgatgatcgattgactgacaaaaaggaactgtgcacgcaccagtaaacccataacactgtggaaattatataagatgcattcattgagaatgaattagcaagagactgccaggttccatccaaacaaaggctgcgtgctaaagaaatcccaacctacatcaagaaaaaaagtaatcatgttcttaacatgcaacaatcaattacgcagtgaacataaaagtttgcagtaagttattgaaacttagttgggcatggtcacagtgaagatgccagtacagaggacagacccaaacatttaaagcttcttcactaataaatagtccaaatccagcagccatgagcaaccaaaagtaaacccacctgaagaaatttattagcaattcgttatattttaaaaagttttggaaactcttttagtgtgactatggtacatgtgtatataaatgattcattttacatatttttcaccatccaccattaatcatcatatatgttgcaatggtgcaaggtggtaatcttaggtagttaggacaaaaaaaaaatccttggtagttggaaattatccccaaaagcatatgtatctagcatgtagtttccactcacaaataaattcacaatctgatataacagccaaaattatggatgctcatggagaatggaatattaaaatccaggaatcaacaatgtatttgtctttgtcttacttcagcagcacatatgcatttttttttttttgccgggttagcacatatgcatttcaggagtaatatgcaacaacacaatgttttaactgtgagtgaaacagaaagataacccataaaattgtgaaatgcacataccctggagtatattccggaacaataactttcttcccaaacagcgaaaaagtatatccgatggtcgctgccgcatccggcggcgccgaagcatcaacaatctgtggcaaactgaaagatggacctgaagaaggctgcctcatgaagagtgaaatcacagtagcagtagctgccacacccagagcaagtgccactttagcaaggaaagaagcagcagtgctgcttgatttcacttccattgcatcgattatctcgctctcatcttccccaccaccagaagaagattcagccccggaggccgatgcccttgcagcgcaggaatccatacgggagaaattacgcgaactgtttgtatttgcgagaattatcagatgaggaatttcgcaattgcgcagataattactgaaaattccaccaggcaattcaacaatttaatcctgatcctatcagaagcggttccacggagagagagagagagaaaaaaaaacccaacctcgtaatgcgaccgcgagcggcggaacggcgtgcgccggcggagaaggtggcgcggcggcggaggcgagggagagggagcggtggcggggagccgaagcggccggcgaccgtcgccatgggaggagacggcggcggcgacggccggcgagagtgtctcggtgtcgccgccgtatgtttgtgtggcgccaagcgggttgcttcgttggcacgaccgcacgagaggatgatgggctagaaatggaatatgccaagatgccatccaattcgaatttcatttttgtatttttttaaaaatttaattatcggtttatgaatttaagaataccatatttaaatcatttaaatatacgattagtggtcgaaatttaataaaaaaatagaatttaaaaaaggtgaatcatgccccatcagttgcactaataagctaaaaccaaagctaaaatttaaattttaagttgaagatattttaaggcactttctttttcagaattgtatttttagttactaataacacaatttttaaaggttttacttatgcattaattattatgtcttaataagttgttttggtttattaggggatatgggtaaccgataatgctagagacaggttggtgcactgatgagtgaattttactgttttcttccatttttttctgaagaatttaaatattttgttaattgcaaacgatcaagttttggtgcattttttgatatatatctctatctatctatgtgcaggttcatatacacatataatctatttagagaacattatgttacacagtacaaagtaggatacgaggagagaaaaacgcagagaaaacatctgttagtacaatgccatccatcaagatcgtcgtcaatggaagccatgagatggcagcagtatcagaaacagggaagcgacggcggcggccagcacacggcagccaccggcgccggcgctggatctcgccgccgccgccgagctgctgctgtcggtgggcttcgccgccgtcgccgcctcttccggtgggctggcaatggcgacaggcggcaacggcgggtccagcacgtcgcccggctccagcaccggcgccggcggcagcgccggcggcagcgcccccggcgctgccaggtgcaccagcgcgccggcgtccgccggcaggatcgcgtagctcaggttcaggctcagatcgctgcacggactccctgcaattcacacagagaagttaaaatttagagcaaatttcatcaaaccccatatttttataatatcgaagttgcataaaatcctgagcattatggccagtggcacatagcctcatctatttattttgacaaaatcccacgcctatacatatttggtaaatatttacttaccgtttcaaaacatgtaatgcatatgaaacttttagttttttatttcttcattaagtttgtcggtttaactcttcactactttgaaaagtattatttcagatgtattgaaatcaattgaaattcgaatcaaggtgggaatttttaaaacattagaccataaaatctcttatgttttacaagtcataatacctacgattttctgtaactttgatcataaaacgtgaggctttataaaatttacttttaagatgattaatttatattaatttcttgagctgaaaaactagttctagttggtgtctatggctttgtgggaggtaccccttccatttcagattataagccgttttgactttggccaaaattaaactactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27764 - DNA, 714 bp, Oryza sativa
  unsure (1)..(714): unsure at all n locations
attgattctatctagtaaaggtaaagataaaatcagcaacaatatggccaaagttccctgccagcaattcccacccaggaggccaggacagaattgaacataaaaggtaccaaaaaaaaaccacctacataggagtatatcctaaaattatagccatcacgccaagtagtaagtctctataaagttagatcaaacgtcctgagcaagtgacaactcagtaacttcagaagtaacagaaaattaaaatccaaattacctggataggaagagtaaatagacaaccacagcaaactccagcaaaataacagtctgctggtatgccctgtttgtaatcgtcagttaaaatatcgggtttatcagaaatttctgacagaatcactgtgagtgaagcctgggaaaatgactaaccaatgcgccagctagaaatcctgtaggattgcgaaccccaactgaaaatcgctcaactgcaccaaacatcacagatattagtgacttctcactgtcagtgattaatgaatgtaacccactggtgttgtttctggatgcactaagtgcagcactataatctggcatttcaggaaaatgctccttactcagatataaactcttgagaaattataatctcagatatataccaaatccaattannnnnnnnnnnnnnnnnnnnnnnnnnnnnnnnnnnnnnnnnnnnnnnnnnnnnnnnnnnnnnnnnnn

SEQ ID NO: 27765 - DNA, 731 bp, Oryza sativa
  unsure (1)..(731): unsure at all n locations
cgggagggatgaccgccggcgagatggacatgacggaggcggccgggatcacggtgcgccgccgttcggacctactggtgttcgccgtgccccgtgtccccgtgccagcgcagtagacagctggtgttatcttatctaagccaatatgagtaatcgcaattaatggcagaattcaccgataatgcccgtctttagattattttttttctaaaaaggtcacatcgaatgttggacacatgtatggagcattaaacatagaagaaaaaaatcaattgcatagtttgcatgtaaattgtgagacgaatcttttgagcctaaatataccatgatttgacaatgtgatgatacagtaaacatttaataataacagattaattaaacttaataaattcgtcctgcagtttacaagcgaaatctgtattttgttttgttattaaactatatttaatattttaaatgtgtgtacgaatacttaaaaagatttggcccagcaactaaacacagccaatttcatgtgagcagtagtcaaatggtctccttgattaccgtcattagtcaaaatcgcagttcacatcatcacatattcacatggcgcgaaagattacgacacgctaccaattaccaaacccccaaacactttcccccctcaaagccaaacaannnnnnnnnnnnnnnnnnnnnnnnnnnnnnnnnnnnnnnnnnnnnnnnnnnnnnnnnnnnnnnnnnnnnnn

SEQ ID NO: 27766 - DNA, 854 bp, Oryza sativa
  unsure (1)..(854): unsure at all n locations
ctaatctaaaaagtgaaaggagatgctgtcctaacaggcatcccaaactgaaagatgctagtcctgtcctaaaagctgaaaagcaaaaagaacacaaaaccaatcagcacaagaagaccaacaacgcaagacttatttcatcattctcctcctaagtcttgtgcgtcgtcttgtgggaaagttgggccatcccgatcctagaacaaagctcaaggaacttgatcctcctaaggggcttggtgagcaggtccgcaagctagtccttggtgtggtgttgatgtagctcgccttgatgcttccttcctccaaacagcctcggatgaagtggtacctcacccggatgtgcttgctccgttcgtgaaaaatggggttctttgctagggccagagcgaacttgctgtccaccctaagctccaccgctccagtgtctctgccgaagagatcaccaagcagtcgcgcaagccagagcgggtcgaagcgctggaggccgctatgtactcgcttcgtagctggacagggtcaccacctgctgcttgaccgaatgccagttaacgaggcacttgccgaggaagaggagaatctcgcttgtgctcttgctggtgtcgatgtcgccggcgtggtcgctgtcgatgtcaccggcatggtcgctgttgctatacccgacgaagtgtgcctttctaggacacctcgggtagtagagaccgtggtcgagagtccccgcaacgtagcggatgatcctcttcacagcctgctagtgctccatcgtcggtcgctgagaaccgactaacgtannnnnnnnnnnnnnnnnnnnnnnnnnnnnnnnnnnnnnnnnnnnnnnnnnnnnnnnnnnnnnn

SEQ ID NO: 27767 - DNA, 42039 bp, Oryza sativa
attaccaagttgtcgacgtagacacccaccagcaggacatttcctccattgcccagccggttgatggctacctcgtgcgggctttgctcgaagcccatccccttgagcgtggaatccaacttggtattccacgccctcggtgcctgccacaagccatagagagccatgtgcaggagtagcaccttgccctccttgtcggggatcgcaaatcctggcggctggtgtacgtagacctcctccttcaagtcgtcgttcagaaacgctgacttgacgttcatgtgatgaacgcaccagctttcctgagcagccagcgcaaggaggagcaccttgccctccttgccggggatcgcaccacgggggcgaaggcatcccctcctgctgcacgaaaccgcgtgccaccaagcgagccttgtgcttgacgatggctccggcttcatccctcttcagcttgaacacccacttaagggtgatcgcgcggtgaccacgagggaggttaacaagctcccaggtgcggttttcctcaaccgcgtccatctccgactacatcacggcacgccatgctgcgtgtctctcggcctctgcgaaagactgaggctcccgtcgtacggtaccgcagcggctcactgtcgtggtatgcgtcgatgcgctcctcgtcgtgagagagcggagtagcgaactccaccgggctgtgcttgacacaacctggcgtcggagtggatgtgcccggaggggtggctgttggtgctggagtgcgtggggtcgccggttgtgatggtgtcagcgaagaactcattgcagccgaagtcgtagctcgagagcgtgtcgctgctggagtcggtggaggctcgggggctaggtaggcacactcagtgaataagagctacctactcccccagctccctcgaagtggacgtactcaacagtgaagtcgtacgttggagtcgagccgtcgtccaccgccttgtcctatgcccaccctcgtctttcgtcgaacactacgtcgcacgccgtgtgcatacgctgtgtctctgggtcgagaatacggtaggccttcgagccctctgcttagccgatgaacacccctggggtgctcctgtcgtcgagcttgccgatgtggccgatctccttggtgaacgtgaggcagccgaaaaactgcaggtgggagaccgccggcttgcgcccatgccaagcctcgtacgggccttggtagtcgagcggttgaggatgtagacagccgtcaccaccgcctctccccagaaaacggccggcatccccctctgcttgaggagtgctcgagccatccctacaaccgtctggttgtgccgctcgacgacgccgtactgctgcgggctgtacggcgcgaagtagtggtgctgaatgcactcatcagcgcagtacgatgcgaattcagccgccgtgaattcgccgccgcagtccgcctccgcagcagcctgcgcgcgcctaatggcgtccgcaacctctcccttgctgccgagaaccattacccacatgaagcgggagaggtcgtcgacgagcagcatgaagtaacgtcgtcctcctggtgtggccggtgtcactgggccacacaagtccccgtgcacgagctcgagccgctccttggctcggaagcttatctgctggggaaaggggagccgcctctgctttgttaacacgcagacgtcgcagagctgcttcacgtggtcaaggcacggcaggcctcgcaccatctccttggcactgagccgcttcagggcctcgaagtggaggcaggccggttgtgccacttgcacgttgaagacgtagagtcgattggtgccttaggttaccttggcaagaaggcaacgacggcaatcccaaatcctcatgacttcgtgctcgaccaacaagcatgaatctttctcatccagctgtcccacgctgatgatagagttcctcaaagcggggatgtagtagactccggtgagcacagggatttggcggtgaaggtgatggagccgacccccaaacttgacggaacctcagacgctggagtcaagctcggtgaagaactcccgtcggtcagtcatgtgatgggtggcgccggtatcgaggtaccactcatcagtcttgtcgttgctggagccatctccgaggaaggcgcgtaccttcggctcatcaagttggaggaaagccgctgcggccggtgccgctggagatagctcgatgcttgcgtgtgccaggagcagagccgactcttcctcctcctccacctgtgcgacgttggcctggccgtgtcgtggctgtcggcagtctttggcccaatggccaaacttgccatagttgcggcaggcgtcatctcgcgccggcttaggcgcctccgcgggcgccaccctgggtgcgtcctcgcaggacgtgtcccttgccgcgcttgcggcctgtcgaggaagaggactccctcttcttcccgtcaccctggcaggcctcccactgctctcgagtgagatgaagcttcctgccaatggtgataagcctcgagagaggctgtggctcgtcgctgtcgacgaccttgaggcgacctatcgcctcctcgatcgacatcgtggagaggtccaacagagactcgatcgagcgagcaatctgcttgtacttctctgggatgcagcggaagagcttcttgacggctctctcctcatcgtaggtgtcgtcgccatacgacaccaacttctacagcagagtgttgagacggagggcaaagtcatcaacatcctcacctggcttgaaggccaggttctcccactccttgcgaagtgcctgcaatgtggacttgcgagcgcggtcgcttccgatgcgtgccgcagcgatggcgtcccaggcctccttggcagtccgcttctgggcgcccgttgatcctcgtcgtagttgacgtcgccgtgccgaactggctcccacatgtgtcgcacctggagccttatcctcatcaccacggcccactcgacgtagttggtcttggtgagggtagggtttaggccacacaccgccagggccgacttccctgatgacggcctaaatcctgtggtgaccatggtaccggtccggtgagggagagccatgccacttgcaacggctgcgatctccgtcgacccaaccgggccgccgcgtccacgcccgtctgggccgccgccgccacatgcatccccgccaatctaagctgccgccattgcgcgcgtggggttgcgcagctgcccactgctccgcccgctcacgagctgcctccctcgtcagctcatcatcggagctgccgtaggcggagatagagctgttggtgctactgtcgtgccgccgccgccgccgcttccacttccgcccttaccgttgccaattttgctgccgccagccttgacgccctcgctgccgtcgcagcggtctctaccaccactcgctcgcgttcctctgccgcggtgaactcggcctcctgccggagccgcgcgctcgaggcgaccaagcgctgagactgtcctgcggacatggcacgccactaggggctgctgcgtggggaagagactgcctttgaggagctgctgctcgtcagcgcaggggaagagggataagtaggaacagccggtgttcctgctgccgactgaggacagaggggagctcaagaaggagagttggggcaattttctgtttatttctcacaagtgccataccatcacgcaggggaggggggttgggatatatatttatagctggcttgctactctaaaaagtaaaagtgaaaggagatgctgtcataaaagaaagatgcactgaaaagcaaaaagaacacaaagaccaattagcacaagaagaccaacagcgtaagacttattccatcagacagttgcacatttattatgaagatgatgaaactgttctacattggtacttgttagtttgttgcatggtgatataacccccaaactgctacatcccggtgagttgtgtttcattttgggttgaaaaaaaaatacgggcctattcagattgtagccaaaattttagcaagatggcaatgttgccaaaatttaagatgacaatattgctaaaattttggcaggatttcttatgtatttaccaaatttgacaacaaactaaacatagacatttttttggcagctttaccaaaaaatggtatggttgaaaatagcatcaatctgaacagcccctacaatatcaaattcaaactatcgttttgacaagtatgtttttgaacatcatttcataaatcataagtattatgttggaactatttaccttctatctgtttaatccaaaatcaggaaaaagtagttcactttaaccagaacctaacgcttcttctgttaactacatgggacagattgcggtgaaaaggctcaagagttggagcaacaaagctgaaactgaatttgcaattgaggtggaggttttggcgacagtgagacacaagagcctgttgagcttacgtggctattgtgccgaaggccaagaacgcctgatagtctacgattatatgccaaacctgagcttgcactcccaccttcatggacagcatgcagctgaatgccatcttggttgggaacgaagaatgaagatcgctattgattctgcagaagggattgcgtaagcatgttttacatccttatgaaatattcattatgctgtaacagtatgacaactttcagtacatgcagaagtaatcttacatctgaaatctctctctaccatgcagatatcttcatcaccaagcgacaccacatatcattcatcgggatatcaagtcaagcaatgttctgttggacaagaatttccaagcacgggttgccgattttggttttgcaaagctcattccagatggtgcaacccatgtcactacaaaggtgaagggtacactcggttatcttgcaccggaatacgccatgcttgggaaggcctctgaaagctgtgatgtcttcagctttggagtactgctgctagagcttgccagtggaaagaggccagttgagaagctaaaccccactacgaagctaactatcacggagtgggcacttccacttgcccgtgacaaaaagttcaaggaaattgctgatccaaagctcaaggatgtcttcgtcgaggctgaactgaagcgaatggtgcttgttgggcttgcatgcagtcagaacaaacaggaacagaggccgataatgtctgaagtcgttgagctgctcaagggagaatctgctgagaagctttccaacttggagaatgatgagatgttcaagcctgatctgaccagctccttccaggactcatctcattcgtctcatcctgatagttcagactgcatcacagaagagaagaactcaaaagcagatacaatagacgaggcagttgattcaagtgagacagtaccttcagctaggtagtttgatgcatagaattataagttatctgtcattcatcagcaggagttattggtttccttccgtggagcattgtgtgtttacctctgcatgcgtgtttatgccttgtttaccggcaggtttgggtgcttcccttgtcatctcacagatatacttatctgtgtgtatggttaattgttacaatctgttttcggtatggttgtaccatggcttgtaaaattctgcatatctggtgctgatccaaagttaacatgttgttcccagtgttgtgattctcagtatttcatcggttacttagagcttctccaacagcctctccatcccactcttcaaaccaaattttagcaattctagccaaaaaaacgtgctccaacagcctcttcaactggatggctaagctatcggctggccaaaaccctccctccactagccaaatttggtcactttatttggctggccaatggtgggccccacagagcccatcttcctcatccccacacggcagccaagcacaggagcccgacgaggcatggggagaaactcgagcacggcagccgccggcctccgctcgccgcgactgccgtcctccgcttgccgcggccgctcgtcgcggccgccggcccccgcgcggcgcaacccgccgcccccgctcgccgtggctgctggcctccgcgcggcacaagctcgccgcgcccgccgtcctccgcgcagcgccgcccgctgcctccgcacggcgcccgcctcccgccgcgcagcccgccggtccccacgcagcgccgcctcccgccgacgctgccttcaccgccgtcccctccccgcttgctgccgccgcctgcttcttgtcaacgctagaaaagaaaagaggaagaggggaaggaaggggagaaagaataagggagtggctcacatatgggtcccggtgtcatagtcaaaatagagagggtagaatagagaggctgttggagtatacagttaatttgactagctaaatcagatggagagttggctatatgggtgttttaggagttcgatttggagaggctgttagagatactcttatgtgcaaaatatgtgcagttaccatgcatgttggtactgaagagccagagccattccaagaaaggaaggatcttttcaccacgtagaactccatttttctgacattttttaaaagaaagaatgaaggtgactaagggacaatattttaatatagcaggatgatatagagattctcgagggacaataaggttttacacttttacaaaggattctcaagatatacatatttcattcttgctagggttagtgtaggatggtgcagtgcacaccatgagaatcggagaatctgtatgtggtgcgaagaaaaactaagaacaccagaaacagaaaaaaaatgaagaacagaaacaaatccatgcaaaacttgtcattcagagagcaaattatgtctcagatatctctatttacctgctactcctgaagagactggacttgttacttcctttgacagaaatagcagaacaaaaatatgtcacctttttgcaactttcataagattttcttttctttttgcaaagaatttatgcatgctaaaaacaagggggtgagttaggaactcactgaaaagagcacagcctagatgagtaggtgcgctcccgtttttgggcccagatgaaggacaaggcccacctagaactcctacggtggaccgcgggcggttttgatccaacggccagggttcttcatcacccatccaacggtgacaatcccactaaaatccttccaaattttcggtttctttaaacatcttcgaattcaaatttctctcatcacgtagtacagcccagcatttcctgtcctcacgtacccccgaataaaaacgaaacggcaccagaacccagaacagcaagcaacacaaacccatcaaaacaaacaaaacaaaaagaaaagaaaaagaaaaaaaaagagcaagcgacacgagcgtcacgtgtcacgcttactcgagtcatcaatcatctactacaccccaccccactccactgcactgcactgcagtccacacgcgtccggttcggcctccacatcatcatctcctctcctctctcgtctccgcgcgccgtgagccgtccgatctcgcgcgggcggccgtgatccgctccctcccccccacccacgtgctaggccgccatgccacccctctccccttcctcctcgccgccggcgacggcggcggcggttctccgctgcggctccccgtcgtgccgccccgtcacacatgtgagcatcccttcccatctcctcgtatctcctctctcgttgctcgttgttcgttgttggtggtgtgtgttctcgttcggtttccgattccgagctcgtctactagcggtttgaaggggacggaggatcggattttttttggttttctagttcaagttgtgctgcctggtagtggtagttttttaattaggagttttttggctgaaattggtttgacggtggtcaattccggtacatctttaaactaatcttgataacggagaacctaacgagaactattagcgattgtagtttgtgtgtggcgatagatttgggatcaaaattcatccgctgcgctatgtcgctttgctgaagattgaaactatgtgtgaataaatatagttctgaatttttagttcagagttaactttggcatactatatcatttcagtcctttggttcaccgggagaattttcatgtacaaataaaatccccatttttgcagataggttcactaggaggtgtcctgttgcaacttttttctagcagtctactgatgcacactgttttctgcaatcccgacaggagctgttcaggcagaagttgagtttcatggtgtcatttcaagctcaacatatgagatgtgctcctcatttgatcaaatcagttgttaaaggtattagagcaaatatcactgatggcgagaatggagcaactgaaccagctagggagctattggagcggctgtttgcgaagacgcaaaggttggataccagtgcttcccaggatagtgagctgagtatgagcattgatgtactgaagtctgaatttgaggccgccttgtctaccttgaggaagaaagagagggatctccgagatgcggagaatcgggtttcagttgatcaggtacgcctgaaccgggcgaagaaggatcttgatcagagagagcgtgggatcaatagagcatatgcaaggcaacaggaaatggagagatcactgggtaaggcaagtagagatctggttttacaagtgaggcagatcgataacctgaagcttcttgttgatgagcaagacaagaaaattgccagctcacaagatttgctttctcagaaggtaactgaagtggaaaagcttaagcaagatatgttgaagaagaatgaagaagtaaccttgatgcgttcagagatcaagtccaaggaacagctgcttcttgaagctaatcaggctgctgagcagcaagaagcaacaattaaggagctccggagtgaaattaaaagaaaagaaattgatttttccagatcgaatgaattgagaaaggccaatgaacagaaactaaaaatcgccgagcaagaacttgagaggcagaatatgggatggttagcagcacagaaagagttaaaggaagtggcgcaactagcatgcaaggatatggatggtatcaaggatacagtcagtgacttcaaacgtgtgaggtctctgctggatgctgtacggtctgaactaatcgcttcaaaagaggctttctcctcctctcgaaaacagatagaagatcaagcagtgcagatgcagaaacaagttcaagaactctctggtcaaaggctattgctttcatctttcaaccagaacttggaagctgctcggttggagattcaaggcaaggcaaaggagctcaatgctgcacagtctcgctgtcatgaacttgaatcactgttacttcaggaaaaggagaaggttgagtctctggaagcagtgttaacaaaagaaagagagagcttagaagagaaaaccaaagaagttgagttgcttcaaaaggcgctcgttcagaaggaaaatgagcacagcaattcattaaagcttgttgaaataaaagaatctgagctgttagaagcccgaaatgaagtccaagatatgaaatcaaaggtggaatctatccaaatagctgttcaggagaaggattcagagctttctgaaacacaacgcagacttgctgaagtgaacagtgaagttgttgaactaaagcagctgctagatagcaaggaagatcaacttgttcaggttagaaccgaattacaggataaagaacaacacatacagacactacagaataaattggatagcatgaaattcagttgctcacaagctgaatctgtggtgcaaaagatagctgaactcactggcaatcttgctagttcagtagaaggcgaagagatggacatttatgcattgctggatgatgagatttcgagcacaggtacagccctcaagtccaatttgcacaagcataatcaactggaggctgacatagagatgttaaaagaatccttgcatcagaaggacatggatttaagagctgcccatgaagcacttgacgcgaaagatcaagagctgaaggcggtaatgagaaggtgggatgtgaaggaggaggtagacaagttggaagggttcctgaaagatcctagtgacatcaagagaccttctgatttttccgttcatatggggctccaaaatcttcaaactgaagctgcggaggtggaggcacttgctgctactactacattgaagaaacttgcagatatggctaagggattcctgagaagtggcaaaactgattctggcatcaatctggttgcatcgccaagtgtaaacagtactagaattgtttccaagaccaaaccaaacaaggaaatggatatgattcttgatgctgaaaaggaaattgccgggctcttttcgttgacagaacagctcattaccgaggctggaatagatgttgctcaccaagcatagcttcagaacccagaaatgtatatcatattgcagttttgcaacatttagatagttgctgtgaagattcagctgaaattgttagcgttttcatttcttttgctttgggtctcatcgccctgtttgctgttggattgctctgctccaagtgcgaaagggagacatcgatgttgatatgcctcttactgtttacatgatatattgcatctgctgaaatcctagaaaaaaaatgataaatttgtgatccaaaaccccttctctagtcagccagtggcggatttgctgacaacctaggcagctgcctgtaattcatattctccaaaactccttcagaccggagttaatgaagatatccaaagcctgtaaaattgttgctgattttggagaggtgagaaatagtgaaggattttactttctggacggataccaggttgcccttgattttggtcagctttcgacatgtagatttgctgaattatatctgtttttctcttctctgtagtttcccatcggagagctgttgattctcatcatgttatccatatgttaacctggaaaaattgtacagaatttgctgctcagctttagtgtatttatttattttttgactgaaaaaggtagaggggctctaccttataactattttattaatggtagtcaaggtgttacaacaggagtacaaagatttagtgtatttatcgtgcaaaaaactgtaagcatttctcgaagtgcataatctagcttcctatttttaaaacataaatctaacatccctgtttcagaacataaatctattgttccaataatctgtatcgccttagtgagtcagagcgcatgtcccagaaatggatcttgcagatgcaccaactttttttttgacttgtagaatttcacactgaagtttatagccttatttcttttctgatgaaaccacgtcgtgattcattttatttaccgaaataaagtgcgcattccccctctcaaaacaaaagtgcaaacgaagtttgagcgcgcgcgctctctctctctctcaaaacaaaataaacaaaagtactctctcaaaacaaacagaagtttgaactctctttcaaaacagaaatacagaagaagtttgagctctctcacaaaatagaagtgcagaagaagtttgagtttgcggcacacggaggatggggcggaggtgaaggtcgttcttcctccgaacagtaagggccatctcctctatcatgtccagctcacttgctgtcattccgcaagggagctcccagtcgaagtggaagagcagggtagaaaacagtagatctataatagcttccgcaaaggctagaccagagcacatcctccttcccgccccgaatggtatgaactccatgtccatgcctttgaagtctatggtactatttgcgaaccgctctagcctaaacacctcagcatcatcccaataattaggatccctgccaatagccacgcattaacaaatacggtggtaccttttggaatatcatatcccatgatcttgcacggctcacggcattgtctcgggacaagcaagggcgctgcagggtgaagccttaaggtctccttaataacgagctttaagtactttaggtcggacaaatcatcctctgtcacccttggcttccctgctagtttgtcacgcaactcagcctgtacctttcgcataacccttggattcttcatgagctccgacatggcccattggatcacggttgcagatgtctcactccctccactaaagagatcctaggagaaaaaaacaagaaaaaaattgagattaacatcagatgtaccatctactaactactactcccttagttccatactgtaaatcgttggactttttttttctagccaaacttctttaactttgatcaagtttatagaaaaatataatagtatttttaacacaaaataaacatattatcaaaatatattcaatgttagatttaatgaaactaatctagtattttagatgttgttaaatttttctataaatttagtcaaacataacaaagtttggctagaaaaaaaatcaaacgacttataatataaaacagagggagtagtagagtagctaagcatgtataatctaccatggtagcacatggattttaatttgtacttaatttgatgatgtttatagaaaaatataatagtatttttaacacaaaataaacatattatcaaaatatattcaatgttagatttaatgaaactaatctagtattttagatgttgttaaatttttctataaatttagtcaaacataacaaagtttggctggaaaaaaaatcaaacgacttataatataaaacagagggagtagtagagtaactaagcatgtataatctaccatggtagcacatggattttaatttgtacttaatttgaatttgaattttcatcaggctttttcccggttgggccaacaacacttcacctgctcggcgagccccctccaagaactcgtcgcgcctctcgaacctggccccaatcatggcgcagcaccaaggcttataagcagatcctaacccacctaaactttcaaggtggtactaaaccaccactatacaaccacttctgggccacatgggccaaacacacgagcgcgcccacgaggcgggccacctcctcctccctgacgcggcggaacgtccggacgcggcgcgcgctgagcagctcgacgacgcagatcttgcggagctgccgtcgccggggggggggggggcgcatccgccgcacggtggggctcagcggccggctcgcgaacgcgacgtcgtgcgcccgcatgatctcgcgggcggcgcacggcgacgaggccaacacgacggggacctccccgagcttgaggtacatgagcggcgcgtcgagccggcgcgcgaggtcggccatggcgcggtggacgaggctctcgcccatcaggtggtgcatgctcccgatcaccggcagccgccacgggccaggcggcagcttcaccccgtcgccgccgttcgtcagcttgagcgggagcacggcaaggaggaacagcggcgtgaaggcgacgaggatgccgacgcaggcgaggacgtgatccatggcgatcagatcgcggcgaggcgagtgcagtgcaagtgcaacattgcagcttcgcaaggttaacacatacgtagtatatatgaggcttcggcgccaattaagtgacaaagactaccgtttaattctgcgagtatttggagtggcatatagtagtagtagataggtaggtacgggctcactgcttcaattcccggtgctagtcatctcgaggtggcccatgctttgctccatgtaaggttgtcactatcggatactacgtagtactctctccattccaaattgatttatatatagattcttttgatgttatttctaaatgatctacatatttatattcgtttattaagtctattcgttatttgtgcattggagtaaatggacattgatgcatgtattcacacaagtatttatatcccacatgcaatatcttgatttgctattggcttagaaaatattggggatggtgtatgcatcgagtttgttgctaaagtaaatatagtatgagagagttattagtttttcttggtcttggtgtacctataaaatatgtagatcaatttagaatggagagagtaacgttttgctcaaagtaatatcgtatcgtagaatcgtaacgtagtatcgggatactatgagattttctttttttaagcttaattaatatttacattaattatatatagccattctatataaagaaaatatagtaatgatatatgtcatacaaatagagacatttattaagagaaaccacgttgattttgatatattgaactgatttttatataaatttgagcatatttatttacattattttcaaaccatgctattttaaataatattttgtagtatcgtaggaatcgtagaatcagaataccacctaagatttcgtaggatcgtatagtaatgaatagtaggatcgcgatagtataaaaataggatactaggtgggatcggtatcgtttcggcttggtaggatcgtagtatcgtaagatactaggatacgaatcgagatactgacaaccttggctccatgtccacgtcttaaaaaaaaactcaacctagaagagaatttgaccactcctaatacaatgaatttgggctacgctttatccaaattcgttgtcctaggaagagccacatcccctcataggttgagttgtttttttgggacggagggatcgtagtacatgctactccaaacaaggtgaggcactacttgtctactttggttcggggttcaaattactccctctattttatattatgacttcttctaagttaaagtttgataagtttatagaaaaatatagtactattttcaacacaaaacaaacatattattaaaatatattcaatgttataattaatgaaaataatttgatattttaggtgttgctgttttttttaacttatcaaacttaataaagtttaactagaaaaaaagtcaaacaacttataatataaaacggagagattttcggtatttgtatcggatactgaagtttctcaatttttagttattctatccgaaataatttgaaattttaacaacatttgccaaatacataaaaccatgaaatatccaaaaaaaaatcggccgaaataatttccagagggggttttgggtggggtgtgggtgggtgggtttccgaaattttgaccctagttcggttgctttgttaaaatcaaagtataaatggggaagcatacaaacatactacagtgttttatggtttcagtcctatgtcgacgagtattacgtataccattatagagctattaattttaatcatatgggggattttatcttttttaccataagatactttatattcgttataaataaattttggtccatactaatacctgagatactaagactactaaggctgtgttcggatgtgaagttggaaactcacctcccacgcacgcaaaacggagtaccatattttcttataattaattaaatatttacttttaaaaagatagattaatatgattttttaaagcaactttcgtatataaaccttttgcagcacaccgtttagcattttaaaaagcgtgcacgtgaaacacgaggaaggtgagttgcgaaagttggggaagaacacagcctaaatggctgtcgatgacagcaaaattactctaaccgtatgtaatagtgtgtaaaacagattttgctgctcagatttaatgtatttatcgtggaaaattgtatgcatttctcgaacagcataatccagctagcttccagtttcaaaacacaaatctctatggtagtatggttccatcgaggtcatcacagagctagaatgtcttaagaatgaaacttgtcgatgcaccaacttttttctgactcatttaatactgaagtttctagtcttaaaactttcccctattatatgaaatcatattgtaacccattttatttatctacacgaagtgcctctctctctctctctcaacaaaactacggaagtttgaccttacaacacacggaggatgggggcggaggtgaaggtcattcttcctccggacggtgatgcccatctcctctgtcatatccagctcgctcgctgccattccattagggagttcccagtcaaagtggtagagcagcgcagcaagcagaagttccatgattgcttctgcgaatgccataccaggacatattcttcgtcctgcgccaaacggtatgaactcgaggtctatgcccttgaagtcaacagtactgtgttcaaaccgttctggtctaaactcctcagcgtcatcccagtactttgggtctctgccgatagcccacgcgttaacaaatacagtggtgccttttggaacatcataccccatgactttacatgattcacgacactctcttgcgacaagcagtggtaccacagggtgaagccttagggtctccttaataatgagctttacatactttaagccagacaaatcatcctctgtcacagttggctttctcctaagtttgtcacgtagctcggcttgtgtcttttgcataaccattgggttctttattagctccgacatcgcccattgaagcgtagtcgccgatgtctcgctacctccactaaagagatcctataaaaagttaaaagatcgaatgaaaaatactacaaagatttgagagctgtaccatctaattgagcaaatataatccaccatgatagcacatactctctccgtcctaaaataaatcaatctcatacgagatatgatatattatagtacacttaatctgaacctgttactctgggatgaagagagtagatatattttactttgcttttaatacgacaggtgtcaattttacttacaaggataacagctttgatttgttccatggtgagaggcgtctcgagctccccttgtttctgtatgttcaggagcacgtctatgaggtcttggttcttgtcgtcctcgacgccggcgccgccgtctaccacggcggcctccgcccgctgctgctggtgctgccggatggcgcagtccatgagctcgtagagcttcctgctgttcgcctccgctcgccgcgccctgccgccgatggcgctcgccagccacgacgacgggaacaggtcgtcgaggctgaacccgccgaggagcttcatctgctcggtgagctcctgcaagaactcgtcgcgccgctcgaacctgtccccgatcatggcgcgcagcgccgcgtccgagacggcctccgcgatccgctcggtgaagttgacggccgcctcctcgccgggcgacgcggcggcggcggcgagcgcgcccacgaggcggccggcctcctcctcccggacgcggcggaacgaccggacgcggcgcgcgctgaggagctcgacgacgcagatcttgcggagctgacgccacagcgcgccgtacggcgcgagcgccaccccggcgccgccgggccgcagccgccgcgcggtcgggttgagcgcccggtcggcgaacgcgaggtcgtgcgtccgcgtgacctcgcgcgcggcgccgggcgacgaggccaccacgacggggacctccccgagctgcaggtacacgagcggcgcgtcgccgagccggcgcgcgatgcgcgccatggagcggtggaggagccggtcgcccaccacgtggtgcaggctcccgatgaccggcagccgccacggcccaggcggcagcctcacgccaccactaccaccaccaccaccatcaccactcctcgccagcttcacccaaagcatggcgaagacgacgacgacgacgacggcgacgacgcaggcgacggcgtcgtacatggtgatcagatgatcgacgacgacaacgtaagtacgcgaacgcgagtgcaatgcaatgcaggatagctagctagctaggctagggaacagatatatacgaggcgatggagatgagatgacaaagagagccgtttcatctgcaagatcgatgcacggcgcacggcggcgccgtcttggcgcggggcgccattgcagatgagctcgaggctggctgctgctgctgcctgctgctacacgccacggaaaccgcgttgtctcgtcatgcggtggcgccgcgagcggtgcccactgaattgagatggcaacggcagatatcataagaggctaagatttttgcaacggcccggacactgtacttatccttgtgttttcttgctgcttttgaggccatgtatttacatctcataatttggggaatttgaaatatctcgttttcatgtgggggaattgaactgtaaacatagtaccgctcgaaaatctaattctcaatcccatgtaatgtgccacaaatggatgctatatatatctccatctcaattaatcaaacagagagaaaaacatacaaattgcttacttcatatatctaaagaagaaaaaaatgaacaaaaggagagagcagtaatgcttgagttgccttgctaaagtccccataaaatacattttatttgatgtcgttttgaggtggaggtgccacatagaccatctcttatctatctttttttttttgtgtatatccacttataaatatagagaacggatctctacccattatcaaaattaaatccatccatatctatctatctaactttagtgtatattcacttgtgaacacagagacaatatctctatccattatcaaaattaaatctatctatctatacctatcttttttttttgcgagggctatatctacctatcttgactgtatatagagactggttctctgtgcattatgataaataaataaatcaatcaatcaatctatctatctatctattaactgtgtatatccattttttgttacggaggttggatctatatccattattaaaaaataaacctacttgtttatatctatcgatatatctattatattaaaaaatagaaaaaaaatggaggcaacacgtttcttttggaggctaaaaattctcatattaatcgaagaataaaagaaagatcctggccattaaattatattgttcaaattatacctctgtatagattgttcaatatagttgtgtacaaaatacaattttatttataaaaatagaagctaagagtcgtatatcgaatctatttgtatttataaaatgcctctatatacaaattacaattgagtaagaaattcaaatttgtttttattttcatgtagatattataattgcatacttctatttataaaaatagaagataagagttgtatttcaaatctaattatacctttacctacctttgtgtgaaattatacacgagaatcctctagttattatatttcaaatttttctgcttgatctgggcatttttctctttgaaattatgtagctttcacttctatattgttaacagtagcaacatgtgtgtatattccaacatgcctccccccccaaaaaaaagaaaaaaatagcccatacaacatgtggattgaacatactagcgtagtatcgttcaactttccatctccaagttcatcctctgaggctttgaactctgtgaagaattaacaagagaaacgaacaaacctattaaccatgtagcctagtggttacagtgatctgagtagtactcaaggtcctgagttcaaatctcctatggagtgaatttcagattgggttgtttgcggggctaagttccctatttcaatggccgtatatatccggttggatgtagatgccgggtagaaaatacccttctctaaaagaaaaacatagcaaggtgcagacgtgcagtgcagatggcaacatagaaaacaaatttgcaattcaggctgtgtttagttcctgaaaaaagttggaagtttaggaaaagttagaagtttatgtgtgtagaaaagttttggatgtgatgtggtgtgatgtgatgtgatggaaagtcggaagtttggagtagttaggggtgaactaaacaaggcctcaattggcgatggcaacgttggtggtgttgctgttgcctgctgctctcacctcttcttgatcgttaggattcaggcctcagtgcagtttagcagctgcagtttcaggcttgcaacagttagcactcgcgcggacgctcggcgacagcgctacgctacacggccgacggaactcggcaaggcactcggatgcgcggatgcggcagcagatggaactgatcggctgcctgaaacgagctagacaggatgaacgactgacgggcgacgtacggcggcggatgctatcctgcgtagtgtttttttttaacgcacacaagaattgcacgttaatatattagaagaatagaggttttatcctgcgcagtgttgatcctgaggacacgttatgcgcggcgagcggttgcaaagccggcaatctcgcgactcgcgttcgtgtatacgttgtcggctcttcggaatcacttacactacaatagttagctgccaaccattggagacatttaactatttaattcctttgattcttcgataaataaatcgtagtgccacaaatcacaacaaagaaacacataaccttattaagaaaatcaaacattgaaaaacaaggagagtttattaaggcagccacgagtggcgaggtacattttgtaagatcttatgtagaggcatcacaagcatagatactgattgcgcacattgaggaaggtaggtgctatgcggtaagaggcacacgaagagttgggagcaggtagagatcattcttccttcggatggtgaggcccatgtcctcagtcatgtccaactcctccggtgctgccccgttagggagttcccagttaaagtggtagagcagcatggtgaggatgaactctatgctgacctgggctaatgccaagccagggcagatcctgcgtccggccccatatggagtgaactcatagtttgtgcccttgagatcgatctcactatcctcaaaccgctctggtttgaatgtctcggcgtcatcccaatgtttggggtccctcattattgcccacgactttatgaatatgacactgccttggggcacgtcataccccatgatctggcaagtttgctggcacacccttggggtgagcaatggcaataccggatgcagcctatgagtctccttgacaatcatcttcacatacgttaggtctaccatgtcggcctcagtcactgtgggcttccctttgaggatgcttcgcacctcgttctgtgctttctccatcacttttgggttcctcaccagctctgacattgcccattggatcgcattcgaggatgtctcacttcccgcacaaaagagctcctataaaatgacaaaatgcaacatatgtgaaactttgacctgataaaaaactaaggaaaatagatatgctacatcaagttaaagacaatatgcaagtgtgtgtgtatatattacccatctgaaatttaatttgtgatctgaactgtttttcttcaacaaattcagagtagcagaaaattcttatctgaacaatcataatagtagaaaacttatctatgaacattaagagcagtagcaaagttacttactaggatgacagctttcaagttgccggcagtaagaggcacctcgaggctaccttccttgtgtatcctgatgagctcatccatcaagtcatcctcctcctccttggcgatgtcaggcggcggcgcggccatggcctccttttgctgctgccgctggcggaaggcgctgtccaccagctcgtaggacgcccggttgaccgcctcgccgcgagccgccgatggcgccggcgagccacgacgacgggaacaggtcgtcgaggctgaacccggaggcgagcttgacgatctccgggaggacctcgaggaagtcctcccgcctctcgaacctctcaccgatcatggggcgcatcgtggtgtccgcgatggccaccttgatccgctcggtgaggttcacggcctgtcccggcggcgtcgcggcgacggcggcgacgaggcggccggcctcctcctcgcggacgccgtggaacgagctgacgcggcggacgctgagcagcttgacgatgcagatcttgcggagctggcgccacagcgcgccgtagggctcgaagaagatgcccttcccctgcgcgcgcagcttctggacagtcggcggccacggccgcgacgcgaagttgatgtcgtgcgtcttcatgatctcgcgcgccgcgtcggcgcacgacacgacgatggccgggacctcaccgatctccatgtacatgagcggcggcgcgccgagctgccgcacgacgtcggccagcgcgcggtggacgagcgggctgcggcggaggaggtggaagctgccgatgaacggcagccgcgacgggctgggcggcaggttcagcccgtcccactccctgcgcggcgcgaggagcatgcgagcgagcgagagaacaacgaggacggcggcggcggcggcggcgaagcacgagacctgctccatggcggcgggtggtggctgtgagtgatggtggagtggtgtgtggtgaggtgagtgccatggaggagatgcacccggctatttatacactggagagggttagtgacagcagagacttccaacctggactcttggagaacattggcacatagttaatacaccactatatggttggacaggtgtctagctagtgaagaagagggagaagataaatatgtattaatattttattaatatagagtgtataagtattttattaactacacgagaagatatatatgtatttatgatggctatatatatgattgggcaagtgtctattaaatagagttcgcttaaaaataagtcgaatgtattaatatttttttattacacgagaatatatatatatatatttgaagaaggaaaaaaaacaaacggagagcactgtttgagttgtcttgttaaagtctccataaaaatacattttatttgacgtcatcttgaggtggaggcgccacatagatcatctcttatctttctatttattattgtgtatattcacttataaatatagagaccatatctctatccattatcaaaattaaatccatccatatctatctatctcttatgtgtatatccacttgtaaatgcagaggcaatatctctatgcattatcaaaattaaatctatctatctatatctacctatcttggcggtgtatagagattgtactccgttcactatctatctatctatctatctatctatctatctatctatgtgtatatctacttgtgaacgcagaggcaatatctctatccattatcaaaattaaatctatctatctatatctacctatcttggctgtgtatagagactggttctctatccattatctatctatcttttatgtgtatatccacttgtgaacgtaggggcaatatctctatccattatcaaaactaaatctatctatttatatctacctatcttggctgtgtatagagattggttctctatccactatctatctatctatctattacctgtgtatatcaatttatggatacaatgatcggatcttgtcaatgttttagatcacgactactgtatttatatagtaaggtgatcattggtaccagggtatatgcgagattgaggtaaaagagacggagtatatacaggttcggaccccttattcatcagaatcaggtaataaccctactcctgttggccaaagccgatgttgctcttattcatcagaattacacaagtacaatatttgagataacctatctacttgtcgtcaacttggcagcatggaacaccaacacgttgtcgacgacagggtagtcttcctccttgaataagtacccggcaagattagagatagcgccagatccctcttgtcatcctccgtaggcgccagattgggtatgtctaggcttatttctgatgttgatgtccggcggcgtgtattggtgtctattctgacagatgttgtcttcgtctctctccctctccctctcctcctaatgggtcttgtatttatacccatagatgtcccattgtccaagtagaactaggagaccaatatgcatacaatccgagtagttcttacagtttccatgtagaactctacttgttcttccttatccggaactccttctatatacgtggtatgattccatataggacttggtatatgatgagccccgccaagcttagttgattactattaggtatatgttatccataaccttacaaatctatatccatatattgttaaaaaaataaacctatctacttatatctaccgatatatctactatagtaaaaaatagataaaagatgaaggcaacacatttcttctagaggctaaaaattctcacttaattgaagaataaaaagaaagatcttggccattaaattatagtattcaaaatatagcggtgtagattgttcaatatagttgtgtaaaaaaacaattttatttataaaaacagaagctaagagccatatattgaatctaattgttatacaaattatagttgagtatgaaagtcaattatgttttttttttcatgtagatattacaattgcatacttgtacttataaaaatggaagataagagttgtaattcaaatctaattatacctttgttaacgaccaaatttggtaatccaagtaacggagatgaagatgggatcgaagcggagtacgagatggagatcactccggaaacagagtaagtatctgaagtcgagtcggttgcgatcaggatcgacagagtccaagttggacagggttagccgattgagccgaatccgacaatatgacacggcatgcattgtcgggttgagttaatgtgcttcataatgattgccacatatggatagagtcctgaaaaggcaattgtatctattaattatgacatttcatgtaatttccttagagatatgttttgggcaaaagtctgccgcaaagacttatggtatcttagagtttgttagagataagagtcatgtacgatatggacatattttgtaatctcgggtataaatagaccccgaaccctatgtaatcaatctaacacacgttcaatacaatcttggcgcatcgccacccttttactttcgttttgtttcgatgagttcttactttcgggttgagctgcatcggtttcgatcttcaactattgttatggcgtcttgcgttctcgggattagtgcttccatctttatgatactctaatcttgtttatataattcgtcgagttatcatatatcccatataatctccggcaatatcgttatctaacctccaatcggctaacgtctgttattagaaggcagccgattaggttaaataccgacgttgacttagattatataggatattcaccactctatgaaacatccaacggtttgattgtctagatattgtccttcttttcatacttatagctgcatcagttgggtttgaccttataagtcgtgattagaatctcaatctctagcctgcttttggttgccgattagggtagcatcggagtttcagccgatcttacctgatttaactacatttatcttatatgcttgattgacatgttaaatctgtcctttatgattaagatattgttgcatttatgtatattaggcttttgtttggtatattttacttgctttgatatcttaatatagagtactagtatcggagtattagccgatacatgctagatctatctgatcggctatgctatgaacatatatagtcttgttgttaatatatatttcgatctaagtgatttatactgtctcggcatggcgaccgatatatcccaatcacttgatttaagtatatatcgacatagagactatatattgttaatatctatagccgatcgaatagatttagttctttcttacttattcatgactgccgatcgattcacatatgacatcggctcaaagataaatgatatgtcatcggcaactagccgatcggctatcgtttatgaatttaaccgtggtttctttgtctttatttcttgttgattgcaggatcaaatcaactggcacgctcatacacctaaaagcaagcttttgaacctgcacttgagttaagcagatctcccaggcctcgtgttttcacatcaacatcctttacctcgtgaaattatacgtgaaaattctctagttattatattccaaaattttctgctcgatttggacaatttttctttggaaaatatgtggtttccacttctatattatcaacaatagcaacatgctcgtatagtccagcatgccaaaaaaaaaaaacatgcccatacaacttgtggaatgaattcaaaggccgtgtgcttaaaatcaattgcgttatctgtgattcgctctagcttgaactccttgggcagcctttgtcccaatatttagggtccccaaaaatcacctacacgttgataaatgcggtggtgtcttttgcaaggttttaaatctcctgctatagctatacaactatcccaggagatagttgtttgaggatctagctatttgctcccatgtactataatttaacaactatccggaggatatgcgcggcggcctcacggctacaaagccggcaatgtcgcgactcacgttcatgtacacactgtcgatcggtttttagcatcggttgcacttcgatagttagctgcctcctgttggagtcaatgaactatttttgttgattctcccgtaagtaaatcgcagtgccagaaatcacagcaatgaaacatggaaccttattaagaaagccaaacatagaataaggagatttctgtcggtttattaaagccgaaacgagcagcgaggtacaacttgtgcgacctcatgtagaggcatcacaagcacacatactgattgcacacatcaaggacggaaggtgctatgcggtaagaggcacacggagagttgggagcaagtagagatccttcttccttcggatggtgatgcccatctcctcagtcatgtccagctcctccggtgcagccctgttagggagctcccagtcgaagtggtagagcagagtggcgagcatgaactctatgctggcctgggctaatgccaagccagggcagatcctacgtccagccccaaatggtgtgaactcatagtttgtacccttgaggtcgatctcaccatcctcaaaccgctccggtttgaaagtctcggcatcatcccaatgcttggggtccctcattatcgcccacgagtttataaatatgacactaccttggggcacatcataccccatgatctggcaagtttgctggcactcccttgggatgagcaacggcaacaccgggtgtagcctatgagtctccttgacaatcattttcagatactttaggttggctacgtcggcttcggtcaccgatggcttccctttgaggatgctttgaacctcgttttgtgctttctccatcactcttgggtttctcatcagctctgacattgcccattggagcgcatccgaggatgtctcgcttccagcaccaaagagatcctgtacaatgccaaaatgcaacacatgtgaaactttaaccagataaacaactaaggaaaatacatatgctacatcaagttaattgaacactatctgcaagaacatatatatatatatatatactcttctgaacttttgtctgaactgtttttttccttcaaaaacaaaatcagagtagcagaaaaatcttacctgaacaaccagagtagtagaaaagctctattctgatctgaacattcaggggagtaagaaaaatacttactaggatgacggctttcaagttgccagcagtaagaggcacctcgaggctaccttccttgtgtatcctgatgagctcatccatcaaatcatcctcctcctccttggcgatgtcaggcggcgacgcggccatggcctccctttgctgctgccgctggcggaaggcgctgtccaccagctcgtaggatgtccggtggctcgcctcgccgcggcgctgcgagccgccgatggcgcaggcgagccacgacgacgggaacaggtcgtcgaggctgaacccggaggcgatcttgacgatctccgggaggagctcgaggaagtcctcacgcctctcgaacctctccccgatcatggggcgcatcgtcgtgtccgcgatgaccacctcgatccgctcggtcaggttcacggcctgtcccggcggcgtcgcggcgacggcggcgacgaggcggccggcctcctcctcgcggacgccgtggaacgagctgacgcggcggacgctgagcagcttgacgatgcagatcttgcggagctggcgccacagcgcgccgtagggctcgaagaagatgcccttcccctgcgcgcgcagcttccggatggtcggcggccacggccgcgacgcgaacttgatgtcgtgcgtcttcatgacctcgcgcgccgcgtcggcggacgacacgacgatggccgggagctcgccgatcctcatgtacatgagcggcggcgagccgagctgccgcgcgacgtcggccagcgcgcggtggacgagcgggctgcggcggaggaggtggaagctgccgatgaacggcagccgcggcgggctgggcggcaggttcagcccgtcccactccccgcgcggcgcgaggagcatgcgggcgagcaagagaaccacgacgacgacggcggcggcggcggcgaagcacgagacctgctccatggcggcggctgtgggtgtgtggtgaggtgagtgccatggacgagatgcacccagctatttatacatgggagaaggttggtggcagcagaggcttccaacctggagaatattggcagatagttaaggcgaaatcaattcttaatgagaaagttaatgaagtggtgtggcttgatagctgtgattttgatgataccttgtacatccagaaaaaaagacaaatatactactccaccactgcatggttggactagtgtttattaaaggagtgtttgcttaaataagtataatgtattaataatttttattacacgagaagatatgtatgtatttatggtacctatgtatggttggacaagtgtctattgaaggagagtttgcttaaaaataagtataatattttaatattttttattacacgagaagatatatatgtatgcatggcacctatgtatggttggacaagtatctagtgagtgagtggaagatttcgcttaaaaaaagtagagcatattactattttttagtacacggatgatacatatctgtatatggtacctgtgtatggttggataagtgttgtcgagtgagtcatagagtgttcgcttgaaaactaactagagtattttatatttatttagttttgattacacggaaaatgcatatgtatatacgacaatagacacgtacctcatactcatacactcgtgaacatgccacttaacccaagtaagtagagtatatataatatattcctacatcttgaacttagaatccactctcactttgctgttgtcagatcacttggtagctatggacagtggagttctgtcatgccttcaataataaactgattcatatgtaaagcaaaaccaactagctggagatttattgttagagatagggagataaccaattattagttgtatagatatctggcacattaattagatactttctcaatatcaaaatataagggatttacgatggagagataatcaattattagttgtatagatatctggcgcattaattagatactttctcaatctcaaaatataaggaatttaagatagggagataatcaattattagttgtatagatatctagcgcataattagatattttctcagtctcaaaatataagagatttaaatagagagataatcaattatatatatatatatatagcacattaattagatactttcttggtctcaaagtataagagatttaagatagggagataataaattattagctgtatagatatctggcacattaattagatactttctcaatctcaaaatataaggtattttagatagggagagagtcaatttttagctgtatagtgtcacgccccgaatctggcaccgccgtacaacggcacctgacaggagcgtgtcgtgggaaaaacggcgcgaaccgcttcctacgaaaccgcgatctcagtaccagtcccaggacatagcgctggtacccacggtgacaaatatgaatcattgcaatccttaaaataaatagaggacttatttaccttaacttaggttgcagctcagacagcccgagaatgcaaccgacgacacggacgaggcgaacaccaacaacagcagcagcagcggaaccaacggtctaacacccaacaccacaggcagcagcagggaactaggacgaaaccctaatctttacttcacttcaacttcatcttcggagctgactgaactatatttatatagagagcaagggtgagtacttacgtactcagcaagccaggggaacttaggtggttaatgcaggcttcaagggaaggctgttattttgcaaacagttttgttttcaagttttcaacaatctaagtgtgtgctttctacaaccagagcgagacaagtctcagctcggtcgggaggtgagaagtaacaaatttatttatcacgatttgcacaactcccagagttggcttcaaatctagtttttcccaaaccaaaccaattttccaaacttcccgataatagaggtccccaaacgaccaatcacttccagggacacccggtcccgctgtccccagggtagctaaatgcttcccaagcattaggtttcccaaaccttaacaccttttcataaaacagggtaaaacaaaaactacgctaaggaatcacctcacatccgcccatgaccgtgggcacggctgttcgaacagtttgttaacctctgcagagggggtacactttacccacacgacattactaacccgaatcacctagcccgtgtagaacgaccacgtctggtgacctaagggctttcatgacaaggcatttcgagagcagacacaggattgccatatgccgacgagaggggtcccagaccaacaacaggttaggtcccagaccatactgtgccaggaagcccatgggtcctccccgacaccaccctggcgaatccacatgtctctcggcatcaaggctcccccgattagcaatttactcagccaggggcatcccattccacccgtgtggtcacactattgtatgctcggatgtaattccaaaggaatcggtccttagatgcgaccgcacaagtattccgcccaggaatggccttgtgtcgcgagttttatttttaaaactcattttctttcacaaggcaccgacccaggcgtcgggttttccaaagcttttgtaaaccaagttttacccaagaagttactcagattttaagtttgaaggcgaccgtcgatactcgcacagagtgcacgaatatcgaggtgcaactagatagttacaagggaacatgatataacaattaacaatggaaggatcagatgcaacgagttgggtaggcccaccggtctgcctttcagatggggcaaacaaattaagtgtagtcctatcaatgcataatattttgtaagcaatataattaagttcaaatataggctcaatatgttcaaaggtggcttgccttgctcagggtcttcacgaagcttcacgaatcttcaagatatccacgatcgacgaaaatccggtaaccgcaactatgcgcaaacaaacaaaaacctaaacaagagaccaagaaaaagaccctatttagactaaataatagtgccattaaatagatctcaattttatggaattactggaagtggaacggggtcaatcggacgattggatcgagagatacgaattttggaagtttaattagaatttctggcgaaggaagatatttgtagaacaaggggagattgattcatgaaatttatagaaataatattctcaagaatattattgaccatctctgacatgcgggaccaaaggaaatgatttataaggaaaatgattcatgaaattttggaatagagaattgatttatgggatcaagggaaaaagatttattaacccatgaaataagataaaataatttactgaatttatagaagagagaaatatttgtggaatattggaaagacattctcaagattatctttgactcattgacgagtggggccaataagaaggtgagagagagagagaggagcaattggagggagcaattgcggacctttagctcttcggtgtgtgagcaccggactcggaagagggagtaaaagtaaacttcctttgttttgttaggccgaggaggaaggctggccaatgggccaagtccacgagccaggggagagagggggagggggacggctgaccgactgactgggcaggggcgggcccggtcaacgccacgtgggcagccacgtcggatggggagagaaaagaggggggggcgggaatggcatcggacggctcacggcgcgcggcggaaatccggcgaacagcggcaagccgaagcgagcgacgaacaccggtggctagaggaggtcaaggagaaccgattccatggctcggattggggagacgacgcgtgacgacggccggcggcggcggcgaagctcgccgggatgccgacgtggatgcgcgatgggaagggatgcggctcacgcgctcgggcttagtggacgcggtatggggttgcggcgcacacgcggtgacgcgggacccgatggtcgccgggctgtggctcgcggcggcgccttgcggcggcgggaggggcggcacggcgcgggagcgaggaggaaggtcggcggccagggggaggggttggggaggtcgagggggggcccgaggaaggtggcggcgccgggaatcaaggagaggagggaggccgacggcaggggaggcacagcggaagtggccgagcgcggcagcggcgaatcgggcgacgcgacgcgagggcgagaggggaggccggcggctgaaacaacggcttggggaggtagagagggaactcaagaacggcggtggctagaggagtcgccgagagggaggccaacggtggctctcgattgcgcacggtggcggaaacagagcacgcgcgacgcgagctacgcgagtgctgggacagaggaaaagagaggtagggagctcaccgacgggaggtaacggcgtcggcggcgagttgaggatgggaaggccgatggcggcgcatggacgagcagcggcgcagggcgacgaacgcgatgccgaggcggcatcgtgtcacggcgggcgtgccggggaaggcaacggaggcgtgcggtggcgcccttggtcgcggcggtggcgttcttggccgcggcgaccaagaaggcggcgatgctccggggttggccgcgcgacggtgaccgaggttgagggaggaggcggcagaggacggaccgtgcgacggcgagacgggggcgagcagctggcggccggcaacaatggcgcgggtgtttcgagcgaggcgaagacgaaacgagaggggagggcgcgggctttataggcgaggaggagaggtcggtttggaggagggaaaccgacattggcggtcaagggagctcggctggtgttcacgggcggcagcggcggtttcgtgggcagtgcgaaagcggcgatggcgtggatgcgttgggcggcgaaggcggtggatcggacggcgaaatttgaaacgcgagcgcgggctggcagcgtggagcggtcaaggtgggggcggcgagctggccactggcgtctgcgtcatggtgctctgcctccgggcgcaaggagacatgggcgggagagagagagacccagcccagaagggaaaaaggggagggggacggtgaaaagggaggcatgtcccttccgtttttgggaggagagggggcgggagcacgagctgtgcctcgcggctttggacgcacgcggcgtggggcgcagggctcgacaggatgacgccggcgacgactgcaaaaggacggggactgtttggaggtgagcacggacacgcggtggtcgtcggagcaggcgacgaccgagggtggcgatggcgtctcccagacggtcggccacgcgcgcgagcgcacgggaaacggcgagcggattcaaacggcggcgagcggtttgggggcggcgagggagagagagagagaacgttcgagagagggaagggagagagacagcgctctctctttcggtggtcatgtgcggcgcacgtggagatggagggagctggggagagatgggccagcggcaggtttcggcccaaatcatcacgagggaggtaaaatagacttttaccggaaggtttgttttggagagaagtttgatgtggagattgaatttgaattcaatttgtatatttgtacacgagggttcaaggtggatccaagggaggggtcaaggaagggcttcaaaagcgggaattttggtatttttgggatggatttgtatttggcggcatgaaggattatttcagaggatttcaaaaagggaagatcattattcaaaaatggaacaagggagatagcggtagaatgccatggatagatagatagacagaaaggtaggttgataggtagagggacggatagacagatggattgacagatggatagataaacagatagataggtataggccctgtttggcacaactctagctcccaactccaacttacctggagcgggagctgtgccaaacggtccagattcatctttttttggagtggagttggcagagctactcctagaaaatgaactacgggggtggagctgggtttttgctgctccacagctccactccaccccaaaagacccactaccctctaatattttagtgtatttacacgaaaatgccactcaactaccctttcaccccttctttcctcccgttctctctcctcccccaatcttcctcccaatcccgagctagtgcggcggcatcggcgggctgcagcagcgtcgacggcgacgggcagtgacagcggcgggcggcggcggctgcgggacgacgacgggcggcgcccacgcgtggccggaggctggcggcggggggctgcggtagcggcggagagcggctgttgggggacgaggacgggcggcgcggcggcggggccagcaggtggcggcggcccatcttcttccccatcctccgacgacggccacaaccagttgtggcggcgtctgcgttggcagcatacggggacagcaggccacggcgcatcggcggcggcaggcggtggcggcggctgcgggcggtgttgcggtggccgcgacgggcggcacgcggcagcggcgtcggtaggcgactcgcgtgcgggggcttcggcaggaggcagcctgggcgacggcggcggcctgtgcggcggcgcttgcgcagcggcttgggaggcggcggagatgcgtgggcttcccggcggcggtggctcgtgggctgaccggctgcggcggcaacgtcaaggcgacgcctagaaggtgttcgatgaaatggcgacaaaggatgtagaaatgtggagctgagtaatctagccaaacacttttttacctacctcagctcctagaggagctagctctcactggagttggagtttggagttgggagttggagttaggagctctaccaaacggggccatagtagatagatagatggatcgatcgatagatagatagatcgagattcagagagagatgggatggaagagaaggaagaggtggaccggaaaaaggatgaaggaatccaacctatgagggaggttaaatagactttcacagagagatttaattgggaggttttagagttggagtctggattcgaatttcgaggttgatactcggtctcgggagaataggaaggagtcaaggaagggaacaatattcggagacgagtgaaaaggggatggataatttagagaaagagagtgtaacttgagagtttgagtttgactactcaacgagatatgtgggtaaggattttggagagaagtctgaatagaagggttcggactttgagattatttcggaacggaaatcattttggggagaactcagggcgaaagggattgaatcttgggattttgagttcaagggtggaagtgatctcgatttgcatattcagacttgggtcagaagttcgagaaagaaaacaagggtagattgatgaaccaatacagggagaaagatagatgaatcaaaacctgagaggttgaattcgaatttgagaatcggtttgaaggaaccaaggagagagcttatgacgcgaaggtgaatccttggacggagttaggattcgggcattcgacaaagttcacggatggggttccaggaggggatttcgaatagaaggaatcgagcttcgggactacattgggatggtaattttgaggagacgatctttgataacagggtatcgagacaagggagggatttaaatggagatctttggcacaacttagactcaacactcaaagaacgaaattttcgcaattaggattttgccaaattagtttttaacgtctcacgaaaagcggagcgttacatatagatatctgggatccggcacattaattagatactttctcagtctcaaaatataagagaattaagatagggagacaatcaattattatttgtatgaatatcttatgaaggtaataaggtattgtggggatatacctagtagtagaagatatgaagatacactttaacatatggtgtctagtatattattacatgacacatgaggcattaccgaggcacgatattgaccctacaagttgcatgagaatacctattattatgagttttatggggttcatatatcagaatagtattatgaaatgtcataattgcttcttgtcagtgacatattaaattttaaattttttatgagcctttttttgacgattaactttttatgagcctagacaatagattcggctaattcctgtcgtgctcatctggagacaaccatagcgggaggtccgttatggacactaaattcaattccaatatattttaaacttaggtaacactccgagcaacataatcatcctacagttttaaaagaaaaacacgaacctccatcattttgtatacctagcacactaggtaactaggtccgatatgtttagtagttgagacaaccttgtccctttgtccataccatgttatggtaggtaaggtacatggttgatctcgactttctctactacactaattatcacaagtgtttcacattgatattattatattcttctccagatgtgggatccacccacctctccctctccttacatttcttttctagccagcatttccatgaattaaaatgatgctcacaatcaaggacaatatattctaggataaaaagaaggacaatctattcttagattattagaaattcaacaatcacatgccatgccccctactagcagactagcacatatgtgagtggacgaggtagatcatttagatagtgtggatttcctattactaagtcaggtttgaataacatgtattgttcgcctcttggctaaatttcaaatgtttcgaaaaatatacgaaagtattgattcaagcaacaaatttattaagtcattgggcacatcataatgcatgacttgtcatacaaacacttcaaaagagactacggcctacagaggcacacaaactgttggatgtaggtaaagatcattcttccttcggacagatagtcccatgtcctcagtcatatctaactcttcaggcgacataccactaggaagctcccagtcaaagtagtataggagtgtagcaagcacaagctccatattggactgtgcaaatgctatgccaggacagatccttcttccagccccaaatggcacgaactcgaagtctgtacctttgaagtcaatcatgctattgtcaaagcgttctggcttaaacatctcggccatgtcccaatatttggggtccctgttgattgctcacacgtttataaaaacggtagtgtatttcgggacgtcgtatccgatgacattgcatgcttctcggcactctcttgggagaagtaagggcagcacgggatgtaacctaagcgtctccttgatgacaagcttcaggtactttagatttgtgagatcgtcttcggttaccgttgtcttcccttgtaggttgttccttaactctgcttgtgcctttctcatcacttttgggttcctcattagctctgacataacccactggagcgtatttgctgatgtctcactccctgcattgaagaggtcctgtggaataacaagatgcaacctgaactaatcaatagacattcttagaaaaaaaagaaataacaaacacttctagaaaaatgaaataagaagatgcaacctgaactaatcaatagacattcttagaaaaaaaaaagactagctaacacttctagaaaaatgaaataacaagatgcaacctcaactaagcaatagacattcttaaaaaaaaagactaacaaactcttctataaaaatgaattactcttctgcaaataataatgtagaaatagatgacttccatatgtaaatctattttctatatgtaaactaaaacactatgaattaatgtgtgttcttcataaatcagagcagcagaagtagtagcatttaccaggatgattgctttgatgttgccaatggtgagaggcacctcgaggccaccatctttctgtatcctgaagagcacgtcaacgaggtcctcctccgcgtcgtccatggcgccgtcagccggcgcagcaacgtgaaccctccgctgttcgtgctgctggaacacgctgtccatcagctcgtaggtcctccggtggttcgcctcggcgcggcgcgccatgccgccgatggcgccggcgagacgccacgacgggaacaggtcgtcgaggctgaacccggagccgatcttgacgatgtcggcgagcagctccaggaactcgtcgcgccgcccgaacctgtccccgatcatggcccgcatcgtcgcgtccgtgatcaccgccgtgatccgctcgctgacgttcacggcctcgccgcgcggggacgcggcgacggcggcgacgaggcggcgcgcctcctcctcgcggacgcggcggaacgaccggacgcgccgcgcgccgagcagctcgacgacgcacagcttgcggagctggcgccacagcgcgccgtacgtcgcgaacaccacgccctcgccgtcgcaccgcagccgccgcgtggtcgggttccacggccgcgttgcgaacgcgacgtcgtgcgtcctcatgatctccctggcggcgtcggcggacgaggcgacaacgacggggacctcgccgagcctgagcgacatgagcggcgcgtcgagccggcgcgccaggtcggccatggtgcggtgcacgagcgggccgcgcgccatgacctggtggaggttgccgacgagcggcagccgccacggcccaggcggcagcctctccgcgccattgtcgccacgccgcttcgccgtcaacctgaccaccatgagagccagcaagaggaagcaagcgcaccacgccaccttctccatgccatccatggccatggcaacacagatcgatcgagtgctactctaagccagacgctcgcgtccaggtgcagatagatatatgcagaggtgttactgttaattactactaggtggcaagtgacagaagcagctttgttggatttttgtcgccatgggagtaaatctctgcttactaattgctaattatgaaattccaaagatagctgatgcaatgcatggctgcaagagatggatgctaggtggatgcatgatgatgtactctaattaaggtcgtccgattttgtaattaattgacttcagcggtggtcgctgggcgctggctatgcttacgagaattttagtggctggaaaataaataaaaatgataaatgggcgatcacaaaaggggaaaagattaattgacaccagctggcaggtttgagagaggctggacgtttgcttatttatctcgtggcttttgttatgttactttttcctaacaaaaagatcttcattttttgattttttttttggtcatgttttggccttccaagtaggatggccattactcctggctctaaaagactcttgtttcacattagctttagctagttaaagccatgataagcaggagatcaaaatactactatatgtttaagagaaaatcccttgtatacccctcaaattttacctaatcccttctatacccctaaattttacttacttccttttaattctgatcccttccatacccctcccgtcagttcaccgttagttgaccgtctattttctataaaaatgaccattttacccttggatgaacaaagaaattcatgaattacattattaaaaatataaaagcttcttgcataagactattatagttatgagtttgttgttcgatgcattatttatcccaaaaaatattgatagataatgaaataaaaaaatacatatttattttttaaaaaaaaagtcataaaagtgaggagcattcatataaaaatagaactaccaatgttcacaacattcttttaatgaatgctcccgataaaaaaatccattgtcctattaaaatttcaaataaaaattttaatttattgcatttattttattttcaaaatttatgtcaaaattttatgcactaattatttagtctctttagttttataaaatgcacatactgtacactcaaacaaaatttttaattgtttttgaagcttatatttaaacctaaatcatcaagggcaaaaaggacatttgcaaccaaacgtaacagtgaaatgatggaaaatgtaacggtaggggcatggaagggatcaaattgaaatttcaggggtatagaagggatcgggtaaatttcaagggtatgaaagggattgagtgagttttcaggggtacacaggaaatttactctatgtttaatcgttaacgcagatagaaaacgagaagagagagaaaacgggtagtattacttttcatggctaaaaggataacaaaataataaaatagtatcaaaaaggtttaattcaccccattttgaaacaatggtgtttttgagaaaaaaaaaggccaaaagaatagtttttaggacagagggagtttccaaccttgcaccactcttttggaagattcagtccctgtttggttcatgggactaatccattagtccctcccttttagtccctaagaatccaaacatgggtgactaaaaaggaattaaaaagtgcatatttgactaaaatccattagtccctcttagggcagtcccaaccctccatctaggatggtgtctatggcattaactacattgccacgtaggacttttagcttatatgacactatattaattaagagagagagagtgaagagaggaagaaactgagtctcatgcaagacacagcttcaacacgagaatctatgcactagacactatcaagttttgcattgggagagaatagtgtcttcataataaatgaagaataaatatgattggtggagaagagagatgatgtatttattaatggcccactttaagaaaccatgggttgtagagtgtagtttttattgtgatgtcttgttgacatgacaccatagacactagttatggacaccatgggttgggatttgggaatgtccttagaggtacttataggaactaaagtgatagcctctctcttctctctctccctcggtccacgtgacttcccttttagtccctagatccaaacagtaggggactaaagtttttagtctagggactaattttagtccagggacgaaatgatccaaacgggacctcagagtgataggttgaattacgactgaagaacttaaaaataaaatttacatctatattattaggcttctaaataccaatataaagttttaaaaatagattatgatgtaaaaaccccaaattaattgtaaaactaaattttaaatttcagattttgattgcagctagtaaacaaaccaacaaatgataaaaactgaatg

SEQ ID NO: 27768 - DNA, 11146 bp, Oryza sativa
  unsure (1)..(11146): unsure at all n locations
tacatatacaaagtttgtatacgcgtatgcaaagttggtatatgtgtatattttttatacgttgattttttggtacacataaaaattatatatacatgtatatatatactttatatatatacgtataaactttgtattattaatataaaaattatacgtatgtatacaataatacaaagtttatatgtatgtatacaagatatatacatatgcatatatacacgtagtagtactgtagtagtagtagtgtatgactatgagtagtagtagtggacctggtggtcacgcgctcgtgtgactgcgcgacttgtcgcgcattaggggcgccctagaggagcgcagcaacaatttcgaactcttttttttttataattgaattcattttggctttactccaaagaagttacatcagttattacagaggttgcaagatgaacaagtacgaatgtgtgaacaactatggggcaaccggcacatgggcatttggaacaaggtaaagatcattcttctttcgcacggtagaacccatcacctccatcatatccatcttggccggcgagatgccatcggggaactcccaatcaaagtgatagagcaatgaggctagagcgagctccataattgcttctgcaaatgccacaccagggcacatccttcgccctgctccaaaaggtaaatattcaaagttcattcctttaaaatctatatggccatcctcaaatcgctcgggtctaaatgtcttagcgtcctcccaatatttagggtctctaccgattacccacatgttcacaagcacaatagtacctatggggacatcgtagtccatgaccttacatgtctcctgacattccctccctagggagaagtagtggcaccacaggatgtaaccttaaggtctccttgataataagtttcaaatacttcaatttaaccaagtcatattctgacactatttgctttccttggagggcatcacgtaactctgcttgtgccttcagcattgttcttggattcattatgagctcagccatcgctcattgaagcgtatttgccgatgtctcgctgccagcaccaaaaaggtcctatatgcatggtaaaaaatacatgatttcccataaagtgtagaaaatattgtatcaattccttcctatgttcactatgcatacttttttataaaaaggaaattcatgtactcgctccatttatccgtataagttattctttaaaggtaaattttatatattctgacctaaacagtagttaaactagatgtattgttgcggtagtggatttatattttaaagttgtgtcttactccatcataatggatgctatgtttttttagcgagattaaggatgaaaacaagacaatgatatcctctattaaataagcgaagatgatttcatggtggttgggggataagaaaggaacaaaattaagtgataggtgctaggtgcaattaaaacatgtccatagtagttcaaaatccctaatatctattgacaattggagatggccaaaatactttatatttgcgaaagggggagtagctattaagttatatttttgtgaccaaataaatttatagtttggtattaaagattttttaaaaaataaaataaatcctatcgaaattaagggagatatagtattagcatccacaggaaaagaaaaaaaaagggagaacaactagagtacttacaaggacgacagctttgatattgcccatggtgaggggcacttggaggctcccttccttctgaatcctgagaagcacgtcgacgatgtcctcatcgtcttccacagcgccggcggcggcagctgcagcagctgccctcttctcctcatgctgcttgagagcgcattccatcagctcgaagttcttgcggtggttcgcctctgcccgccgcgtcgtgccgccgatgaagctggccagcctcgacgatgggaacaggtcgccgaggctgaacccggatgtgatcttgatcccctcggcaaggccctccaggaattcgtcccgcctctcgaaccggtcaccaatgatggtgcgcaccgcggcgtcggagacgagcgccgcgatccgctcgctgacgttcacggcctcgccgggctgcgccgccgcgacggcggcgacgaggcggccgacctcgtcctcccggatgcggcggaacgactggacgcggcgggcgctgaggagctccaccatggcgatcttgcggagctgccgccacagcgcgccgtagggcgcgaacaccagcccgacgccgtcgctcatcatgacccggatggtggagctccacggccgcgtcgcgaacgcgacgtcgtgcgtcttggtgatctccctggcggcgtcggcggacgaggcgacgacgacggggacctcgccgagcctgagcgacatgagcggcgcgtcgagccggcgcgccaggtcggccatggtgcggtgcacgagcgggccgcgcgccatgacctggtggaggttgccgacgagcggcagccgccacggcccaggcggcaacttcaccccgccattattgtcgccacgccgcttcgtcctcaacctaaccaccataagagccaggaagaggaagcaagcgcaccacgccaccttctccatgccatccatggccatggcacacacagcacgcagatgcagatacatatatgcagaggtgttactgtttactactaggtggcaagtgacagaagcagctttgtcatggtgagttggattttgtcgccatgggagtaattgctagggatgaacttccaaagagagctgatgcatgcatggctgcaagagatagatggatgcatgatgattatcagattatgtaataacgtctattttgagttcagcggtggccactggctttgcttgacttttttagaattttggtgtcgggaaaatcaatgaaaaagatactctctccggttctataataattgatgttttagacaaggttaggttaaacttttataactttgaccattaataactttaaaaatatttactttaaacaaactagaacaacatatatagatttgtctttcaaagcactataataaaagtaaacatgcatttatttattgtatatattatagtagaaaaataagatcaaagatatattttgtaatccgtgtcattgtccaaaatgtcaattaaaatgaaaccgaatggagtaaatgagtgatctcaaactgtgaaaacgatgaattgagcccagctggcagagtggcagttatgagagaggcaattgattttaggctggacccttgctactctctgtgtcttgtggctattttgatggtttttttccaacacaaatatcttcttttttcaattaggatctgttgtaccacattcaacagaaaattgagggaaaatctgtcaattttttgccactggatgcgtgtcaagatttgtgctccatgcgagaaacaagcgagtagctgatgtgagttgatcccacaaccctagacttaaatgcatggcccttccatttcaagccacggtgtcggttatgaattacatccgacttacattcgaattgtgtagttatatactagttatgttgtaatttcattacaattatgtagttacatttgacagatttgtgagagaaattctcttgaatgtacattcgataggcagtctcttttctatttatttccatgttttgtccatccaaacatttttcatccctttatttcaatttccaggtatataccctctcctttttcccctaggattaattcaaccttttcactttggctttaatgtttcttctcaagtttttcaacattttttgttccttattctttttccatgttcaaatttcttctgcttgcaacatttccaatttctgcatcctctccaccaacctatgtattgccattttgtcttgcagattttttaattcttccttttttttttcttgcgatttgcaaggcatacgttgtgaccatggaggagttaatcttttcttttaagaaaaaaatcaatggtggagtcaattcaatttgctttccattccggttggaagtgcgaagattttgaaatatgacatatttttttcaattctacttttaagaatgttagtattgaacccatcatagttcaaaactcaactactaattactgaattgtctattgtaccttaggagtttggtgttcttaattttctttaggactagcttacaccactctctccctctccaatgaatgttttagcattttagcaaagggaaaacaacacaaacaactcgagcttgttaactacgacacaaattaaactcgtaatttatagttacatgaacaactatgatggtacttatttcgagaaaacattaaaaaagttgagcagcataacaccataagggcatgaaacacaatggaatgctcatgatcgctacttggcaggtacgggtcacaggagacacatattgtgtgaagcagttacgagccaaactatagaggcacacggacctttggaaccaggtaaagatcattcttccttcggatggtgatacccatctcctcttccatgtctagattgcttggcgcaacaccactagggagttcccagtcgaaatgatatagcaatgaggctagagcaagctccatgctaacctgcgcaaatgccaaaccagggcacatccttcgtcctgctccaaatggtatgaactcaaagtctgtgcctttaaagtctacggtgctatcctcaaatcgctctggtatgaatgtctcagcattttcccaatgcctaggatctctgcatattgcccagacgttcacgagcacgtttgtacccttgggcacgtcgtaccccataatgttacatgtctcttgacattctctcggaagaagcagtggcactacaggatgcagccttagggtttccttgatgacaagcttcaagtatttcaatccgatcaaatcatcttctgacaccgattgctttcctcgaagacaatcacgtagctcagtttgtgccttttgcatcactcttgggttcctcacgagctcggacatagtccattggagtgtattagctgatgtctcactcccggcaccaaaaaggtcctatagaatgcaggggaaaattttgaaactttcatgaagtcatgttgcataaaacaagtagtagaggtgcaattaaagacttgcaatatatgttaatgtcatttaactcttactagttaccatccattttatattcttgtacatgtaaatttatttcttactaccatttagcatgaattttatattctaatataatactaacattatcacacagatagaacatgaccaagaatgtatacttgcttacacgaatgacgcctttgatgacgcccatggtgaggggcacttcgaggcccccttccttctgaatcctgagaagcacgtcgacgatgtcctcatcgtcttccacggcgccggcgccggcagctgcagcagctgccctcttctcctcatgctgcttgagagcgtaatccatcagctcgaagttcttgcggtggttcgcctccgcccggcgcaccgtgccgctgacgaagctggccagcctcgacgacgggaacaggtcgccgaggctgaacccggacatgatcttgacccactcggcggcggcgtcgaggaaatcctcccgccgctcgaaccggtcgccgatgatcgtgcgcaccgcgatgtcggtgatcagcacggtgagccgctcgccgacgttcacggcggcctcgccgggccgccgcgtcgccgccgtggcgacggcgacgacgaggcggccgacctcctcctcccgcacgcggcggaacgacctgacgcggcgcgggctgagcagctccaccatggtgatcttgcgcagctgccgccacagcgcgccgtagggcgcgaacgcgaggccctcgccgtcgaccatctggacccgcacggtggggctccacggccgtgtggcgaacttggcgtcgtgcctgctcatgatctccctcgcggcgtcggccgacgaggccacgacgatggggacctcgccgagcctgagcgacagcagcggcgcgtcgccgagccccctcgccaggccggccatggtgcggtgcacgagctggccacccgccatgatctggtgcaggttgccgatcaccggcagccgccacggcccaggcggcagcctcatgccgccatcgccaccaccgcgcttcgccgccgccagcttgaagagcacgagcggcagcagcgccgccagcaagaagctcgcaaccttctccaactccaggtcggccatggccatggcgatgtgcaggtgcagctagctggagcaatcgtgtatggcacgcagatgcagatgctacttgtctactgctacatatgcggtggaggtgcgtcgacgacgaggtgatgatcaaagcggtttttgtcgcggcgacgacgaggtcggagatcgacacggtgttcagtttggcgccatgggatcagttttgacgtggtcgtggatatacagcaacgacaacgaagtgatggtagctttgcctgtccggtaaacgtcaaaagtttgccgagtttgccgcgatttcttcggtggacgcggactgatctgaaaaagggaaaggctgattgtgaattgagcacctcttcccacagccgatccatcagtaagatagtagaacggcaataaatgagtggacgtccacctaaatgattgaaaccctgaccctcttacggtaattagttgagtttacaactttgcacccgaagtagtgatcagttgtgttatgagtgcaggaaaaaaacgagcaagcatcaaaaataatttatgagtaaatatttgttagtctactttatctagggtataaaaaaattaaaaactaaggtaaaaaagaatatgataaaaaatccacattaactctaaaactaagctttaaaattcaaatttgatactagttgataaaccagcaaatgaggagggcacaactgatgtgtggagggaggctctggttgaactggcttgcttgggcccatagatggccaaatgggccgtctggcacagcacggcctaggcccggcagtgtctgggccgaggttttcgagccttttcgggcccgcacggcctgacctacacgccgggccgtgtcgtgccagcccacgggctacacacacggtccaatacgactcgggtccatcgtgcttctccacagaattagtctatttctcatccctcgactctgtggctatgtccataatggctgaaaaataagtctgttttatactcctcttgtctttgggccttgccttatatggttatttaagtctattttggattcctctactatttttcttcgatcatgccgtgccggccggcccaccgtttcgagggtgcagcccaggctcggtccggctgtcgggccaggctgacacggtacgaccctagtcgggctgtgccgtgcttgggccaagccatgggcctcagatcatatggccatctatacttggaccagggctcagttttggctggagaaaggagatagaggactaggagggtgtacatataagttctatggagtcatgtctatcgatactaatcgaacataaaaacttccgaacctcatgggccgctgacccccaacctggcctatccatcatcgtcttcaccttatctactccgcctccattgccgccgcagccattggctgcggtagtagcagggatggtttctcccattcgcttggtggtggcgaatcaaggaggctagcacagtagcacttcgtccttgctggtgactgcacattgttactgcttgatatttgttgtttgcaattggatattggttgctacatgtgtagcgacttcggttttgatcggaaatattggtcaatgattggtaaagtcggttcagcaactacgactaatggtgagcggatcatgcaaccaattataaccatttttcactcattttcttcacctacttcctcttctcttctcggccaatcacaatcccctaattaatcgtagttataccgcttaagttctgttttaaaatgaagctaattaggtgatctagcttcattttaaaacaaaacttgagctgtagaacttcaaggacggagggagaggcggagagctaatttctggtctcccgtcaatggaatttaatattttcatttgtttccacgtttagaggcttatgctgctgtcttctgttcaaagcagatgagttacattttgtcaaatgaaaattatttttttatcacaaatgaaaattaaaacttagatagaaagtacaaacataaacggtaatggagtcgtggtatatgactcaccaagctttaaattaatcctgatttctattaatattacgtaacaatgatgcatttttaatagaaagttattatggccagggatttatcactagtaaatcagaaaaaaaatactactccttccattttatattataagttattttaattattttacagtgtgattaagtttatagaaaaaatatatcaatattttaatacaaaacaaatattttatcaaaaatatattcaatggtatatttaataagattaatttaattttgtacatattactatatttttataaatttaattattttttaaaaaaccttataaaagaatttaaaggactaaataaagcgttagtaaacgagagtatgcggtggcagagcgagccacggaacatgtccagatggaggccgctgctgctcgggcctcatcgtcatccgcctttgccgcggtcagcttcgtcgtgagctttgagtttgaggaggtcgaagcagcacgcaaccttctccatctactcctactccatatgtggtgacgcacagtggcggagctagaacaaaacgaaggggttccatttacttgttttactttgatttgaatcaaatttagcttgatacagatgtctaaatttaaactaacggggtatataaatagtgaaaatagataaaatataggtaattttttttaaccgggttcatggacacccccttagctatactagctccgccctggcgacgcagaatccacggatattccggacggaggtgaccctgtcaagtgacaaaagcagccctgttatcacttgccactgccataggcccatagccgatcgagtttgccgtcgtcggttcgctttggcgccatatgggggttacaagttatcatcttcttcgagtattcattagcataaatcgtacaacgttttagatggtatcactttctcgtttccatgcgtaacgttttccgaacaattaatgatgtacatttatttttctaaaacaaatttcatattaaatagctgggtggcccgcgcaattgcgcggctagcacctaaacaaaatcatatatttttaagtattattttacttaaaatttattaaatagctatctagctatttcattgtctttaagactttgaaagaccaaaccttactatccccgtgtttctaatcatatagtttttaaaagtcacaccagttgctaactcttatgtcatctccttatttatttgcttgctcgatctaccactattttcattcattcttcttggaacctttaaaaattggattttatagtttttagagtttattgtcatgttgggtttcatttttataatttctagatgtcccatcaaacgttgccattatactactctacggcccgtccactgtcttttctctttgttgtcattgagattttaaaaatcgaacataattatcgtttgggttcattttttactttctagaagtcccgccaaaccgtcagcggctttgctattgtactcctttacggctcgcccgctgtctcccttctttattggcattgagattttaaaattgaacatgattatcattgggttttttttactttttagaagttcaaaacctttaaaaattggacttgtagttttatttttttataatttttagaagtcccatcaaacgatgccactatgcccctctatagcccgtccgccgccaactctttattatcattgtgattctagaattctttttttattttctagaagtcctgttaaccgtcggcagctctgcaactgtactcttatacaccccgcctgctgcttctcctttttattatcattgagattttaaaaatcgaatatgattatcaatggggtttgttttttttttactttctagaagtcccggcaatcgccttactcgtttgcttcacggcctgcctgacgtctctccttttaatcgtcattaggattctatttgatgttttattaacaatttttatatctcgtatcaaccgccaccactctacttctttataggcatgttagttaatttatctcgtcatgtgttttagatggtcttttctttcaataatctttatttttatcacaaattttagttatttataaattgtattcctaattgatatcttatttttctttttctaatttcagaatttttttaaaaaaattagttaatatcgtattgtgttattttaatgtttttattttttattttcaatttcagttgtttcaaaattgtattcctatttgaactctctttttgtttttctagttttagatattattttatttttattctaatttttaattaatctcgtattggattcttctttcaatattgcttatttttaattttgaatttcagttatttttaaattatacatctacttggactctccttttttttctttttctctttttctccgattaatgtgggaattatttttattccgaattttaattaatcttgtataggttattatatggactcttattttaacattccttatttttaatttcgaatttcagatatttttaaattgtattcatacttggactctcatttccttttctaattttagattttattttatttttatttcgatttttgatttatctcgtattgggttcttatatggaaacttattttaatattccttatttttaattccgaatttcatctatttttaaattgtatttctacttggactctcctttccttttctagttttagatttttttttatttttatttcgaattttgattaatctcgtattgggttctnnnnnnnnnnnnnnnnnnnnnnnnnnnnnnnnnnnnnnnnnnnnnnnnnnnnnnnnnnn

SEQ ID NO: 27769 - DNA, 706 bp, Oryza sativa
  unsure (1)..(706): unsure at all n locations
nnnnnnnnnnnnnnnnnnnnnnnnnnnnnnnnnnnnnnnnnnnactgcatgattctcagatttcttcctgttctttttttctttttcaagattgaaagaggaacacctcacctgtgatccatcccagagctggccccagtagacgctgccaaacccaccctcaccaagcttgttgtcatagttgaaattgttcgtcgctgactgtagctccttcagcgagaagatccgccatgtcgtctccttcttcttcttcctccggccaggtagaaccctgagtatagaacaagcaaacagatcaacaaacgagcttcatttcctcttcaaactctcaagtacggactcttcttcccaaaaaaaagaattggcacatttttaacggattaattagatataagtttccactatgtcattctatttcagcttgctgaccaacaactgcaatccgagagcgaacagaaaaattccccaatacaagcagagaaaattccacgcatcatttggttcatccatccaatgaaaacaggtgaatgttgcggtgttgtatgctcgcatgattaatcagcaaatcacacacaaaaccacaaaacttgatcagcaactcaccattttcccaaacaaaaaccattttctggttcaagacacttttcaggctccagcagaaaaaattcttcccagaaaaaaaaagttcttcttagctatcaatcga

SEQ ID NO: 27770 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnnnnnnnnnnnnntctggggagttaaaactgctaactggcatggttcagaactgagtcaagcacaccacaacatcgaccagagcaagaattccgaattccacgtttcgaaaatttcttaaaactgatcaaatcaattccactataagtttataattcgctgaatcgtgagcctcttttctcctctttccatccccctccttttcccttcctacttccaggctccagcagaccagcacgcctcttctcctcttctcttcacacaacgtcattgtgttagcagagtcactgtcagcaataggaggcacacgactattatcctccctcttacgtattgttcatggttatggcgtcgcagagtctacaccagatattgtgcatgcaagtacatatatgtgtaatgaggtgacagtcatcgatcaaaattgaaaagcagattattcatggaattattgtcatgagttttctacttgattataaaaataaattgaataatttgagaattaaacttaaataataatttataataggtaggataggaagtaggagtacacatcatcaaaagttacatagcttatcatttagacacgtacatacgagacaaacatactatttataagtgtgaacaactataagacagttgacaaaggcacacgggcagtaggaataagtaaagaacgctctttctt

SEQ ID NO: 27771 - DNA, 9649 bp, Oryza sativa
  unsure (1)..(9649): unsure at all n locations
ttgattaatctcgtattgggttcttatgtggaaacttctttcaatattgcttatttttaattccgaattttagctatttttaaattgtacttctacttagactctcctttttctttttttctttttctccgattaatgtgggaatttctagctcccacagcgaatgtggtgcctcctttcaaagctgttttaataatataatagatagatttctttctctaaaatttttaaactaatacttaatgaatcatacgctgatacattgttttaattttttttaataatcaccggaggggagaggttccccacctagatttccattgaagagaaaaatagggtacaattgaagtgttcaagctagctagcagctagcagttacaaatgcaaagagaaaatagaattggaaaatatagctttccaagactggactgctattctctctgggattttgaaacggtgttcctagaggtttgtttcttctaaacatcgtctcaaaaggttgagaagagattgcaagtttcaaaagaccacatcatgtcgatggttccacaggcaatagaaacacagcaagtagaaagttctgaagtgtggctgcaggagcggcggcgccggagacagcatttgtaaatttctaatgtcggaaatatttggatggattccaatagatgtctagaaacttatagacggtagaaacgttgtttattttgtatgccgagaggggttccaacccttatagacgggcaaacctcaaaatataaattaactagatgacacccccacgtattgctgcggaatatttacgtgttaaatactccctctgttttaggttataagacgttttaacttggttaaagtcaaattactctaagtttgactaattctgtagaaaatagtaataatatttttaacccaagacatatatatgatgaaaatttattcaattatagatttaatgaaactatgctggtattgtaaatattactatttttttctataaatttagttaaacttagagtagtttgattttaattaaagtcaaaatatcttgtaacctgaaacggagggagtagttactatcctggtaaggatgtgcattctaagaacatgttagaaatgaaggcaaccaccatttgaaatttaggttggaatgtatatattaattgagaaatctcaatacatgtgtatcaaataattaatgcgggtatacatttaggtttaatatatgagtgtgctgcaaaagaagagattagtcactcaaattttctaaaagaagaatcttcaatacagagtgaaaagggtgaagcagtgaaccatgcttccttttttctgccgttatgttggactatactaaggtagtacttccatgttagcgattgtccgtcaataaatgttaagataaaagatttacttagcactagtacaaatattatttaataactaagctgataagcaagcttaaaaaacagaggatgatataatgtaaatattttaatgcaccattagataccaaaacaaagctatggcgatgaaaaacaaaatacctgtctcatgatagaaagattagataacacccatgattagatcagctccaggagattaggagaagagatgaccgattgtcatatagaaccaaactgattgaggataaaaccggggaactgccatgagcctgacaatcgatgtgagataaaattggagaactgccatgagccttgacaatcgatgtgagataaattgcttgggtgtttgaaatcttgaatgttacaaacgattgtgagaaatttcatgagtctcgaattgcttgggtgtatgaaggccatgtttagattgtagccaaaataaaccttaccaaaagtttagcaatattatcaacatgccaaagtttggcaataaactaaacgttgacattttttttgataacgttgccaaaaaaaataatatggttgaaaatagcatcaatatgaacagcccggaatttcatgataaaatcttgacaatcttaaattgcttgggtgtatgaaaccggataactgacattgggtctcgacaatagatgtgagatgaaatttctcacaattgtctgaaatcttgaatgatcaatgaatgtggctaatcctatgctatgccactgcttaatttatagcttggttgactggttgtatggcttggcagtttctagaagatgagcagtccaccgaaagatagtgggccaataataatggtatggctaataataaaggtggaatggcttggcatgcatgtaaacatgcaggaaccggtagagtgacatggcccaagaaaatttggacttaaaaagacattcttgctgcacgctagaaagtaaacatcttggacatcaattttagatctaatggctagattaatttgaagtgatgtggcaagctgtgaaaagagaaaattagcactagttgcacttagtgagaatgaaccatatagatatataaaattaatgcccttctcgattaattccttcataaaaagttaagaaggatttagagaggattacttaatctccaacattccttccggccttcacataagaattaaccgaacaagctttttttttctaaggcgtggaagaactctttttcaaaagaattttcaagcggatcaagaggatgttttgagaatgaaaagatcgaatgctaattttaaataggacctctcatgttctttttatagagcatgcatgtgtcatacgttcaaaacacgtcaattataaaaaaaaaaaaagaggtggtacactttaactgtatgatttagtgcaagcgcaacaataatgttcagatgatgatgtaatgctgtccgttcttaaactgcaagatttgcagacacttctttgccgactaatctcaaagacaatataagtatttattgatcaccgcttttcatcgaatcaatcactagctagtaacacaccgacacaggtggggcctggcccacgtggggagagccggagagagaccagcaccgcgtctagcttccacgtgcttatttttaaaagacaaaaatacaaatccatgtactcgcacactcgttagtataaatgcacgcgcgtactttatttttataagcaccttcaaaatacttaccggtactccctgttttaggttataacttcaaatttaactaaatttatagaaaaacagaaatattttcaactaaaaataaatttattataaaaatatatttaattattaatttaataaaactaatttggtaatgtaaatattacaatattaaatcttgagttgaaaatatttctattttttctataaacttggttaaactttaaatagtttgactttaaccaaagtcaaaatatcttataatctaaaacggagtatacctttagattgatgaagtcgtcattgatgtcacactatcgacgagtatattatatatcactgaaagatgaattagtcgtaaatgtgaacatatcaagtctagaatttgaattcggatcaactgattccacttcgcaacatccatgtgcttttgaattccacgtgaaggagaaaaagggtttgaaatattggacttttgcaaatttatcttctaaaaagacttcagattccgttgattaattatgtttgaaacgagaagttctggggagttaaaactgctaactggcatggttcagaactgagtcaagcacaccacaacatcgaccagagcaagaattccgaattccacgtttcgaaaatttcttaaaactgatcaaatcaattccactataagtttataattcgctgaatcgtgagcctcttttctcctctttccatccccctccttttcccttcctacttccaggctccagcagaccagcacgcctcttctcctcttctcttcacacaacgtcattgtgttagcagagtcactgtcagcaataggaggcacacgactattatcctccctcttacgtattgttcatggttatggcgtcgcagagtctacaccagatattgtgcatgcaagtacatatatgtgtaatgaggtgacagtcatcgatcaaaattgaaaagcagattattcatggaattattgtcatgagttttctacttgattataaaaataaattgaataatttgagaattaaacttaaataataatttataataggtaggataggaagtaggagtacacatcatcaaaagttacatagcttatcatttagacacgtacatacgagacaaacatactatttataagtgtaaacaactataagacagttgacaaaggcacacggacagtaggaataaggtaaagatcgttctttcttcgaattgtagcacccaactcctccatcatgtccaccttggttggcgagatgccatcagggagctcccaatcaaagtggtaaagcaatgaggctagagcgagctccatgattacttctgcaaatgccatgccagggcacatccttcgtccagctccaaacggtataaattcaaagtttgttcctttgaagtctatatggccatcctcaaatcgttcaggtatgaatgtctcagcatcctcccaatacttaggatctctacctattgcccatacgttaacaagcacagtagtacctatggggatatcgtaacccatgacctcacatgtctcccgacattccctagggagaagtagtggcactacaggatgtaaccttaaggtctctttgataataagttttaagtacttcaattcaactaagtcatcttcagatatcgtttgctttcctttgatgacgttacttaactcagcttgtgccttcagcatcactcttggattcattatgagctcagtcatcgcccattgaagtgtattagctgatgtctcgctcccagcaccaaaaagttcctatatgcatgaaaaaaaacatgatttcccatatatgtaaaaaaatatgttatcaattacttccttcctttgttcagtgtgcatactttttttttattttcatatatactcgctccattcatcagttaaagttatttaattttattcttaaacggtaaaactttgtagattttgacattaacagtagtcaaattttaagtgcactcaggtaaaagaggtttggtaaaatatgtcttatatttcatcctttcacgaatataatggattatagatccagaaagtgtgattgaaccttcactaaattagggaagagaacgtacgttagggtacgattgtagatacgattgaaaaattaattattggtaagataaatactactctaagctcagaagtattcgtgtgcaattaagggagattagtacagtattaatcagcaagtacttgtctacttaccaggacgacggctttgatattgcccatggtgagaggcatctggaggctcccatccttctgaaccctgagaagcacatcgacgaggtcctcgtcgtcgtccacggcgccggcggccctccgctcctcgtgctgcctcagagcgcactctatcagctcgaagttcttgcggggttcgcctccgcccgccgcgtcgtgccgccgacgaagctggccagcctcgacgacgggaacaggtcgccgaggctgaacccggaggtgatcttgatcgcctcggcgagacccttcaggaactcgtcccgcctctcgaaccggtcgccgatgatggtgcgcaccgccgagtcggagatgagcgccgcgatccgctcgctgacgttcacgggctgcgccgccggggcggcggcgacggcggcaacaaggcggccgaccttcgtctcccggatgcggcggaacgactggacgcggcgcgcgctgaggagctccaccacggcgatcttgcggagctgccgccacagcgcgccgtagggcgcgaacaccagcccaacgccgtcgctcatcaggacgcggatggtggaggtccacggccgcgtcgcgaacgcgacgtcgtgcgtcttggtgatctccctggcggcgttggcggatgaggcgacgacgacgcggagctcgccgagcctgagcgacatgagcggcgcgtccagccggcgcgccaggtcggccatggtgcggtggacgagcgggccgcccatcgcgacctggtggaggttgccgatgaccggcagccgccacggccccggcggaagcctcggcttgccggcgccattaccggtcgccttcctcgccaccttgtggaggacgagagtgagcaagaggagagccaaggagaggcacaggtagccggtgatgtcttgcaccatggccatggtttgagctgtcgagcacttcatggaaatggtataaatagggagaagttcttttattttgggggggaacataaatagagagaagttgattcatttattatttgttgtctggctgctatctctagtttgaaaacataggcaagagaaataattgcaaaatgaaaggcgcatagcgatttggaattttggactaccatcccattggcattaatacagcttgcagttattagtcaaatattggctgtggagttcagagcatgaatagtgattgtaggcaactttcgcagttaagttcagagcataaatactgtgatttagacgactattatctgtataatcattttaattacaacttataggcctcatctttttgcgtatgcttatgcttatcaaccaaaatttcaaatttcaatattaaatatagagtttattttagggatttttcatcgtagtttatttttcagcctttgcttttagatcgttaagaacatgtatatataagttttattcacaaattacttttcatttgcaaatatgtcatatggcttattccacaaataagcgaaacaacggggctcaataacatacagagaccacccatatataacagattatctaatcagatatctcaaatatattcgtatattcaatgacttaattatacggaaaactggttttatctcctcgttttttcatgtcacctatagttgtaaataaaaaattgataagataggttaatatgagatatatcaccatgcaaacatgcaagttttcgacttctacaagttataacaaactaggaaggtggcccgcgcagcacttgtattatttgaaaggtaagatttttactgtttgtttaaaaattttgtctgatagattaagggcaaactaaagtttagatactgttattttataataatttaagggttctattttcttaaggtatctttaaaatccattcataaacttttgagtaggagattgattaagtacttacgatttttgaatcatgttctttttctcgagtaaataataaactattgcttgtagtatggctacaaatgaaaaagtgagagcaagatacttaaaattcttgtgattaaatcgtctcatgaaggtgcatgatacaataagaaagggagggaagcgtatacatggagaaaaagaagaaagggaaaaatggaaaaaagggaggggaagcgtaggtacccacgtacgtaggtgcgtaccgaaggtggagaggtggaacctcgtagtatttggtttgttctaagatcaatttaatctaatggtttataatattggacccatcgattaagtgaaaatcaagtaatagatactttgctttttttcttataatttctaatattttagagcatcacgtggcagcttgagggcattttaagaaattttaatggacttaccacatgtaattataatattaaccatgtaatatatatgtatgggatatatgttaatattcattctagcttcgtccatgtttatatatagtcatatttacaattatttatagtagctcttacatattcatcttacgactttgattatgcgttgatcaccaatttactgatcatcatgactcgcatgaaaaaattataattatgtactacttagggtttagggtttaggacaacttaaattgatgaattatcttatttatgtgatagctatttgagattataaacgaatgaattaacttctaaaaagttaaaaagatgtttaagaaaagcaccatttacgaacttggaaagcgtggagcgtgcaaacgaaaatccaaaagatggaatcagggaaaaaatagcgccttaaactcccttataacactcttatcctagtaagagttctattgatattcgttaatattgtgctcacatttgtaacataatgatttctttcaattgtacaaacaaataatacaaaatctgaatacaacataacacaatacattataattattatgtaatcaactatcgatttcggcttaaacagagctaagtgttaacacggtgcttaattcttctctcactgcatcacacatttaattttcttttcatgttattaacannnnnnnnnnnnnnnnnnnnnnnnnnnnnnnnnnnnnnnnnatgcctcaaacatgacgctttgtcacacatgcgaaaggaaaaggtgtagacgtgcattatgcagcaggccaaaaagagaactttagacactttagttattaataatagatccgatgatttaaataatgggtcgtacttgttctagtataaatataaattagttaatctatattttaaattgttaatttaatgggtacacaatataacggtgtaaactttattttaaaacaatgtattatttgagaataatagtccaaagtaattataaaaatagatccaatgatttaaataatgggtctatctgtttaagtgcatgtatatattagttaatatagatcttaaattgtttatttgataggtacacaatataattgtgtaaattttattttaaaatagtgcattatttaaaaataatagtacaaagtaattagtacaccggtttaagtggaaactatcttacattattgatttaatgggtaaacatataatatggtgtaaattttattttcaaatattatagagctaatttagttacctgtgtttataaagagttatataatggtatattctttgtttataaaattatcaattgtataaatggaaaaaagtagtaaaaaaaggaaacaaaagggagggaggcgtacgtactacatacccgtacgtgacctacctatgcacgtataaagaggagaggtgggacccatagtattttgtttgttttaagatcaattttatctaacggtgtataatattggacccaccaatttaagtgaaaatgaaggggtagatgttttgtttttttttagaatttctaggattttctttaatttatcatagcgccacgtggcagaaggaagtttaatggacttttagtatataataacataaatgtgagtttatgttaaataaattcagtttaatttgtttccgtaaaaataacatacagtatcatgcaatttatgataactactgccatttgatctgcggcctacactactgttgaccccagcaagataaattgcatctgtccttactaatccattggaatcactggtggagaagtgctttttagtcccggttcgtaacccccctgtagtcccggtttttaaaccgggactaccaatccgggactaaagatcgttatctttagtcccggttcaaatgcccgggactaaagatcgatctttagtcccggttggtgttaccaaccgggactaaagagannnnnnnnnnnnnnnnnnnnnnnnnnnnnnnnnnnnnnnnnnnnnnnnnnnnnnnnnnnnn

SEQ ID NO: 27772 - DNA, 13716 bp, Oryza sativa
  unsure (1)..(13716): unsure at all n locations
nnnnnnnnnnnnnnnnnnnnnnnnnnnnnnnnnnnnnnnnnnnnnnnnnnnnnnnnnnnnnnnnnnntttcgggcgaccgaccaaagacggtttcttcaccagtgaatgcatccgctagctagtaaatgtgctgttatttagaacagttaaccaatggttatgtactattgttagcgatttgagttgcaatttgcaactcccgtatgatcactccaacaagcacaacacccatgctgatgacgatagcacagcaatataccttctttgtctcaaaatataaaagattttaaacagatgagacaactttcaggacatcaatatactatctatctagattcatagtctagaaagtatctcatccgttcaaaaatacttatattttagtacggtcgtagtagtaattattatgcagcagaggcagctggaatttttggctatctatgacaaagctgacctttgaaaattgcaaacttcaagtcaaaccattaatgcaatacttaatgtatggctcgctttaactgcaaagctgactactgaactcacggtgaaaattggcaattttttaattcatggctgaattagtgccagattgccagttagagtgataaatagttaaatatctcacaacaacctggacgtacggtgtcgctgatgaagaacaaattgcagcaggacgtgtcttcaccagcgagaagcacataaaaaggataattctaaatacattgggctaaactaggccaagtacgtaattgtaagccgatttgacccattgagagtgatccgtagaaagatatgagcttggaaacatatatagtataactgtatgtgtgtggagattttcagacataagtgatttacactacatattcacttgcttttgaattattgcacgaggtggagaaataagtcttcaagagtatgggagttttgccaatatactcacttcaaaaaaaaaaaactccaaattctgttagtcatgcttgaaacataaatttttcggtgtcaaaactgccaaactagcatggtccagagctgaattgtccacactacactaaaacctagaaccaagccaaaattccaaattccatgttccaagttcatattcataaaatcgatcaaatttcactatgattgctgaatagcgagcctcttttctcctgttccctctcctccccttccttcatcccttcttacctccaggctttggtagagctttcaaaaaagctcgagttcggctcgactcagactcgattcgagctcggctcgtctcagactcgattcgagctcagctcgagctcttaacgagccgagcctaagtccagccccaaactcgtgagatttgtcgagccgagctcgagcttctcacgagtatagatgtacgttttatttttatgttctatataacaagatagtaggtaaatgataatttaatctacattcatgtgaaaaattagtatgttttggtgtcatatcacaatcttatgtgatccttggccctagcttgcattgaaccgggtcacccatgatggtgcgcagtctgagatgaacaccgcgatccgctcgctgacgacgttcacgggctgcgtcgccgcgccggcgatagcgacgatgagactggacgcggcgcgcgctgagcagctccaccatggcgatcttgcggagctgccgccacagcgcgccgtagggcgcgaacactagccccaatcagcccccaacccgtcggccatcaagacccggacggtggagctccacggccgcgtcgcgaacttgacgtcgtgcgtcttggtgaactccctgcaggcggcgtcggtggacgaggcgacgacgcgcgacgcggagttcgccgattgagcctgagtgacatcagcggcgcgtatgtccagccggcgtgccaggtcggccatggtgctgtaacaccctgaaaattcgacgaacaaaaatcaaagtttcaaaaatatgggccttcaaaaactttttaaataaaattgcatcatgccgattttgttcgattattttattagattttgatttcagagtttataaatcgcgaataatggataattagttaggaataaaccctaaaaagtaaattgactaagtaaataattaaagtgcaatttaaaataatatttggtgaggatagaaatgagtaaaatattattacgactatatttgtatcaattaaatttaaaagtgtcggaataagaattaactctaattaaattcaagaaaattatataaaaataaaatataggtaaaattaatcaaggatggacccattggttggaataacacaaatattgagtgaacttcatttgtacaaaatttaggtttatagaatcaattttaaataaatgaataggcttaaatcgggttaaatagaaaacggcactattcggtagccagccaggtgttcgacgaggttccctagcctaaccctgccccgctgccgcgccgacgccgcgcccgcgccccacacctcacgccgcgcaccgccgctaccgctgtcgccgtcggccgtcgccgtcgccgctcgcccgtcacgtcgccatctcgcgccccgccgcgccgtacgcctgccgcgccgtcccgtcgtctcgcgccccgcgccgcgcgccgtcgccatcgccgtcgcatcgccgcgcgccgtcgccatcgctcgcacgtcgccgtcgctgtcgcgtcgccatgcgccccgcgccgcgccgcgcgccgccgctgccgctcgcccgtcgcgtcgctcgcgccacgcagccgtcgcgtcgcctcgcgccgcgcgcccccacctcgcgccccgcgccgccgtcgcgtctcccctctcccctctcccccttatctcttcccctctcctatataaactccactattcccactctttccctccatcctcacctcctctcctctacccactccaccacgccgccgcctccacgccgccgcgccgccgcctccacgccgccgcgtcgtcgcatagagccgccacgccgccgccacgaagccgccgcgccgcgccgcgccttggccgtgccgcgttccccgccgccgtcgcagccgccgtgcgccaccgccgtcgcagccaccgtgcgccgccaccattgccgttgccgccggtaagccgtgccgccgccgcctttttccttttcctcagccggtctcggtaggcagggcgagagagagagggagaaggagccgaaagagaagagaggaagagaaggaaaagaaagaaaggagccgggaggagagaagagagagaaaaagaaagagaggagaggaaaaagagagaaaagaaaagagaagggaaagaagaaaaaaaaggggaaaaagaaaaggaaaggaagagaaagaaaataaatagggtttgagtaaaatttagaagtttagaaaattcaaaatagttaagaatttaatcgtaggttaattatagtcgtaaaattgcgaaagttaattataggattaatgaaaatatagttagatgaattcttactaattaaatacctaaaatactagcatttaattataggattaatgaaaatataattggatgaactcctatagattataatctatagattatttttagtaatctccctaagaaatcaagttcgcgataataatttacatatgattaagaactcaataattcgatgagtcttaggacatgactataacttacaaaatatcttaggaagaagaacaattccacttcgcgaataaagtagcctatataaaattcacctcccgcgctcgtttttcaatacggtcattatgtggattttgtttgaattctgatcgaattcaaattgttcttacgcatgtaactatagagaccgagggagccgcggatccgggtgaaggccaaggcccacaagacctagagcaaggcaagtcatcactattccttgaacatattaatcccaattgcgaaattgttttgtttacaaataaaattgcatgcagttatgaacatcctacttgtgattatgccatgccttgattattgtttacccttaaatccttgtaactatgatttacgtataagtccttagtcaactatgacaaatgcttagaaatgctactctagatttatgcatactcatatttatcaaatgctatatgcttgggcaattacctttgggaaggtaattgagatgcggcatgtggagacatgagcgccacattgccatgatattgatgacataatttgtgaaaggaaaataaaactaaacaaatgttttcgactggggcggatggaggatttgggtgatgtccggaaaaggctagtgccgtccctggtcagttaaggaccgagccatgaagttaagaatgaaacgatcccccgtacaaccgcacttctcatatgggtatagacctagcggagtagatagctgagcggaggcagtatccatgcgtagtggtcttcttttaggtgtgtgatgcggcaagcagtctgctggcggatgcccggttcagatggccaggtggatggtggatgcccgttccggatggtcagagactggcttggcaatactacatgaggatacccataagagaacaatcatgatggactgggtacaacgacaggaagcaacgtaggagtgcatgtgtttttcctttcccgggtgcgccagaactcctctcactgctagaaatcgtgtacgcctagagtgcatgaggatataaagttcatggagcgggtactgccaatgcgaggttatcgaaaagctttgccgtgacacgtctcatgtgttgggacgaggctcatgtgttgggcagtcgcggagtgcgggtaaagtgtacatccactgaagtgtgagtaaaccaaatctattcgaatagtcgtgctcgcggttattgagcatcgggacatgtattacacttggctagtctctaaattcttaacttgtgtgggatgggttgttgcatgacgaatttttatgctgttggagccacttcctgagaagggggaaggtgggcatcctcagaaaaccataacaactcaatggcgggaagctatccttgggatcacaatggatggtggacagaaccatcgttgtttaaatacaaacactggtactaaaatttgatcagtcaatgctaggtctgaggcttgtaaaaagaattacaaaacttgctttgcgcaaaagaaccatagctatcctttgaaataccctttcatatgcattgttgctgtggtggcttgctgagtacggttggtactcacccttgcgaatataaaattaatcagaagcgggagacgaagctccggaggatccctatgcctactaccaggagggagatgaagacgatgtcgcccagtaggtcttagtacggtcgttgcctgtggcaatggcatgccgctgcctaaaatccgctgtcttatctaattctgcttttggttgtattccggaccgctcggtccgatgatttaagacaatgcctgcgggcttatgttgtaataattcacactagactctcgtgtatgagtatttggtatttcagctatgagctcatgtgtaccagactacttgattcagagaaatggtactgtttacacgattgattcctgttataaaaacgagggtccacaggtgcccatcatgagctggtggaagttgccgatcgttgaccggcagccgccacggccccggcggaagcctcggctggccggcgccactacaaccgctcgccttcctcgatcgccaccaccttgtggagcacgagagtgagcaggacgagagccagggagaggcaaacgtagccggtgacgtcttgcatttgcaccacggccatggcgatctatgagtgttatatatggaggccaacaagaaatgttatatatagagaaagaatggagtggattctaacttctttaagggatgtcccctcgttacttttttttcttccaaatccaatgtaaatggtagtgaaaaatctgaaaaacattaacaatgttagtatagggatatatatcagcgacggaaatctaagtttaaattcgacctacacatttagaataaaaaataaatttgggtgtgaataatgatttaaaaaatttacgctgttagtgtagacgatttgagaatttttctttgttgtttggatggtttataaatagacaagtggacatccgctcgagatatcaaaatactagtttccatagagaagttcattcattcatgtaagtgaaaaaaaaagtcaggtacagtgcggctatccctattttgaaaagataggcaagagaaattattgcaaaatgagagggacagcgcgactactttcgtaccggcactaatacaactatacacaattttatctgttaataatagttactccctccgttttatattacaaggcattcaactttttttagtcaaaattcttaaatttgaccaaatttaaaacaaaattataagtcctcttttctcatgtttgtcccacccctctccacctcatcccttccaactctcaggctccaacccgcctcttatcctcttctcttcacacaacgccattgtgtgttagcagagctactgccagcaataggaggcacgactattatcctcctttctccatattgttcatggttatggcatcccagagtctacaccagatattgtgcgtgcaagtacatgtatatgtgtaatgaggtgaccgccatcaaaattgacaagctaggaggactttagcatttaaaacatattatttatcaaattattgtcacgagttaaactcttgatcatatatataaattaaatagtttaataactaaatttaaagtaataatgtagaacgagtaggatgcaaagtaggagtacatcaatccatcaaaagttatatagtttatcatataggcgcgtacagatgagacaaatattttgtctcttaagtgtaaacagctatagggcagtcgacataggcacacgaacagttggaacgagataaagatcattcttttttcgaatagttgcacccaactcctccatcatgtccaccttggtcggcgagatcccatcaggaagctcccaatcaaagtgatagagaagcgaggctagaacgagctccatgattgcttctgcaaatgccataccagggcacatccttcgcccagctccaaacggtataaattcaaaatctgttcctttgaagtctatatgtccatcctcaaatcgctcgggtctaaatgtctcagcgtcctcccaatacttagggtctctaccgattgcccacacgttaacaagcatagtagtacctatggggatatcgtaccccatgacctcacatgtctcccgacattccctagggagaagtagtggcaccacaggatgtaaccttaaggtctctttgataacaagttttaagtacctcagttcaactaagtcatcttcagatattgtttgctttcctttgatgacgttacttaactcatcttgtgccttcagcatcacttttggattcattatgagctcagtcatcgcccaatgaagtgtacttgctgatgtctcgctcccagcaccaaaaagttcctatatgcatggaaaaaacatgatttcccatatacgtaaaaaacaatatcttatcaattactttctttgttcagtgtgcatacctttttttttattttcatatgctcccccattcatcagttaaggttatttaattttattattaaaggtaaaactttatagatttttacattaacagtagtaaaattttaagtgcactcaggtaaaaggggtttggtaaaatatgtcttatattccatccgttcacgaatatagggattatagatccagaaagtgattggtgatacgattgaaaaataaatgattgataagacaaaaagtactttaaactcattaatatttttggacaagtcaaaagggcttaaaattatctgtatttgtgaacagatggagtagttattaaggttgtactattttgcaaccaattaaaagttaaagctttggtgtcgaagatgttaaaattgaataaaataagtcctatcaaaattaagggagataatactattatcattatccatagggaaaaggatggtcctagtacgcgatcgctcgctggagggagggttaagcgataaaaaaaaactatcagcacccgcgtccctccccgcacacgtctcccctttctaccacactatcaattttaaaccatttaaaaaatataaaaagaaatctaatacacttgaaaaatatattcatgtgaataaactttatacttacaaattcgaattcgaatttgaaccgggtatataaacttttaacctataaactttgggtatacaaactttagatgtgtaaacctgatgaaatttcatacatataaactttatgtatagaaatattctatataaaaaaatatttgaatccaaattaatttgaacaggctatttaaacttttaacttataaactttgggtatacaaactttagatgtataaacttgatgaaattccgtacatatagactttatgtatagaaatattatatatatatatatatataaatatatttgaatccaaatttgaattcaaatttgaaccgggtatataaacttttaacctataaactttggaatgtataaactttgggtatataaattttagttgtgtaaatttgatgtgtaccacctttagttatataaacttactaaaaacagaaaagtaatgcgagtgaaaaaaaaaaaggatcatggggaacgggctgatcgccgcgcgtcaccattcggtaacagaaaaaaaacagccaaaaaagcgacggaaaaaacaaagatctcgagcacaggagtctggcaaaaatggaaaggtaacggcaagaaaaaaaaccgatggcctcgccgagatttcagcgaccgatcgcgtattagtgatttcgcaggggaaaaggggaagaggtgaagaacaagtacttgtcaacttacaaggataacggctttgatattgcccatggtgaggggcacttggaggctcccttccttctgaaccctgagaagcacatcgacgaggtcctcgtcgtcgtccacggcgccggcggccctccgctcctcgtgctgcctgagagcgcactctatcagcccgaagttcttgcggtggttcgcctccgcccgccgcgtcgtgccgccgacgaagctggccagcctcgacgacgggaacaggtcgccgaggctgaacccggaggctatcctgtccccctcggcgagaccctccaggaattcgtcccgcttctcgaacctgtcgcccatgatggtgcgcaccgccgagtcggagatgagcgccgtgatccgctcgctgacgttcacggcctcgccgggctgcgccgcggcgacggcggcgacgaggcggcagacctcgtcctcccggatgcggcggaacgactggacgcggcgcgcgctgaggagctccaccacggcgatcttgcggagctgccgccacagcgcgccgtagggcgcgaacaccagcccgacgccgtcgctcatcatgacgcggatggtggagctccacggccgcgtcgcgaacgcgacgtcgtgcgtcttggtgatctccctggcagcgtcggcggacgaggcgacgacgacgcgaagctcgccgagcctgagcgacatgagcggcgcgtcgtgccggcgcgccaggtcggccatggtgcggtggacgagcgggccgcccatcgcgacctggtggaggttgccgatgaccggcagccgccacggccccggcggaagcctcggcttgccggcgccattaccggtcgccttcctcgccaccttgtggaggacgagagtgagcaagaggagagccaaggagaggcacaggtagccggtgacgtattgcaccatggccatgggtgtgagttgtcgagcacttcatggaaatggtataaatagacagaagttgattcatttattatttgttgtctagcacaaaaataattgcaaaatgaaaacataggcaagagaaataattgcaaattgaaaggcgcaaagcgatttggaggtttggacattaatacagcttggctgtggtgtgatttccgctgccttcttattagcattaacgtgcaggaatcatcagccttataactctttggactaagctttttagtgtgctacttttgtaataatggactatagctcttgtgagcaaaggccgggatgtttcataccattattaaaaaaaagagaaaaaactctcttatttgctggccaatagcaatcgtgtagttgccttactatatttatactacactgaaaaatgtatatgtcacaatgatttgtaaaagctgatcgatatgcggcactactatgcaaaacaaatgaaaattactaattagcacaaattatgattttgatgatccttactgatgaattagatttgaaatgtagagaaaatgttgttctgatttctgaaacaaaagccaacgggccaattagaggtactgaggtaggttgttggtatatacgtatacgtatacgtatgtactcatcaattcagcatccaataattagtttgttcacaacagttcaatagaatcaccactcaaggagcatcctgccaacaaagttaaacatgtgtttggcgtgcttgcattttgaaatacggtgttaaatatgtagtactgctgttaggagcgcagcacgttccttagcatttcgagcaccaaacatgtattagtctaagcctacctcactccacgtcctgtcatcccgctcccatcgctcccatcgttatcggagtaaatgatttacttcgataataaaaacaactttcctacttccgatcccaccccacgtcccatcatcctgctcccactattatcggagtaaatgatttacttcgataaaaacaacttcccagattccagtatatattctatttttcccgtacccaaccaaccactctcgcccccactttattttttcctctttttttttgggatatgcatcgatccatcatcccagcccacagatcggtgacgcaccatggaggaggacgacgacaggcgatggccggcgagcggtggccggtggcggttgatgcgaaggcgctgcttcgggcctcgctgccgtacgtcgagcaacaccttaactagtaaagaggcgttcacctaggtcaagagcaacaatcggcggctgctccacgtcggcgacattgacagaacaagcacgtaaggaaatagcactccgatttgcatctgcatactctagtttaccttcacgcatgaagccccaatttttttttgcaaatcagattaacgtgcaatctccaatattacttgatctgaattgatgggctgcataggtcctacatttgcacatcatgctccatgtggttcgccgcagaggatagggtggagtttgccgatgatggaggttttttgctatttttcttttgctcgtcgtctctataacatgaacgagaatgttcttgcatttttttcgtgcttgctagatgatggatggctgctactgcgcaatgtcgagcccatctctataccatgccgctacacccttctattattccatcatcgactaccgctcgccatctggttgccctctccactacctgtcacaagacacagaccggcatctccatccttatagcaagatccaagaaagccaccagaatcctagtttcacgatggatttttggttgaatcattttttttcttttctagtttgattcacttgtgagtaatttttatcatttgtatgtgattgagcctgtaattttttttattcgtacggtcattttgtgatatagattaacaatacttttagtatcattttttactcttataccgtgtattgaatacatcagtaaacatattactatatggttgctacgagatcatgagctatatcgagagaaaagtagtaattgttttactcgcagaccacgaagtctcagcttttactcttatacagtgtactgaacatatcagtaaacatattactacatagtagctacgagatcatgggctatatcgagaggaaggtggtaattgttttactcgcagaccacgaaatctaaacaatatttataacactagtaaaagaattactagtgttttaagcaggtagtagttcttttacgaccatctaggaatggtgtcgcacgatatggggacattcatgcaagtaaaaagtaagggcattcatgcgagtaaatttgttattttagaaggagcagatgtggaaggctaggagtaaatggaaaactccacggagtaaattcgttacttttgaaacgtggggagacactagaaaaacagaaaactggaaaagaaaaactagatgataaatattttactaaaacgcgaaacaaaataactggagagaaggaaccaaaaacaaaaaaaatctggatgtttaatattttaccgggccctttgatgaagcacggataagatggaaaagagaaaaaagaaccacggaagatagggtggtaaaaaaacgaaaaaaataaactgatgaaaggtgggatgcggagtaaaggtgggtggtaaaaaacgaaaaaactggaaggagggagcgctgtgtggcgctcgatctaatattccgtgtgcagcgcgtggattagcgctaccgttagttatatgtgcttagttgtaaaaaaatcgggtgccgattttttagtattcaagcacatgcaaccttttaattaggaatgttgtggagttcagagcatgaatagtgattgtatgaaattttcgcagttgagttcagagcataaatactgtgatttagacgaatattatctgtataatcattttaattacaacttataacatacagagaccacccatacataacatattatctatttagctatctcaaacatattcgtatattcgatgacttaattctacagaaaagtgtttttatcttctcgtttttttcatgtcacctaaatagttgtaaataaaaaaatgataagataagttgatatgagatatatcactatgcaaattaacatgcaagttttccacttctacatgttataacaaatatatcaaacataaaaatgagtttatattaactagatacggtttaatttgtttctctaaaaatagcatatcatgcaatttatgataactaccatttgatttggggcctacactactgttgaccccagcaagatacattgcgtctgtccttactaatccattggaatgcatccactagctagtaaatgtgctgttatttagaacagttaagcaatggttctgtactattgttaacgatttgagttgcaatttgcaactcctgtatgatcactccaacaagcacaacacccatgctgatgatgctggcacagcaatatacttcctttatcttaaaatataaaagattttgaacagatgagacactttctagaaatacaatatatactctatgtctagattcatagtctgaaaagtatctcatcggttcaaaattacttatattttattttagtacggatgaagtagtaattgtgatgcagcagaggcagccggaatttctggctatctatgacaaagctgacctttgcaaattgcaaattgcaattcaaacacattaatgcatggttcacgataactgcaaagttgactactgaactcacggtgaaaattggcaattttttaattcatggctgaannnnnnnnnnnnnnnnnnnnnnnnnnnnnnnnnnnnnnnnnnnnnnnnnnnnnnnnnnnnnnn

SEQ ID NO: 27773 - DNA, 1363 bp, Oryza sativa
agaagctccaccacggcgatcttgcggagctgccgccacagcgcgccgtagggcgcgaacaccagcccgacgccgtcgctcatcatgacgcggatggtggagctccacggccgcgtcgcgaacgcgacgtcgtgcgtcttggtgatctccctggcagcgtcggcggacgaggcgacgacgacgcgaagctcgccgagcctgagcgacatgagcggcgcgtcgtgccggcgcgccaggtcggccatggtgcggtggacgagcgggccgcccatcgcgacctggtggaggttgccgatgaccggcagccgccacggccccggcggaagcctcggcttgccggcgccattaccggtcgccttcctcgccaccttgtggaggacgagagtgagcaagaggagagccaaggagaggcacaggtagccggtgacgtattgcaccatggccatgggtgtgagttgtcgagcacttcatggaaatggtataaatagacagaagttgattcatttattatttgttgtctagcacaaaaataattgcaaaatgaaaacataggcaagagaaataattgcaaattgaaaggcgcaaagcgatttggaggtttggacattaatacagcttggctgtggtgtgatttccgctgccttcttattagcattaacgtgcaggaatcatcagccttataactctttggactaagctttttagtgtgctacttttgtaataatggactatagctcttgtgagcaaaggccgggatgtttcataccattattaaaaaaaagagaaaaaactctcttatttgctggccaatagcaatcgtgtagttgccttactatatttatactacactgaaaaatgtatatgtcacaatgatttgtaaaagctgatcgatatgcggcactactatgcaaaacaaatgaaaattactaattagcacaaattatgattttgatgatccttactgatgaattagatttgaaatgtagagaaaatgttgttctgatttctgaaacaaaagccaacgggccaattagaggtactgaggtaggttgttggtatatacgtatacgtatacgtatgtactcatcaattcagcatccaataattagtttgttcacaacagttcaatagaatcaccactcaaggagcatcctgccaacaaagttaaacatgtgtttggcgtgcttgcattttgaaatacggtgttaaatatgtagtactgctgttaggagcgcagcacgttccttagcatttcgagcaccaaacatgtattagtctaagcctacctcactccacgtcctgtcatcccgctcccatcgctcccatcgttatcggagtaaatgatttacttcgataataaaaa

SEQ ID NO: 27774 - DNA, 603 bp, Oryza sativa
actatagggcgaattcgagctcggtaccccgcatatgtagcagtagacaagtagcatctgcatctgcgtgccatacacgattgctccagctagctgcacctgcacatcgccatggccatggccgacctggagttggagaaggttgcgagcttcttgctggcggcgctgctgccgctcgtgctcttcaagctggcggcggcgaagcgcggtggtggcgatggcggcatgaggctgccgcctgggccgtggcggctgccggtgatcggcaacctgcaccagatcatggcgggtggccagctcgtgcaccgcaccatggccggcctggcgagggggctcggcgacgcgccgctgctgtcgctcaggctcggcgaggtccccatcgtcgtggcctcgtcggccgacgccgcgagggagatcatgagcaggcacgacgccaagttcgccacacggccgtggagccccaccgtgcgggtccagatggtcgacggcgagggcctcgcgttcgcgccctacggcgcgctgtggcggcagctgcgcaagatcaccatggtggagctgctcacccgcgccgcgtcaggtcgttcccccgcgtgcgggaggagg

SEQ ID NO: 27775 - DNA, 1227 bp, Oryza sativa
  unsure (1)..(1227): unsure at all n locations
gcccatcaggtggtgcaggctcccgatgaccggcagccgccacggccccggcggaagcctcggccggccggcgccattgccgcgcgcccgccttgccaccctgagcagcaggagaggggccacgacgagagccaagaagatgctcaggtactcggcgacatcttgcgccatgggcgccatggccgtgcaagctaggtgttcgatcactttaaggccaagctggagtgtagaatttgtacttcatataaagaagctgaaacaatgccaaaaaaaagaacgaaaaaacaaacatacaatgcagtttttgatgctgaagccagcaatttccactatcagtggagtgagatcattacttggattaatcacccaaatctgctggatatgcattatctagaaatgcatcagcagatcagaagagacaattcaaggttgtactattgctgtcaccagcttcagttacaagtgcagcatccaagcttttctttttcttttctttttttttgaattagcatccagctttcgatcgtcatcaacacctgcaatttcagctctagccatttcacggcgggcccaaaaccaaagcaaaatggcccacgtgggcccaaaagaacagcccatttttccctgggcccaaagaagggcccggttgcgttctgtgggccccgaagaaggtcacgatgtggcccacagatttgtgttcagccgtgaacaataatgctcacggtctttccactgaattcagtagtcaactttacagctgtcatgtcaccagagtgtgctgatcaagtaatttactttatccgtcccaaaacataagatacattattataattattatattagacacgtcctaatacgataaatttgaacagacgtgctcagatttgtttctattcgattctatctttatattttagttatattatgtatagattttagaacagaggtagtacattttttttgtccgatacaaataatgacattactcatggtattattgcctactttaatcactccaactgaatgcattagcttgcagggcatcatgaacagacaattcaagaattctactaccgctgccatcagcttcggtagttcagttacaaagtgcaacagtaatcttccaggttgtctttgtcatcaatggcagcattttcggttacatnnnnnnnnnnnnnnnnnnnnnnnnnnnnnnnnnnnnnnnnnnnnnnnnnnnnnnnnnnnnnn

SEQ ID NO: 27776 - DNA, 398 bp, Oryza sativa
tgttcatggttatggcatcccagagtctacaccagatattgtgcgtgcaagtacatgtatatgtgtaatgaggtgaccgccatcaaaattgacaagctaggaggactttagcatttaaaacatattatttatcaaattattgtcacgagttaaactcttgatcatatatataaattaaatagtttaataactaaatttaaagtaataatgtagaacgagtaggatgcaaagtaggagtacatcaatccatcaaaagttatatagtttatcatataggcgcgtacagatgagacaaatattttgtctcttaagtgtaaacagctatagggcagtcgacataggcacacgaacagttggaacgagataaagatcattcttttttcgaatagttgcaccca

SEQ ID NO: 27777 - DNA, 302 bp, Oryza sativa
ctatagggcgaattcgagctcggtaccctaatgtctttaagaaataccaacagtgatggaaggaagaggtcgttggttgatcaacccctcccattgtcaccgccgatgccggatcctttctagctagggccacggccaacggatctgttgcctttcgtcaccgccaccagatttgcctcagacgacgaactccaacctccgccggtgccaccgccgcatcacagacctgcatcgactatgccgggggtcgagtgagaatgagagaatggatatgctgaaggtagaggaggagaggttgaaaa

SEQ ID NO: 27778 - DNA, 814 bp, Oryza sativa
  unsure (1)..(814): unsure at all n locations
nnnnnnnnnnnnnnnnnnnnnnnnnnnnnnnnnnnnnnnnnnnnnnnnnnnnnnnnnnnnncgcggcagaggtgcgtgggctgatcggtcataactcgaggtcaaacttcgctgacgatgccatgaaagacccaagccatgcacatcatcggttcagttcagatgatgagaatcttgaagattgcatgaatgaagaaaatgattcaggcctggtttagttctcaactttttcttcaaacttttaacttttccatcatatcgaaatttttctacacacataaacttttaacttttctatcacatcgttccaatttcaatcaaacttttaattttggtgtgaactaagcacaccctcagtgtgtgagtaattttgattgatgtactttgttgtgctcagtagatacggaatgcatacaaatttgtgtgcactgtacgtgcacgcgaccgccggaatccttccgcgcgcgagattagcgatagccagttaattagtttcatgcggttttgaaggtagaagtgctccaagatttgtgcacgccaggtgacagaatctcaataggtgtgccatacaatttttttttccgacgtacatatcctactagtctatcttctttttatatgatgacacagattttagataattaattgtttcttgaaatttactaaataatatactgcatagagctaacaaatagactgagaaaaaaatatctaaacctttataagtttcttaagtacatggcctatgttgtatgcctgcgtatttgtaagggactacctttctagtttagtctaaaaattttgaacggttttt

SEQ ID NO: 27779 - DNA, 657 bp, Oryza sativa
  unsure (1)..(657): unsure at all n locations
nnnnnnnnnnnnnnnnnnnnnnnnnnnnnnnnnnnnntgcaggaatcatcagccttataactctttggactaagctttttagtgtgctacttttgtaataatggactatagctcttgtgagcaaaggccgggatgtttcataccattattaaaaaaaagagaaaaaactctcttatttgctggccaatagcaatcgtgtagttgccttactatatttatactacactgaaaaatgtatatgtcacaatgatttgtaaaagctgatcgatatgcggcactactatgcaaaacaaatgaaaattactaattagcacaaattatgattttgatgatccttactgatgaattagatttgaaatgtagagaaaatgttgttctgatttctgaaacaaaagccaacgggccaattagaggtactgaggtaggttgttggtatatacgtatacgtatacgtatgtactcatcaattcagcatccaataattagtttgttcacaacagttcaatagaatcaccactcaaggagcatcctgccaacaaagttaaacatgtgtttggcgtgcttgcattttgaaatacggtgttaaatatgtagtactgctgttaggagcgcagcacgttccttagcatttcgagcaccaaacatgtattagtctaa

SEQ ID NO: 27780 - DNA, 629 bp, Oryza sativa
  unsure (1)..(629): unsure at all n locations
nnnnnnnnnnnnnnnnnnnnnnnnnnnnnnnnnnnnnnnncaaataacgaatagacttaataaacgaatataaatatgtagatcatttagaaataacatcaaaagaatctatatataaatcaatttggaatggagagagtactacgtagtatccgatagtgacaaccttacatggagcaaagcatgggccacctcgagatgactagcaccgggaattgaagcagtgagcccgtacctacctatctactactactatatgccactccaaatactcgcagaattaaacggtagtctttgtcacttaattggcgccgaagcctcatatatactacgtatgtgttaaccttgcgaagctgcaatgttgcacttgcactgcactcgcctcgccgcgatctgatcgccatggatcacgtcctcgcctgcgtcggcatcctcgtcgccttcacgccgctgttcctccttgccgtgctcccgctcaagctgacgaacggcggcgacggggtgaagctgccgcctggcccgtggcggctgccggtgatcgggagcatgcaccacctgatgggcgagagcctcgtncaccgcgccatggccgacctcgcgcgccggctcgacgcgccgctcatgtacct

SEQ ID NO: 27781 - DNA, 774 bp, Oryza sativa
  unsure (1)..(774): unsure at all n locations
nnnnnnnnnnnnnnnnnnnnnnnnnnnnnnnnnnnnnnnggggcgactttggaagaaccccttgcattaaagcggcacgccggcggcaagaaagcggcggccggggcggggcttgggcggggccggttccccggccggccggcggaacccggcgtgcgccacccgcggcgcaagcaccggggcgcggcaccattggccgtggcggccgtaaaccggcgccgcgccgcctttttccttttcctcagccggtctcggtaggcagggcgagagagagagggagaaggagccgaaagagaagagaggaagagaaggaaaagaaagaaaggagccgggaggagagaagagagagaaaaagaaagagaggagaggaaaaagagagaaaagaaaagagaagggaaagaagaaaaaaaaggggaaaaagaaaaggaaaggaagagaaagaaaataaatagggtttgagtaaaatttagaagtttagaaaattcaaaatagttaagaatttaatcgtaggttaattatagtcgtaaaattgcgaaagttaattataggattaatgaaaatatagttagatgaattcttactaattaaatacctaaaatactagcatttaattataggattaatgaaaatataattggatgaactcctatagattataatctatagattatttttagtaatctccctaagaaatcaagttcgcgataataatttacatatgattaagaactccataattcgatgagtcttaggacatggctaatacctaccaaa

SEQ ID NO: 27782 - DNA, 548 bp, Oryza sativa
  unsure (1)..(548): unsure at all n locations
nnnnnnnnnnnnnnnnnnnnnnnnnnnnnnnnnnnnnnnnnacataataattaatgcataagtaaaacctttaaaaattgtgttattagtaactaaaaatacaattctgaaaaagaaagtgccttaaaatatcttcaacttaaaatttaaattttagctttggttttagcttattagtgcaactgatggggcatgattcaccttttttaaattctatttttttattaaatttcgaccactaatcgtatatttaaatgatttaaatatggtattcttaaattcataaaccgataattaaatttttaaaaaaatacaaaaatgaaattcgaattggatggcatcttgcatattccatttctagcccatcatcctctcgtgcggtcgtgccaacgaagcaacccgcttggcgccacacaaacatacggcggcgacaccgagacactctcgccggccgtcgccgccgccgtctcctcccatggcgacggtcgccggacgattcggcttcccgccaccgctcccttttcatcgcctccgccggcgaccacctt

SEQ ID NO: 27783 - DNA, 11662 bp, Oryza sativa
  unsure (1)..(11662): unsure at all n locations
nnnnnnnnnnnnnnnnnnnnnnnnnnnnnnnnnnnnnnnnnnnnnnnnnnnnnnnnnnnctccaacctgcaacgcaggcgctatttcagctagaaaattgaattgccaattttcgcagtgagttcaattgtcaactttgcagttgttatcagctatctcggggaattagtatattgctgtgcttaccatgcatacacgtgttgcaatgaacacaaaaaaaatgtcagcggtatcaaggtttcaagttcatatattgttgtgtttcccaaacacacgcaacatctgattaagctctaatatctggtatagtcaaagaagaaaatatcattacttgaattaatcagtactacgtcttactactatttatgtagggggtgcatctacgaccccttctattattggtggtattataatggtacaaatatatatctactagttgatttttatgtgctttaaaaatattttatttaggattttactaggaataaattggtattgttaatctgtcagaggtgaccgtgcgttgcaacaggaaaaataaaaaattatgacaaacattggacgagtagacaaggtgtttaatttattcagatagataagacagttaatttattcaaaacagtctatttctattatagctctaacatcaattaagttcttttgtaaagaaaataaaacttaactttgtgtaaattaataaaccaatccttgccatccacaatgcattacccccatttgaagttgtagacttgtagttgtgcctcagtaggagcagattaagttttctttttagcaatatatttcttgagaaaacaattctgatatattgatgggatatcgatcaccgttctcgagacaaaagggaaactacctattttttaagttaaatctactccctatttttcggtgcaagacaaaagggaaactgttgaactaatatttttactccatccgtattttaatgtatgacgtcgttgactttttaatcaacgtttgactatttattttattcaaatttttttgtgcaaatatgaaaatatttatgccgtgcttaaaaaacatttgacgatgaataagacgaatggtcaaacattaaataaaaagtcaacggcgtcatatattaaaatataaagatagtattatttaaggtgccatacctgatgttcgaaatatgtgccccatgctgtcacctggaatggcacatggtgagggttgttcgagtattatcttcttttttttcatggcaactcgtgagagcttcgactacttggtgttgacttgacaggagtatataggtgtgcctgcagaatactaacttcatccaaaatattactacctataaaattttagggggtgtcctccctcccaaacatcctcttgaaacaacaatctaaatagtcaatacttgtttagattcgttgttttagagcaaggataataatatagcacatttcctactattagcctatactaaagttaacacatataatagattaactataaggttagctatgattttcttcttctatctctatctctcacttatacatttaatgttgttttggagcttgtgttaagccagctcttacatgagaaccaacatctttctcttttatttacttctctcctctacataagtttatagtaggcttatagcttactattatacttgctcttggcatgtcggttttgtcggaccgtgcctctgattataggggccccacccaactcctgagattagcgatgtgattaacttaatagcacggagtcgagattagcggtgccgtagcgtagcgacgtctaccgagacgagcctgtgaccgcaacgagcttatgatcgagtatcgatccgcaccatccatccactcctctgcttctcctcgccaacaataaacaattttgatttgtttcaattaattctgtttttaccgtacatttaattttaagagggaatggacaatagtctcacatgtcagaattttggggagttgatgctggtgacaagccattccattctttaaaggagcatagatcggcagcagattttgtctagtcatatagtactgcggataattacaaaagggaagtgtcagcgcgatttggacggctctccaacgggcactaattaatttaaccagaaattggccaattttcaccgtgagtacgttcataacttcgccgttgtcgttatcaattatgtcaggccattacggtgttttgttgatataactaattataggctatttggtagcacgcgcgttccaatcagcacctagtatttttgttagcggtagttttttttttaaaagaaaattgtgagggtgttgaggtttgaaaatggatcacaaggttaaaacctcacatgttttgtcccttgcactatcaagtatatcttagtgtctttgtgttacgcaacatacaataatttgataacacttaaacctcatatcttttgtccttgcactgtcaagtacatctcagtttctttgtgttacgcaacatacaataatctgataacacttgggggcatttttttccaatctctctggcagtaagtcaatgcaaggcaacaagaaggtcattacgtggattaatcactctgtcttgacgtaggcaacagacgtctcttttactatgagcaattttactatagcttctaatattggcggcaatttgattctagaaaatcattgacttctgtgtgtattctgattttaacgatcactcctatatttttttccatatatattacacttctctgttttttaggtgcattcatatatatgaaactaattagtttttcttattcttgtgttttatgattcacctgttccatagtgtcctagatgagaacagtcgctgagttcgaaccagatattcagctaggatttttggcaacgtgtaaaacaagacaaactattagacatgattaattgagtacaattatttcatttttttcaaaaaaaaaacttctatatagtaaaacttgtgtacgtaacgcaccatttagcaagggagtagcaattggaaaacatactaacggagcaggagaaagtagccaccaccaaatagcagttcaaaactcagactagtgcttagtgcaccattttgtgaaacatgcttacttaaaaacgacttttacgttttacctcaacaaagtattcatgcgtttttatacagaaactgtagctaatatggcacgccggtttcttgatgcttgagaactccctatttccattgcactgataaaagtgaaatggtgttatttgtagcaatctaacctttgacagtaaacactgataaaagaaggaagatatctgaaatgtgaaaagtgacagtataattgtctaacattgttcatcctttttttatttgtgcagatcatcgttgagacttgagaccaggactgtacacacaccagcatatatggaggcttctttgaatatgacctttgcaaatgagaaaaagaatctccttgagaactctggtgagtgatgaatcagtgattctgcatctgcacgatgaacacaaacacttgtaggaagtgaaatgaacagtctactctgaaacctgactcgccggcgtgcctgcagatcgaccgttcgtcggcggtggagagcttcggcagcggcggcggcagggcctgaatgttcgccttcaacaatggcatggagcatcaggagagcacaggccgatttcaagagaggagatgaactgattgatcattaatcaagaaggaaacgagagagcaatacattacataattgtccagtaaagaatctgagctagctaccctcatggcttcagatgatggttaattaaaagtagttaagttaattgactactcattcatcagaaactctttggtagaaacagacagaaatcaaatcattctgaagacttgtttactgtccaactgcagattcgctgtcagttaattatcctgtcccaactccgatccaaggtcgttccgcttccacctttcatgaactaatctgttcatccaattctgcaatcgctattgttctttaccttttaccactaccgcattatatgttactgtacttcgaaggatggaaaaaaaatcccatttattagtgtgttatatgttggtgctgcggttcggtctccgagtactgttttgatggggtgggccggtgggcgacggcccaattgctgtggcatatacggcccaaatgcctcttggggtcggtgaagaatcaccgacccaaccgaaccgcatctcttctttcaagctcagagatttctttcacccgataatcgtcggcgagtgcaggtttcaccatggccatggcgtcgaggttggtaagctgtcgagcacttcagaagcttaaatccaaagcgaactactgaactagtcgttatgattctatcagtttctttaatgagtaaattacctttcacaacaaacgaaacaatacgatgggtagaaatagaatcataaccgggtctcagaacaacaaagtcaattgcttcagtataaggacttcgtttggttcaaaccgggtctcagaatcataaatgactgaccagcttgacgggaacatatcctatgcacacaagcttctcgtgcacaccaactagtaaatttcacagaaaattctagaaaaattaaacacatattttcaataatattattaaattgtgcacgagaaacttgtgtgtataggatatgttcccagcttgacatgtcaactttcacgtggtttgcatttgtttccatcggagattcggagttcatctctactttcaaaaaaccgttcaaaatttttagactaaactagaaaggtagtccctacaaatacgcaggcatacaacataggccatgtacttaagaaacttataaaggtttagatatttttttctcagtctatttgttagctctatgcagtatattatttagtaaatttcaagaaacaattaattatctaaaatctgtgtcatcatataaaaagaagatagactagtaggatatgtacgtcggaaaaaaaaattgtatggcacacctattgagattctgtcacctggcgtgcacaaatcttggagcacttctaccttcaaaaccgcatgaaactaattaactggctatcgctaatctcgcgcgcggaaggattccggcggtcgcgtgcacgtacagtgcacacaaatttgtatgcattccgtatctactgagcacaacaaagtacatcaatcaaaattactcacacactgagggtgtgcttagttcacaccaaaattaaaagtttgattgaaattggaacgatgtgatagaaaagttaaaagtttatgtgtgtagaaaaatttcgatatgatggaaaagttaaaagtttgaagaaaaagttgagaactaaaccaggcctgaatcattttcttcattcatgcaatcttcaagattctcatcatctgaactgaaccgatgatgtgcatggcttgggtctttcatggcatcgtcagcgaagtttgacctcgagttatgaccgatcagcccacgcacctctgccgcgcgatcaatctgggcagcgctagctccgtcgatttccgccgtgttgctgcgtgcgtccgcgtcgccgttgccggcggcggccgccctttcttgcacgcacgtcatcgtgtcgtcaccgccgccgtccgtttcctgcacgtgcatcgccgtcacgcgcatcgccgccgccatccttccgcgcgcgcgagattagtgatagtctgttaattagtttttgccctagtatggttttgaaggtagatcagtgcttcaagatttgtgcacgctaggtgacaagatcttgatagaggtgccatgcatgctttgtggcatggggtgccatacaattttttcccatgtacgtcttcaccgtccttactaatccacatatacggatttactactgttgctaataaatatattttatttgtataatcaaactagtttccttcaaattggtttacattgacgcggtttgtcgtatactttcataccaatcagtaaagatggaggagatatacatattctagacctcattttgtatgatatatgtgatctataatgtttttttaaaaaaaaaccgtagtcaacatgagccttagatatctattcctcatcaatttattcgtttttaatctcagtagttgttaggtgagatcatgtgcccgcattgttcatcgatcattgtgtttgtgtggtttgttttaccaggatgtggttatattaggccgtggtttacgggtgatcgagctttgtatggcaggccagatgatcgtcgctgactgttcttacgcttcgcaaattaagctgtaggacactgtttgcatgcactttgcaaagctgtagggcagttgatgtatagagtggcatgtttcactggaaggacgagtctttggatttgcatataggcaacgtacagctagctactattccccatcccataatataaagtattttagatggatgtcacacattctaatacaataaatttagacgtaccgtatatttagattcattgtactaagatgtgttacatttatccaaaatctcttatattatagaaacggagagagtgatagtatcccggagtctcttccgtgcctcgatcgggcgccttctccaggcctccatcgcagccgtgcacagccaaccgatctgtagctgggtttagttgggcgttctattcttaggatcaatctaatctaacgatttataatttgagaacaatgcaagcaactaatgtgattgcttagaaagatttttatgcttattagcaattcctttgttccgaacatcacttttttatgattttcaatcatctattttacacaaacaatcttatcccatttatatgtattttttgttcctacttttttttccaattctacctttcgaatgagccctaagtgaaaattaacggttgaatttttttttcttaaaattcttaagattttctctaatttattagcataatgtgatgatttaagagcattcctgaaaatgtttgatggacttttaatatataatagattgtatgcccaattagattgatacatgacagtgcaaaaccagatgaaattacaagcaacagctaaaaaataaagagatgtaattgatagcacaatagtaaaggacgtatggtttcaaccccaatgtatcgtttttaatctctaacaaatttataatttctttttaaaaatatttaaaggacatctcttccaccatatctagttgtagccacataaacaaatagagacaacacaaccaatatatagtacagaaagtttctgcgtttgcgcaccgtctgatcaatcacttcctgctcaatcttcttttcgtctttactcctaacccctccgactccagtctcacctcaggctcttaccatattcctcatcgttacaagaattgttctgaactactgtagagaatcatccgaagaatcaggtagatgcagatcgagacgtacgggacgtgtgcaggttggaggcatcgcacgctaccgcggcggatatgatgcgacgcgtgcatctactccctccgtcaaaaaaaaaaaaaagacaaaccctggtttccgtgtccaacttttaaccgttcgtcttatttgaaaaattatgaaaaaaattaaaaagacaagtcacgcataaaatattaatcgtgttttatcatctaacaacaataaaaatacgaattataaaaaaaattatataagacggacaatcaaagttggacacgaaaacacctagggtttgtttttttttttttttaaagagggggagtacatgcgacgcattgggcagtttacggctagatcgatgcatcgatcgacagccacccgaccagcaaccggccggccggcgacgcgaggacgtgtggacggcgacctggcggccggccggttttggctgtacgcgcgtgcgttgctactctatgctacaggaaggatcttgtcctccgtcgagattaacaatgactaagtttgtactactccttaattagggacctgccctgccggctatatatatacgtagtttaagatggcaggtaaggaacgagaggggtgtgtggaatgaaaaactatatctcccactaaagaaaattaatattttgttttttttattttaggataaaatggtaatgtaataagttggtagtgcaaatatagtacagccttatatttgtaataattaattttgagttcaaaaaaaagagcctaattaaactattttcaacttcattctttatttaatatgaattctcaataaaatctatatcgaaatactacatccgtattttaatgtatgacaacattgactttttatgtaacgtttgaccattcgtcttattcaaaaaaaaaatatgtaattattatttattttaatgtgacttgatttatcatcaaatgttctttaagcatgatttaaatatttttatattcgtacaaaaattttgaataaaacgaatggtcaaacgttagtcgaaaagtcaacggcgtcatacattaaaatatggagagagtaacatgtttcgcctaatagatgatcagaatttagttaattagtactctctccattttaggttataagatgttttggctttggtcaaagtcaaactacttcaagttttactcattttatagacaaatatagtaatatttacattaccaaattagttttattaaattaataattaaatatagttttataataaatttatcttgggtcgaaaaatattactatttttttctataaaattggttaaacttgaaacattttgactttaaaacatcttataatctgaaatagagggagtagtagttataggctcatgcatttcaacgattttttattaaatttaccgagagaatttagacttagtggggttatttagctttttttttaagaagtctgctttttagatggatggtttttatggtagtaggtttttacgtagaggtggaggtggaggtggagaaggatgatttaagtagtagagatatagcaactccctcatacttaaagtaaagatcattagaatgtgttcgggaggagaggggacatctcctctccaacacgtaaaatgaagcacgtattagcatataattgattaactattagaaaaggatttagaatggattcttataatttttaaaacaattttactatagaaatttttatttagtagtttggaaagaatgtgcgtgaaaaagaagagaggtgaagttgagaaaatagacttaagaacaatttgttttaactaacgatgaaatctttttttaatgtagaagctctctcgaagtccctagttagtacacaacgattcttggtagtatcataataataagatccgctcaattaatagtgagatttttttagttaatgtaaagaactcttttatagtgtctaattaatttagtgtaaatgtattctcaatctgtatcataacaatgtgatctgctaaattaatggtcagattttttccaagttagtgtagaagcttcctcagagtgctatgaatatagatgttagatataaggtaattaagatatgaatagaaataccatatctctatctatggtatagatataaatacatacagctgtatacatacgcaggtagtgtataaatatactgctttggctgcgtatagtcagcgaagcaaagcgaagagatggaagaaccaaccagctgctacggttactaccactacctcgccctcgccgtggccgtgctggtgctcgtccgggtcacgaggacgcgcggcggcggcagcgatggcgtcaggctgccgccggggccgtggcggctgccggtgatcggcagcctgcaccacctcgccgggaagccgctggtgcaccgcgcgctggcggacctcgcgcggcggatggacgcgccgctcatgtacctccggctcggcgaggtccccgtggtggtggccacgtcgccgggcgccgcgcgcgaggtgatgcggacgcacgacgtcgcgttcgcgacgcggccggtgagccccaccgtgaggatcatgacggccgacggggagggcctcgtgttcgcgccctacggcgcgctgtggcgacagctccgccgcatcgccatcctggagctcctctccgcgcgccgcgtccagtcgttccgccgcgtcagggaggaggaggccgcgcgcctcgccgccgccgtcgcggcggcggcgccccacggcgaggcggccgtcaacgtcagcgagcggatcgccgtgctcatcgccgactcggcggtgcgcgccatgatcggggacaggttcaagaagcgggacgagttcttggaggccctcgccgaggggctcaagctcgtctccgggttcagcctcgccgacctgttcccgtcgtcgtggctcgccagcttcgtcaccggcgcggcgcggcgggcgcaggagaaccaccgcaagaacttcgagctcatggaccgcgccatcgagcagcaccaggagcggcgcgcggcggcagcggcggcgagcggcgacgtcgtggaagacgacgatctggtggacgtcctcttgaggattcagaagggaggtggcctcgacgtgcctctcaccatggggatcatcaaagcagtaatccttgtaagcaagcacaacatcatttccaaattccaaccaaatgtttttttctaattttctttccaaatccttttcgtacgttctaattcatttaatttctggcatgttcaatttaagttaataattttgaaatttcataggacctttttagcgccggaagtgagacatcagcgactacaatccaatgggccatgtcggagctcatgaggaacccaagagtgatgaagagagcgcaagctgagttacgcgacaatctccaagggaagccaaaggtgaccgaggaagacttgaccgacctaaattacctaaagctcattatcaaagagacgctgaggttgcatctgccagcgcctttgctccttcctagggagtcgagggagtcatgcaagatctttggatatgatgtgccaaaaggtaccactgtgcttgttaacgcttgggcaattggtagagatcctaagtattgggatgaccccgaagagttcaagcctgagcgatttgaggatagcaagattgactttaagggtttggactttgagttcttgccatttgggtctggacggagaatgtgtcctggtataatgttcgcgcagccgaacatagaactcgcgctcgccacccttctctaccacttcgattggagcctccctgctggggtgaagccaagtgagctagatatgaccgaggagatgggcatcactgttaggaggaagaatgacctatacctacatgccgtcgttcgtgtgccactccatgcgacgacaccctagtatgtagttgttttttcgcacacaaatatgttatggaacattgagataaaggaatattgttccttccattatctaagaaaaacatgttcgcagatgaatctttgattgataatttgagataaattatgctcctactatatagttcacattgtgatatactacgggcctgtttggcacagctccagctccagctccacctctcctggagctggagctcagccaaacagtttcagctccactaaaattgggagtagagttaggtggagctctctcacaaaatgtactagagttg

SEQ ID NO: 27784 - DNA, 4620 bp, Oryza sativa
  unsure (1)..(4620): unsure at all n locations
caactccactccagactcaactcctagagttaaatttaggggttggagctgtaccaatcaggccctacttgtacaacttcatatgatctttggggaaacactactgagacaactagccatctactaccgtcgtaaaatatagctatttaggatgggatttgactcatcttagaatatagaatttgaagagacctctgctcagattcgttattataggatgagtcaaatttcattctaaatagcaatattttaatattttagaacgagaacgcggtagcatcccagtatgatgcagcatgtaaccgaaaatgctgccattgatgacaaagacaacctggaagattactgttgcactttgtaactgaactaccgaagctgatggcagcggtagtagaattcttgaattgtctgttcatgatgccctgcaagctaatgcattcagttggagtgattaaagtaggcaataataccatgagtaatgtcattatttgtatcggacaaaaaaaatgtactacctctgttctaaaatctatacataatataactaaaatataaagatagaatcgaatagaaacaaatctgagcacgtctgttcaaatttatcgtattaggacgtgtctaatataataattataataatgtatcttatgttttgggacggataaagtaaattacttgatcagcacactctggtgacatgacagctgtaaagttgactactgaattcagtggaaagaccgtgagcattattgttcacggctgaacacaaatctgtgggccacatcgtgaccttctccggggcccacagaacgcaaccgggcccttctttgggcccaaggaaaaatgggctgctcttttgggcccacgtgggccattttgcctccgttttgggccggccgtgaaatggctagagctgaaattgcaggtgttgatgacgatcgaaagctggatgctaattcaaaaaaaaagaaaagaaaaagaaaagcttggatgctgcacttgtaactgaagctggtgacagcaatagtacaaccttgaattgtctcttctgatctgctgatgcatttctagataatgcatatccagcagatttgggtgattaatccaagtaatgatctcactccactgatagtggaaattgctggcttcagcatcaaaaactgcattgtatgtttgttttttcgttcttttttttggcattgtttcagcttctttatatgaagtacaaattctacactccagcttggccttaaagtgatcgaacacctagcttgcacggccatggcgcccatggcgcaagatgtcgccgagtacctgagcatcttcttggctctcgtcgtggcccctctcctgctgctcagggtggcgaggcgggcgcgcggcaatggcgccggccggccgaggcttccgccggggccgtggcggctgccggtcatcgggagcctgcaccacctgatgggcaagccccacgtgcaccgcgccatggccgacctcgcgcgccggcacggcgcgccgctcatgtacctcaggctcggcgaggtccctttcgtggtggcctcgtcgcccgacgccgcgcgcgaggtcctcagggcgcaggacgccaacttcgcgtcgcggccgtggagccccaccctgcgcgtcatgatggccgacggcgagggcctcgcgttcgcgcgccacggcgcgcactggcgcctgcgcaagatctgcgtcctcgagctgctcggcccgcggcgcgtgcggtcgttccgccgcgtcagggaggaggaggtggcgcgcctcctcgccgccgtcgccgccgcggccgcggccggggccgacgccgtcgtgaacgtgagcgagcgcgccgccgtgctggtcacggacacgacgtgcgcgccatgatcggcgacaggttcgagatgcgggacgagtacctggagggcgtggccgaggtggggaagctcctgctcgggctcagcctcggcgacctgttcccgtcgtcgaggctggccagcctcgtcagcggcacggcgcgccgcgccgcagcgagccaccggaagatgttcgagctcatggactgcgccatcaggcatcaccaggagaggaaggccgccatggacgccgacgaggacatcttggacgtgctgcttcggatacagaaggaaggaggtcacgatgccccgctcaccatgggagatgtcaaggacaccatacttgtaagcaccatggtttctctcttcactctacttattaattaattgtctttcatttcatcattgtgatacttcattgttactgctacatatatgtaatgttgattaatttatctgacatctcttattaggatctttttgctgctgggacggagacatcaacagcaacactccaatgggctatgtccgaggtggtgaggaacccaagaataatgcaaaaggcacaagccgagctacgtaacaagcttcaagggaagccaagtgtgaccgaagatgacctagttggcctaacctacttaaagctcgtcatcaaggaaaccctaagactgcaccccgccgcaccaatgcttgtcccaagggagtgtggggagtcgtgcaaggtgctagggtacgacgtgcccaggggcactaacgtgctcatcaacgcgtgggcgattggcagagaccccaattactgggatgacacggagacgttcaaaccagataggtgtgagaataacaagtataactttagaggcaccgatttcgagtacataccgtttggatctagacgaaagatctgccctggtccggcgttcacacatgccatcttggagctcgcgctcgccgctttgctgtaccactttgactgggagctcccctgcggagttgctccaggggaggtggatatggccgaggagacaggcgtcgtcgttcgcccgaagaacgacctctacctgcgtccggtcgtccgtgtgccgccgggagctgcctcgagcggcaatggtggcacctagccgtgcaccgcatctactacctagccttaattatgtgaaaatgtaacctggttggatcgaatggattaagtgctaaataaaatggtttatgtgttcatgtttgtttgtgttcgtcacatgtcacatgcataagagagagaatcagactatcagagaaggcgaggtccagaagcaggatcaatgttatgcaccttgcaatgtcgatagcaattggcattagtcctaaactgctcagtcatcgtgcaggatattggtgcaggtatcccatagagtcatactctggttctgtaatcaccaggcattcagaaatcaaaaccgtgaaaactaaagacaggcatattcatgctccacataattctccaagaagaaatttggataaaaatattgatataaatttttaaaagtacggaacaatggaaactttcatctgataagcattcttttatcggaataaatatatcagtggatacgtacgatacaatgaacagatcctctcatgctttgtataaattgtattacatgctactacaatacagtgaacaggtcctttcatactttgaattacatgctacaatacatctcaccatactttacatacaatcaatggtctgagagaagggtcaagcactcaagcttcctggtgcacacattaatctacacctcaattgatgcttcaccgttgcttgcctttctccattttgaggatcgttgcttgtttatgatttggacgtaagggtgaatagtctaagtgtctaaccacaccatgagcaataggtcaaccccttgcatcatatgatatcttggtatgattgagtataagactatgagagggaatattgccctcaagatctgttaaaagacatcaggagggaaacgcccaggcatagaattgttctgctgagcttgcttcagatgcactctaagtgcataattatttatctgcaatgttaaatatacttatgtaagaacaatcaaaatcaccgggagtagtgttcgggacaaaagaatcaccaggagtaaggagtagtacctcaagagtttttatctgttcctgatactgcaaaaccagttgtttcaggctatgaacctcctgagtcctctcgtcaaactctttttgacgttcatgttggatagcaaccgccctcttcagaacagcgttctctctcagatatattgccagttgctccttcagcatcacattttcctgcaggaaagcaaagcataactgcttaatttgcctaggagtacaagtactatggatgaaacgtgcatatgctgttggttgcaccttgtgcaaattatgcactgcttcagttcctgctcgctccattatggatttctccaatgcctccagggctcttgaggcacgagcccgcgcatcatctatgtctgatgcactcatcatctctctaacaaatagctcaacccactcagaaccatgatgatttgtctgaaagttttctgtagcatgtgggtttcagtgagcacatccaaatgtccattattaacaacacctgtccaagattgcaagctgacatttagcaggcattttttggagaaatttattcacgaaagaggcatagttcatgaagacatggcaaacataagttggcaatnnnnnnnnnnnnnnnnnnnnnnnnnnnnnnnnn

SEQ ID NO: 27785 - DNA, 1035 bp, Oryza sativa
ctcgaagtgcataatctagcttcctatttttaaaacataaatctaacatccctgtttcagaacataaatctattgttccaataatctgtatcgccttagtgagtcagagcgcatgtcccagaaatggatcttgcagatgcaccaactttttttttgacttgtagaatttcacactgaagtttatagccttatttcttttctgatgaaaccacgtcgtgattcattttatttaccgaaataaagtgcgcattccccctctcaaaacaaaagtgcaaacgaagtttgagcgcgcgcgctctctctctctctcaaaacaaaataaacaaaagtactctctcaaaacaaacagaagtttgaactctctttcaaaacagaaatacagaagaagtttgagctctctcacaaaatagaagtgcagaagaagtttgagtttgcggcacacggaggatggggcggaggtgaaggtcgttcttcctccgaacagtaagggccatctcctctatcatgtccagctcacttgctgtcattccgcaagggagctcccagtcgaagtggaagagcagggtagaaaacagtagatctataatagcttccgcaaaggctagaccagagcacatcctccttcccgccccgaatggtatgaactccatgtccatgcctttgaagtctatggtactatttgcgaaccgctctagcctaaacacctcagcatcatcccaataattaggatccctgccaatagccacgcattaacaaatacggtggtaccttttggaatatcatatcccatgatcttgcacggctcacggcattgtctcgggacaagcaagggcgctgcagggtgaagccttaaggtctccttaataacgagctttaagtactttaggtcggacaaatcatcctctgtcacccttggcttccctgctagtttggcacgcaactcaacctgtacctttcgcataacccttggattgttcatgagctccgacatggcccattggatcacggttgcagatgtctcactccctccactaa

SEQ ID NO: 27786 - DNA, 788 bp, Oryza sativa
  unsure (1)..(788): unsure at all n locations
nnnnnnnnnnnnnnnnnnnnnnnnnnnnnnnnnnnnnnnnnaagcaagaaaagttaaaagtattcatgtgacagcaactgtgacgtactccatggtcaagcagtagataagctattaagagcaagtttaataatatagcccaatactaactccaaatcatttatagctaatgtaataaccaattcatacaattgtttactatactattaatacctaatcttacctgtcatacacacattacgtcttggagtccgtgctgcagctggctacagatctatagcccgctacttttctctatttttctttatctttttaaaatatgtttatagctggtttatagcctgctattgtacctgctctaccattgttgagataagggattagtattcgccgtccagtgcagcttactgtaaagcatcaggtttagtcttcttcagatagaaaatatcgatgccatccatgaacaacaagtcaaaagtgtagttatttcaacagcaaaaaatgtctacaaaaagattcagaatctcatccaagtagtcaacaaaaggaaatatgtatcaaatatgaaccattcatcaacttacagttactgatgccaatgttcatgggcatgatgataaattaatcttttggttaaggtttgctttcatcttaactcttaagatattttggtttaaattctgatgatttgatgggggggataattaattacaggacttagtggggagagcggcatgaagccgtgcaaccaccaggaggggaagcccggcgtcnccgtggtgaacccg

SEQ ID NO: 27787 - DNA, 532 bp, Oryza sativa
cagtgctctccgttgttttttttccttcttcaaatatatatatatatattctcgtgtaataaaaaaatattaatacattcgacttatttttaagcgaactctatttaatagacacttgcccaatcatatatatagccatcataaatacatatatatcttctcgtgtagttaataaaatacttatacactctatattaataaaatattaatacatatttatcttctccctcttcttcactagctagacacctgtccaaccatataggtggtgtattaactatgtgccaatgttctccaagatccagttggaagtctctgctgtcactaaccctctccagggtataaatagccgggagcatctactccatggcactcaccttaccacacaccactccaccattacttcacaaccaccacccgccgccatggagcaagtctcgtgcttcgccgccgccgccggcgccgtcctagttgttctctcgctcgctcgcatgctcctcgcgccgcgcaaggagtgggacgggctgaacct

SEQ ID NO: 27788 - DNA, 721 bp, Oryza sativa
aacttgatttcttagggagatacctaaaaataatctatagattataatctatagaggttcatccaattatatttcattaatcctataattaaatgctagtattttaggtatttaattagtaagaattcatctaactatattttcattaatcctataattaactttcgcaattttacgactataattaacctacgattaaattcttaactattttgaattttctaaacttctaaattttactcaaaccctatttattttctttctcttcctttccttttctttttccccttttttttcttctttcccttctcttttcttttctctctttttcctctcctctctttctttttctctctcttctctcctcccggctcctttctttcttttccttctcttcctctcttctctttcggctccttctccctctctctctcgccctgcctaccgagaccggctgaggaaaaggaaaaaggcggcggcggcacggcttaccggcggcaacggcaatggtggcggcgcacggtggctgcgacggcggtggcgcacggcggctgcgacggcggcggggaacgcggcacggccaaggcgcggcgcggcgcggcggcttcgtggcggcggcgtggcggctctatgcgacgacgcggcggcgtggaggcggcggcgcggcggcgtggaggcggcggcgtggtggagtgggtagaggagaggaggtgaggatgga

SEQ ID NO: 27789 - DNA, 616 bp, Oryza sativa
ggaagtgcaagctcaggtttggcatataatcgtagactatcaggcgttcttggccttcggcacaatagccacgtaagctcaacaggctcttgtgtctcactgtcgccaaaacctccacctcaattgcaaattcagtttcagctttgttgctccaactcttgagccttttcaccgcaatctgtcccatgtagttaacagaagaagcgttaggttctggttaaagtgaactactttttcctgattttggattaaacagatagaaggtaaatagttccaacataatacttatgatttatgaaatgatgttcaaaaacatacttgtcaaaacgatagtttgaatttgatattgtaggggctgttcaaattgatgctattttcaaccataccattttttggtaaagctgccaaaaaaatgtctatgtttagtttggtgtcaaatttggtaaatacaaaaaaaatcctgccaaaattttagcaatattggtattttaaattttggcaacattgccatcttgctaaaattttgctacaatctgaataggcccggaattttttttcacccaaaatgaaacacaactcaccgggatgtagcagtttgggggttatatcaccatgc

SEQ ID NO: 27790 - DNA, 698 bp, Oryza sativa
tgcctgtggtgttgggtgttagaccgttggttccgctgctgctgctgttgttggtgttcgcctcgtccgtgtcgtcggttgcattctcgggctgtctgagctgcaacctaagttaaggtaaataagtcctctatttattttaaggattgcaatgattcatatttgtcaccgtgggtaccagcgctatgtcctgggactggtactgagatcgcggtttcgtaggaagcggttcgcgccgtttttcccacgacacgctcctgtcaggtgccgttgtacggcggtgccagattcggggcgtgacactatacagctaaaaattgactctctccctatctaaaataccttatattttgagattgagaaagtatctaattaatgtgccagatatctatacagctaataatttattatctccctatcttaaatctcttatactttgagaccaagaaagtatctaattaatgtgctatatatatatatatataattgattatctctctatttaaatctcttatattttgagactgagaaaatatctaattatgcgctagatatctatacaactaataattgattatctccctatcttaaattccttatattttgagattgagaaagtatttaattaatgcgccagatatctatacaactaataattgattatctctccttcgaaaatcccttatatttgatattga

SEQ ID NO: 27791 - DNA, 664 bp, Oryza sativa
tccggggcccacagaacgcaaccgggcccttctttgggcccaaggaaaaatgggctgctcttttgggcccacgtgggccattttgcctccgttttgggccggccgtgaaatggctagagctgaaattgcaggtgttgatgacgatcgaaagctggatgctaattcaaaaaaaaagaaaagaaaaagaaaagcttggatgctgcacttgtaactgaagctggtgacagcaatagtacaaccttgaattgtctcttctgatctgctgatgcatttctagataatgcatatccagcagatttgggtgattaatccaagtaatgatctcactccactgatagtggaaattgctggcttcagcatcaaaaactgcattgtatgtttgttttttcgttcttttttttggcattgtttcagcttctttatatgaagtacaaattctacactccagcttggccttaaagtgatcgaacacctagcttgcacggccatggcgcccatggcgcaagatgtcgccgagtacctgagcatcttcttggctctcgtcgtggcccctctcctgctgcttaaggtggccaggcgggcgcgcggcaatggcgccggccggccgaggcttccgccggggccgtggcggctgccggtcattgggagcctgcaccacctgatg

SEQ ID NO: 27792 - DNA, 318 bp, Oryza sativa
atagaaaccctagtgttttttttttaaaaaaacagattgctcaagtgagttcttacatttttttatttaaaaaaattcacttataaatagattggtagccaagttaagaccaaacagtagtagcaactagcaaaggcagctcagctcaagtttagagtgagaggtgagagctcagcggcgcgccatggcggcatctcggcttgcgctcctcctcctcgtcctcgccgtcgccgcggcgcgccacgcgctcccggcggcggggagcgacgcgcacccggggtacgacggcgcggaggacacctgcggggtcccggcggc

SEQ ID NO: 27793 - DNA, 549 bp, Oryza sativa
aagagacctctgttgctgtgataatccgtcttcctgtgataccagtactgtttcctgggactggtatcgatcaacaggttaatttggagcgtcaagggctagttccggtcggtactagttcggggcgtgacacaacagcttcagtatatgtggctggctcaagagaaatctccacctgttcagcacaactaaaagcataataaaccatatcacattcctcaataaggcagactggagctccacaactcctctttgttctgcgatgtgcaataggttcatcttgtggctgcaaaacaagaggtgagtgctgaataatatcattaacatcattaccaacaatttcagtttcctgatcatccacgtgctccacctgcacgctaacatattgctgctcctcatcagaaccacctggtatgatatctgtgggcaagctatcattaaacataacagattcattgaaaacaacactcctgctcatgaaggtcttattagtttcaggattccataatttatatccttttactcctgaaccataaccaagaaacagac

SEQ ID NO: 27794 - DNA, 619 bp, Oryza sativa
aataaacaaaaccccaactagtggacactctactcatggtaccagtagtatgattttaggtagatgcttcgctggttaattaggcaacattaggtggttttacaactgtagactttgggaatattctcatcacctggacactatggaattgttggatcattgtggaattggattcacacctcccctctattcaaaaccctcaaaatggttttaggctgggctcgaggtgcatggttttgatagtagcacctcggccatataaggaccggtcctcggccatataaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaatgatgtac

SEQ ID NO: 27795 - DNA, 1256 bp, Oryza sativa
ctacaatcaatcttatttacaatacgtttgtcgcgactgagaaaaatgcattttcccgaatgctactgtattaatccctatcccaggaaaagccagggtacaccacacaaacatgatataaaagacacatctttattatatcgataatacttacattattacaaaggtgcttcaggcctgacaatcaaaaataaacaacagcggactagcgggcctacggctccatctccacaggcgctcaactggggtataagccgggactccacctaagacttcttctccaaagcttctcttactgaagggggggaaagattgagcaagaatgagtacaaccacagtactcagcaagtcacaccagaagctgcatgattaatgcaaggggtacaagggggtaataatatggggattaggttttgcagtaaacagcatttaaaagtcacttagttgctcaaagctattttgtaaacacgatcctagagctacacaatattattaatcaaggccgtgaaccctcacgaacctgccttaacccaaggcctacgatgattcagaccgaattggcaacccgacctgggccaaccattccacattttagttgttaagcaagttttaagaattaaaccactaacttgggtacatttctaggcttgcccatagccgagggcgcggctattcgaatagattatactctgatgagaaggtgtacatctttacccacaagacacatctttactctgcattccacggccgtggaacccgtcgtaaaggatctgacataacccctttacccatcctagccatgacaaaagcaccgacccaacctcgcctacggccggaatcccgagacaggtaggtaagattaagcccctagcagcaagacaccggccctgtgccatgacatctcgactaccgagccgcagcccgtgtagccttcatttgccctagagatgtccattgagccccgactttgtccatctccatccgtgtactcttgcttggactagactgagcaccgagttaagccttacccattagacatgtggttagtacggtagtgctttgcaacagaggcccgaagatcggtgcttatagtggccgaggtgctactagcggaaccatgcacctcgagcctagcctaaaaccattttgggagttttgaatagaggggggggaggtgtgtgttcaattccatcacaagccaaccattccacagtgtccaaatgatatgagaactcccaaagtctaaagttataaaa

SEQ ID NO: 27796 - DNA, 575 bp, Oryza sativa
tgaatggaccgctgaggagaagcggaaagatcgtaaggctctatcgctgatccaacttcatctatctaatgatattttgcaagaagtgttgcaggaaaagattgctgcagaactttggctcaaactggaatcgatctgcatgtctaaagatctaaccagtaagatgcatatcaagatgaagttgttctcgcacaagttgtaggagagtggttctgtgttgaaccacatatcggtcttcaaggagatcgttgccgacctagtgtcgatagaggtacagtttgatgatgaagatttaggtcttttactgttatactcactgcctagttcatatgcaaattttcgtgacaccatacttttaagccgtgatgaactaaccctagcggaagtttatgaggcgctccaaaacagggaaaagatgaaagatatggttcagtctgatgcgtcgtcctctaagggcgaagcattgcaggtcagaggcagatttgagcagaaaacctacaacgacagcaatgatcgtgacaagagccagagtagaggccgttccaagtccagaggtaaaaagttctgtaagtatt

SEQ ID NO: 27797 - DNA, 748 bp, Oryza sativa
gccggttccaagcaagtacttgcttcaaccttgctgggatctacttcgacaccattggaggaaatcacgtgtccaagaaatgctactcggtctaaccagaattcgcatttcgagaattttgcgaatagttgatgatccctaagattttccattatcaacctcaggtgttcagcatgttcttcctcgttcttggagtatatcaggatgtcatcgatgaataccacaacaaactggtccaggtattccatgaagattttgttcattaagttcatgaagaatgctggagcattggtgagtccgaaggacattactgtgaactcatatagaccataacgcgttgagaaagcggtctttgggatatcttcagatctgattttcagttggtggtaacctgacctcaagtcaatttttgagaaaactcttgctcctttaagttgatcgaataaatcgtcgatccgtggcaacgggtacttgttctttatagttacttcattcagggctctatagtcgattaccattctctcagagccttcctttttcttaaccagaagcactggggctccccaaggggatgagctaggtcgtacataacctttactttccagctcttcgatttgtcttttaacttctgctaactcattagctgccattcggtagggtctttttgcaattggtgcggtgcctggtgccagttctatggcgaactcaatctctcggtctagtggcattcttgttaattcttccggaa

SEQ ID NO: 27798 - DNA, 789 bp, Oryza sativa
cttacaaaagaggaaagaaaagctactagagccatacccgaactcttccgagggcttccggactcctgatttctactctattcctgttccaccagctagatactactaaactaaactttagagaaatgagagagctcttgcttaaggtgtgtgtgtgaagtgataagaggagctcctttaatagctgaactatgacggttgtgatggttggaatggtaggtaataccctccaaccgtcattggggtttcatctcaaccgtccagccaaaacctggatccaacggaggcgagggaggttcggccgaacctcctagttcggccgaacatggggctggcccaaccagcccaccattcggctggcggcctcctctattgcttctttatgtagacttgtgaattttggcccagtttgtcgtgtcaattctgagttcttggctcattcatacataagtctgattgtcgacatcgttcgattgatttatcgtccgtgttgatgtcgattctcctccacttaatggtcattctctgcaaaaggtgagtacacctaatattagtggaatattattattctaacatatatatgcattgcaagcatcactagttctcctctattttggtaatattgacggtcgaaactgatcgataacgaccatcaacacccacatgacagcgagagaatgatgtgggccccacatctctctttgttttctttcttctttctctccttcttttctcgtctgcagcggcggcggcggcactcatccccaccgtgtgcggcaacggtgacct

SEQ ID NO: 27799 - DNA, 554 bp, Oryza sativa
atactccggttcaggtggagttgtaaaggtatcgaaaggttctctcgtttatatgattggtgatatgaattctgtaaacttatatgtccttagaggaagtacattacatggttctgttaccgctgctgctgtttctaaagatgaacctagtaagactaacctgtggcatatgcgtcttggacatatgagtgaacgtggtatagcagaattgatgaagaggaacctgttggatggctgcactcagggtaacatgaagttctgtgagcactgtgtttttggtaagcacaagagggtaaaattcaatacctcagttcatcgcactaaaggtatacttgattatgtacatgctgatttgtgggggccttctcgtaagccctctcttggtggtgctcgttatatgcttaccattattgatgattactctagaaaagtgtggccttatttcctgaaacataaagatgatacatttgctgcttttaaagagtggaaagtcatgatagaaaggcaaactgaaaggaggtaaaagtacttcgcactgacaatggtggtgaatt

SEQ ID NO: 27800 - DNA, 1584 bp, Oryza sativa
cacgcaagcgcgagagccgcgccctgcgcctctccgctctgcccgcgcgcgtgcgcgtgagccgcccgcgcagccgcttggccccgcgagccagcgcgcgtgcccgagccgcgccactccatccgccgcgcctcccgttgcgagccgcgcgcgcgtgccggggtggccgaccgcccggtcgccgccgccgtcagcctctgcacgcgcctgtcaccagtctcgccgctccgctccaaaccgccccgccgtcatcgccgtcgtcatcgcccggccccgccactccgcgcgcaagccgccaagggacggaggcagcatccctcctccctctgccgcgtcgcccccgctcacctcctcctttttcccgaattggcaaaggggcaagccccatatctccccctccttttcccctttttctcctcgccggcgtcatcctccctgtcgccgctttggccgcgaccgccgagcgccagctcgcgcccttgaccgcgcaagtccgttcccaaaccgacattgccgcccatttaaaccccagcctcccctttcccttcctcttccattcgcctccgtgccattgccgccgctcccgtgctctgtctcgcctccgccgtccatcgccaagcgccgggagagccggtgcgttcgtggacgcggaaggggactccgggcgtgccctcttcttcctcttcctcggcccgaggccggagagatcactcccgcgccgtcggcctctcgtcaccgtgcccgtcccgcacggtagtgcctccctccgttcttcctcctcgctccatctccccacccccccttagctttcggtagtagctcgagtagcctccccgaagttagccggcgcagccccgaccgttgccgtcgctcgccgtgtgctcgccgccgtcgccgcccgagctcggaagcaccgctcgtcgccggcctcgctcggcgtagttccgcccaatccgacgctagcatcggattcccgtaaccgcgtagatgctctcgccgccgggaattagcccctagtgatctcgtcgccgtttcccccttctcccgccgccggttgccgccgccgcaatccgccgccgtcgagcaacccccggcaaatccgacccgttggttcgtctcccctcgtcacgtgcaaccgcccggtgtgctcgcttttacccgtatcgccgtggttcgctccgtcgctcgccgctgtcgaccgccgtccgttccggccggcgtcgtcgtctacctcccgccggcctgcgtggcagccacgtaggtgccacgtcggcgccagctcagcctagaccgggtcgagacgaccccggtcagtccctccccgtgcgcgcgttccaccgcgagccgtgaggctgagcgtgggcccgccgtacctgcgtccatcgcgaaccgcgtgcgtacaccacgtccatcctccaccctagcgccgcgccgcgtgctccctccgcacggtgagccgagccgctgacaagcaggtcccacccgggaccgcgcgtggtgcgcccggtccaccggactctctctccttcctccgcgcgcgctcgtcttgggccgccttgggccaccttcttgggccggccggcc

SEQ ID NO: 27801 - DNA, 737 bp, Oryza sativa
gaattatgtgggatgatgatttaacatgcttgtattttaaaagctataaaatttaataaattataaaattatagataatatagcatgtttgcatgatgtttaaattaatgatttttagtggatgatgatatgacatcttgttaatggatgatgatgtagaatctttgcatgttaagtttaggagttagtgagttataactttatagtaaaagaggataaggaaacctatgtcgtattcggttgggctttccttcttgtaaccctacccccaagcctatataaggagggaaaggagcctctcaaggtcatgaccacaatttgatcataagatcaatacaatactggatgcaatctccaaaataggagtaggtattacttttcattgagaaggcctgaacctgtctaaatcttgtccctttactcatccactctagatctcatgcgttaactcttttctcattgctgatttctataatcgacactagtactctagttgtctggttgctctggtttgtggctgttctaagcggccaatctgcaaacagaggagggaaaaagaaacaacttgggagttctgaaattttcggagggaaatatgatatagagggaaaacgatatggtctaactcagtttctcgcctcgctcagctacctgcgcatgggatactgagatttgttttgcctcctctaactatgcaggaaaataaaataaaaatatgcactgcaaataaattgatt

SEQ ID NO: 27802 - DNA, 703 bp, Oryza sativa
ggatcgcacttaatctgttgtcccgtctgcaaggcagattggcggatctgcctaatttgttgcatttgatccttcctttgttaattgttataccatgtccccttgtaaccacccagttgcgcctcgatattcgtgcactctgtgcgagtatcgacggtcgtcttcaaaacttaaaatctgaaaaacaacttgggtaaaacttgggttttacaaaagacttagaaaacccgacacctgggtcggtgcttgcgaactaaatgaacttctaaaaccgcggaccggggaacgtaccgggtgtacggttttcccgctcccgcacttaaggaccgattccttggaatttcatccgaacataggacaagtacgaccacatgggtggaatgggacacccctggctgagtaactagcttatcaggggagccatgatgccgagggacatgtggattcgccggggtggtgtcggagaggacccccctgggcttcctggcacagtatggtctgggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatgtcgtgtgggtaaagtgtacccctctgcagaggttaacaaactgttcgaacagccatgcc

SEQ ID NO: 27803 - DNA, 1260 bp, Oryza sativa
agtggatcccccctttgtaactgatggatgctgagccacgtccccctcctcttcactgcataactggacaactgccacggcaatggtagatggctgactttggaggtttccagagagtaaaaggaggcgacatggctcagctcggtctgaactgcggctgcagcagcgtattagcgatgtaggggagaacctggagaagcgctgaagtggagactgcgtgcgtgagagcgtgagagacagtggaagggaagacggcctgcgagagagagagagagagagagagagagctgagaggaggcgaactaggaggagggagggaacaccaaagttgtcagcgttccccaccggcccacctccctcgaggtcatcgccgcccgggaggccaccgcatcggccgcatcaagatcgtcgccgtgttttccttacccctacagctttcactcgatttgaggaggtggatagacaacactttgctctaacttgctaacttcatgcgaaagtacaaccttgccctcccaccatcaacagcatttggtacctactcttgcagacgatgtggtaccagcaggtaccgagccttcccaggccattggattgattggaatggacagctacgatatggtatctcctcccctcaagaactgctacaaaacttatagtatatgagaaattataagtaaaagattagttttggagaccgtgccaattttgaccgcgtcttatattagggatggagggagtactaaaaaaacgaacagggtaaaaaagaaaaggacatgctcatggtacatcctcaataacagaaagatgactacaccattcattttaaaaatatagcatagcatgttataaatctaaataaacacttgtttacatttatagcgaaagattattatattattatataatgtatgaagtagtatgtatatacaacagcaagttgaatttggcgtaaacaggaccatatgtacgactccaagcacgaggagggctcattccatatatatcaacaaattagtgtcatactgtcatggatctagctaggtaaacatcgtcctatctgggagaaatatgatatccatgcatcgccaattcgccataggattaggaatcgatctcgatgatcagtctccgataggccggcctgccggccccggggtagctactatacgtaccggctatagctgcggtgctatccatggatggagcagcacacacgcgcgtcagtgaatcccgggaaaccctgcccggccacaagtt

SEQ ID NO: 27804 - DNA, 1838 bp, Oryza sativa
ctgcaacaaaggacataacgtacgtaatatgtgtgcctcctactcctagcttgcgtttgatatagaaaattaatagcataaaatggctagaactgctacagggatagcctagctgtatgacaactgtatgttcttgtcttatgcttgtgtggaatgtgtatgtttgtctgtgagagtgttgtcatgtgtgtgtggttggccggttaatagtgcttgttgcattgatcgcatgcctaatatacttggggtttttctataatccaacgcgcgcggcatcgttgcgcgagctccctcactgtgttttcgttttcctttctttgaggcctgcttgtttttgagcttgttggatatcagcttactattcgatcggtttgcatgggattcatattttgatttgcaaattatgtatcgtcggttttcatggattttagtaattaaagggtctcgcattatgaatctctaacggattaatttgtaccctgctccgttactcgtctggtgcataatcctaatctttgggctccttttgattgaaggattttcataggaattttgaaggaatcaaatccttaggaattttttctaatttgcatgtctggaacatagtcttggaggtgagcaaattcctttgaattaattgcaatcctatatagctctaatttgcatgtctggaacatagtcttggaggtgagcaaattcctttgaattaattgcaatcctatatagctcaacacattcaaatttttgtgtattaaattcttaaaagttttaacacatggcattccaatcatgcatttttcggcctattcctatgtttttgaaatccagcattccaaaggaactactaataataataatggcgcagttaaaactataagcaaatggtaggctatatttggagaacaatcttatctattatatactaaaagtccattaaaatttctcaaaacgcttttaagtcgccatgtgacaatctagtaattagagaaaatagtagaaaatcagagaaaaaaacaaaacatctatccctaaattttcatttaaatcggtgggtccaatatataaaccgttggatatattttttttagaaaattatgagcagttatgagtctgatcgtctcaagttagcatgcgagtttttttaaaagaatttcttatacgactcttactgtattttcaaaaacgaatgaacttaaaaaccgactcaaatacggatatggattttcaaaagcgaacgaacttaaaaactgactcgtacacggatgacgtaccaaagtaccggtaaaaacatctttaatttttatttttccatgtatatagttgagacgacaattatcattacttttagtgataataatttttaaataatagttactttgcaaatattgaattatcaacatataactctttaaaaatagaaatagaagtaaataaattagtttctaatatataaaatatagtttacatcattatcttatactatataatgtacccattattttagatttttatgtaaaaatatttgtacacatattttcactaaaataggtggacctattatttagaccatcaaatctatcttttgttaaaaaaaacgaagactcggaagatgtttctccgcccctctacacaacgcacatgtgcgaaaatccacacgcgtgacaaagagtgtcgtacctaaggtacctaaaatgatcatgagttcatgacgctatagggcttctgctttgccaaggtgaagacatatcaaatcattaatggatgacgactgtttttcttaataagtgaatttttttgaagatatgatgtagagggaagaagaatcaagcaacgtaaac

SEQ ID NO: 27805 - DNA, 817 bp, Oryza sativa
aacaccaaccgagaccaaagagaggtagcagcggtgagatggtccttttcttttttttttctttttttttctctcgaattaagtgggatacatatcccaaatcaaacctcaaatacccaaatcaaacccaaaccaaagtaacatcacaaatcttatacatcacagatccatacaaatgtacaatgaatcacaatattgtccatacaaaagtacatcacagtgaatcacaaataaaaaaacaatgttgactgccgctgtcgccggccgccggccgcggccccatcggccgccgtcgcacggccgcctgccgcgcggccgccgcacggccgaggccccacctaccgccgcccacggccgcctcgctccgctgccgccgcacggccgcctgccgcgcggccgcctcgctccgccgccgccgcacagccgcggccccaccagccgccgccgcgcagtcgcctcgctccgtcgccgccacctcgctccgtcgccgccgcccggccgcagtagagaggggaaggaggaggaggaggcggggatagaaagggggagcagagaggggaaggaggaaggggaagggccaggggaggaaggggatatcgaggaggcgctggaggcggataccgagagacttaaagagaagagaaaaaaaaggggacttaaaggcggggatagcatgggaatctttactcccggttggtattaccaaccgggactaaaaatacatctttagtcccggttggtaactccaaccgggagtaaagcttatgttgatctttagtcccggttggtaacaagatccctatctttagtcccggtt

SEQ ID NO: 27806 - DNA, 1111 bp, Oryza sativa
ccgtgtaggcggaggcaccactcggcggcaacggaggcaagccggcggtgaagtcgtagacgcccaacagcggcggcataataggccagccgtgtaggcggaggcaccactcggcggcaacggaggcaagccggcggtgaagtcgtagacgcccaacagcggcggcataataggccagcgtgcaggtggaaacaccagtcggcggcagacgaggcggccggtcggtgaagacgtagacgcccaacaacggtggtataacaggccagccgtgcacgcggaaacaccagtcggcggcggacgaggcggccggtcggtgaagacgtagacgcccaacaacggcgacataataggtcaaccatgcaggcggaaacaccagtcggcggcgaacgtggcggccagtcggtgaagacgtagacgcccaacaacggtggtgtgaccaaacaaccgtataggcgaagacaccagtcggcgacgatgacggcaagctggtggtgatgttctgactgatccattcctggagcgtaagagataagcttaaagccatgtatcccttttgtgcatatctggatctggatcctgcagaacaaacatataggatgagtagtatctgatataaatataatactcgcgaaaaaatcaagtatctaaaaatatttataaatatgtatttcacctcttgtcaattttgatttccccgagcagatgactctgtacgtttaaacactctgtccgactagtcatagcccccaagcatcgggagtcgacctaggcatttcccaaacatgcatatgagtgatatgagttcgtcattaatggaacaaagtttcacggattagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaa

SEQ ID NO: 27807 - DNA, 834 bp, Oryza sativa
tgtcgaaacatgaattcggcaataataaaacggggtagcgcacgagacctaaaagtggatggatgtggagacaaaagatttagacaggttcaggccctctcgatgagaggtaataccctactcctgtttggggatttgaatccgccgggtgtattatagatctgacgatctagttgtctcatgccccctagagggcttcctgcccaccttatataggatggggggcaggattacaagatagaaaccttaaccaatacggtatcagtttcctaaatctactttacaatcttatcaaaccaggactttaggccgttccataatatatagggaaacgtaatacccaagtcacgatctgttacatattccatacatatatgttatcccctattactagtcggataaccatgccgtgtggatatggggtacccataatctccacataaggcaaatagtttattgattttaatgcatatgtgacatcatcaaccacattgtctaagcaggtatgggcgttattactatcattggaggtcacacactgatcaaggtgaggttataggactattgtagaggacctttgaggatatttggcattaacgtgaaacataactggaacacaacatacctcatgccgcgtcagctgaaagggtatgaggaaataatttatgatttgattgattcattgcacttgataataaattatgccgagatgaggatggtgatggtgatggtgaggttttgcttcttaccgaggaagaatgggacatagctatacgcatgtgtaaatttgtaaagccctttcgtagaacttcagttttgctatttggaatgcac

SEQ ID NO: 27808 - DNA, 722 bp, Oryza sativa
ctgtggagcgaagaaaccagtcggcagcagacaagtcagccaacagtgaagatgaaggcatccagcaacatcgacaaaattgagcagccatggtggcggaataatcagtcggtgacagatgaggcagccggtgaagaagatgaagatgcccattagtggcgacataataagccatccgtgaaggcgaggataccagtcggtggtgacgaaagcaagccgacggtgaagatgtagacacgtatcaaaggcaataacgaaatccaccaatcatgaaaatgaagaaaatagtcgacgacgacaaatgcaaccgtcagtagcaatagagatgatcgactatgatgacgaaattgctcatcaaacagtagtagagtgggctatgttgaagaggcttgacagtatgttgacgaagatgacgatgttggtgatccagccaatagcagtgtagcaaccaatgataatgacaaagacgctcatcagcatttgcatagtaggtcaaccgtgaaggtgaaataataagtcggtgaagacataatcatccattagcaacagcggagatgtcagggccgatgaaggaaaggtgctggtgatgatgtcagtgacaataatccttcaaattaatgttatagctgttgtagatgcttcacttggaggagagttaatgctgttgtccaactcgtctaaaccgaaatatttgatgttgttgaagtagattgtctgctccg

SEQ ID NO: 27809 - DNA, 606 bp, Oryza sativa
atggcttcctaaaagcatcaatgttggaagtttgtggtacaagaatgattgtttcatattggccactcatgctacgaaggttttctatttgccagatacaaagctgggtgaaaattggcaagttgtacagacatttgaccataggcatctttataacgtaagtcagacggaggttagtgctactgcatatcaagaagacgagtgctatgatgaggaggatccacgccgaccagtttctagcattatatatgatacgcctttaaatagagatgatgagcgtggccctgtttttgaagctgctgaaattgctcggttgatgaaagaatctagcaaagaagtgaatgtcattggtgatgaagatgaagatgaagaagatgacacacttatggagtattttaacgaagaagatgactcagttatggaggtcgatagtgacgacgaatagttctgtttgaattttatgttttaatattttgtcgtaaggctcaattagtatttgagaccatgttctacttatttgataccatatgttctattatttagatagcctcaattgtatttgagatcatgttcatctatggaattatgtataatggttcgatgcca

SEQ ID NO: 27810 - DNA, 729 bp, Oryza sativa
ggcgtaccgagccaacttgttgaactgacttaggtactcattgacactggtgttgccttgcttaagcctgttgaattcctctttcttcatgtcaatggtgctttcaggcacatgagctgcacggaaagccgtggcaaactcatcccaagcaatgttagtgggttcagggtgtccattgcagtaattctcccaccaatctgcagcaggtcctcttagttggtgagaggcgtagagcgtcttctcaacaggagtacactgcactaagttgaattttctttcaacatccttcagccaatcgtcagcctcgacgggctcgacggtctgagagaactctggcggacgtgaccttagaaaatctgtcagcttggatctattgttgcccatgtgagggtggccatttccatgcacattatgctgataaccggctacggctgcggctattccttgcaagatttgtgtctgaactgccattaagtgttgcatgttgttttccacatgaggtggggaagggaggcgttcttctccagaattgtgactagcagtgcggtgagagcggtgagactgttccatctctgaatcacgggaagctgtgcgatgcgagcggttgctacggcggggttgctcaacttctgcgttacgggaaacagtacggtgcgaattgttgctgcggtgagactgctcattagctgattcatgatttgcttctggttcgactctaccttcttcaaa

SEQ ID NO: 27811 - DNA, 782 bp, Oryza sativa
caggcgattccgcgtccgccgaacgcgtgcgagcagctgggccgctgggtcccgtatcgtgcaaacaccgtggtagatacggacgtcgcacccattttcatcgagctggcccaaacttatcaagttggcgttgagtttagggatgtaatacacccccgtcaacgctcggtgctcctgattcctgcactcaaaaatgatcttgccacgaccctcaattccgacgacggagccgtcgccgaatcgcaccgagccccgcatagacaggtcgagctcagcgaaaacttcgcgaatgcccgtcatgtggtttgtggctccggtgtcgagatgccagacgccgccgttggtttgtttctccgtgagaaggtgcgcgaacacctttggctcgacgagctcgatcgtcttgtcaggctgcgatggcggcgaagaagcaggtggcgcagatgaagacgacgcagacacaggagcagcgtcgacgacatgggccatgaggagggccgactcgtcatcgtcctcatccgccagggcctggtgggcctcggcaggccgcttgggcttccggcagtccttagcccagtgccccgtgcggccgcaattgcggcacttgtcgcggtttggttcccgcccttcctgcgtgtcgcccccggcacgatctccatcgtgcgcagcagcttcagctttcttcttgccaccacgccgacgacggttgccaccgccggacttcgccttcccagaggaactttccgcggcctgtttctccttccaccgggcagtccactgctcct

SEQ ID NO: 27812 - DNA, 2215 bp, Oryza sativa
cgtgtcccgtctcttgctgtggactgactctgttctttgagccgagccgatgcccaggagtcgagttctaccgtcgctcccaaaatcctcttcgccgcctcctcccacgcctgcagcactcctcttcaccactccaaatctactcctacggcggtggcggcggcggcggcggtggctacagggctccgccctccacccatccgaacagcgccccacccaccacccagccatacgacacgctgtgagccttgaggggccccgctgccctcctcgaagcttgttcgcatcagtggtgccatctgcgttgagacagacctgaccgtggtgatgtgtttctgggcagcagaccacaacggcaaggagctaatgtcaggtttgctgaagctatactgaaggctgattcctgtgatattcaaagctgattcatggcttctctttgcaatttatcttgttggaatcggatgtggaattagtgttctttcatttgatgtgtcactaaagctctttgaaaattatagtagtaatttactgaatattactgcggacggtgacttactagacatttgctatcttaataggaaaagaaaaatgaaagctagcagtgtcaacggagaagcggagagtggagattctaatggtttgtccatggcagatagcacgacaggaccacaggagtgctgcagctaggcgcggggatgaggcggcggaaaggattttggggcggcgtcgcggcggtagaactaactctagagcctgcggcgtcggctcggctcgaaaacagactcgagttatagcaggagatgggacacgtggcaccagctcacgtggtgttgcacgagaagcattgtgcggcactgccgcatagaatttttttccaagcgacgcgcgtgtgatctggaggacgaccataggttgtttatctctcttttgctactagaacggcgtgtagacttggacgctatatacaacagcgtgcagacctggacgcttttgacaacgacgtcctaacctggacgctgcttctccccgtgtccatcctatttttgcaaatctcttctcatgtttactacttcatcccttttagcattgcccatattcatatataatgaatctagacatatatatttgcttagatttattaacatctatatgaatgtggactatgttagaaagtcttataacctaaaacggaggtagtagatattatttattatataaaatagtttgggtccagattcattgttaaacatgtggtgtgtcattctgaaataggttggccattgaccatcatgaactgtgtgtcttttgtctgttgagatcgcttctcaggaggaatggtaagaacagagtagtcgaatgccagatagaggtcttttcctttgccagaaaccaaaacaagggcattaatatagtgttacatagaccattcccatcccttaacttgcacagttcgtgagcgcaccatattaattcatgacagtcaaaatttaaattttataattgaaagatttttgaggtttttaatcatattttattttcagtattatcttttaaattaaaaagacacacatatataagttttatttataaattatttttgtccgctgataagtagtacttcctgtcttaaaataccaacatctagaaagatttatctctaagatttttctttctccgatataaaggtgtatatgccaaacgatgaggctgtcatttttgctcattatagctcacagatagatccgtttgacatgtctctgaccaatagatccgttggacatgtctttgaccaatagatccgttggacatgtctcttgctgaccacttggcacttgatagtgccatggcccatggcttttcaggtcttacggacggcaatggtgcttcaccccatcagaatgagtttccctcgtatttgctattcctataactgttaaacagaagaattagatctagttttaaagatacaaattttatctcggttttcttgcaaaagttttctatatgctttaagatattaaataaattttctaaaaatattaaaattaaaactacattagtcatgcgctagctttctcgtttagcacaacgtgtttctctctcgtccctctccttcctgcgtggcagggctagctatacgccaactcaccgcttaattaaatttgtacatataatatatatatacatagagaaattattttaggtcactgcgcac

SEQ ID NO: 27813 - DNA, 72501 bp, Oryza sativa
  unsure (1)..(72501): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagatatcaaaatatttcgtgtacacccaaccattgaccctttgctttccttccaagttcttatgctaattatatttgttgaaatgtagtctacatgatcatttacatgtattgtatacatctttacagaagagtgagggaagtgctgttcccactccatgggctccaggaatgggtaggaacatcgaaaagtatgttttgagggaccaggtttgttcattctccgtataattattgattgacctctcttgtctatgtaaatgctaattactgtgagttctttgtcagcaagtaaatacattgtcggtagtgtgattaatcataattaacaaatatctaggcggattttaaggttctggatgtgcatatgtgatccgctttgttgtatgcacaacaaaatcatttaaatttagattgaggcagctatgcaatttagtgcaaagttagattcaggtggatgaactaatcatgggatcagattctatctgaacaagtggataggtggcgcatgtctagtccattaagagagatttgcaatgttcttaaaattagtgaactcatttgctgacatgaatgccatatttggcatgctaatagaaatctgtccaattttattgactatctcatgcattcattctatttaaaaatctgcatttctaatttacatgagcaaatcataaatttggtgcaggttgctttaagtagcttgatcactcagtgattatcaattatatatctgtcttgttgcctttggtgcttagtagcgatttgattatcaattgtttgtcttgtgatatcaggaaacccgatatcgtcaacgatatcttgatctcatggtaaaccatgaagtgaggcatattttcaagacaagatcaaaagttgtctcttttattcggaaatttcttgatggtcttgactttttagaggtgggcctgtgcaatctattctgttattcttcttttgtatattcttccagtccttcaaatctgaatattctatgtcttttctaggtggagactccaatgatgaacatgattgcaggtggagcagctgcaaggccttttgtcacacatcataatgagttaaacatgaggctttatatgcgtattgctcctgagctctatctgaaggaattggttgttggggggctggatcgtgtttatgaaattgggaagcagttcaggaatgaaggaattgacctgacgcacaatcctgaattcacaacatgtgaattttatatggcatatgcagattacaatgacttgatagagcttactgaaaccatgttatctggtgattatctcttgatgtctctgaaacatcttttttttctttttattttaggaagtaatagtatcttcatgtcaattttgtatgcaactgcaaaatgacctaaatgcattttccttgttccgtaggcaattcatgatttgctattgttctgtcatatcatttttttgccgtcctatcttgtttttactgaaatcaacatgaagcagcctgttcattttatctaatgatctgattttatggttgacaggtatggttaaggagttgacaggtggctacaagattaaatatcatgctaacggagttgagaaaccaccaatagagattgatttcacacctcccttcaggtagagacattgggatgtatttggattacatgtattgctctatatgcacttttaactggtaatgttcagttgctacaatgttactttgcctttaccttgctgcagaaagatagacatgattgaagaattagaggctatggctaaactcaatatacctaaagatctctcaagtgatgaagcaaacaagtatttgatagatgcctgtgccaaatatgatgtcaaatgcccacctccccagactacaacacggttgcttgataaggttgtttctttacccactacacattctttttacactgtattttgatatgattttcgttaggtgattttgctatcttataatatcttatttacatatatgataagctagccactttgatatgaagaagaatgtccggtgtaatcctttttgttgcttccataatgtacagtacatttctgaacattttcacattagctcacaaacaaataaaagatctggggtatattgcaaaatccaacctgaagctatttgcttaaattttaatataccttttgcttttgtttcccttttggtattccttagccaaattaataaggtatatgctctgctctaacagctagttggccatttcttggaggagacatgtgtgaatcccacgtttattatcaaccatccagagataatgagtccattggcaaagtggcataggtctcgacctggattgactgagaggtttgagctctttgttaacaagcatgaggtatatactaagtcttcattgatactttcatacttgtcctcctttctgtttccttacagtgttatgaaatccattttttaggtgtgcaatgcatatacagagttaaatgatcctgttgttcagaggcaacggtttgaggaacaactaaaggtacttgttagattttgtgaacatttgcaaattgtatatttttctttggtaccagcctgctcccaagcttcgagttatttttggtattttggaacatctaaatagctttgcatagtatataattgttggaaaccaacctactcccatatgtggtatattttggtccatcattttaaccagcgtactcattatgcttgggagttttggatccatcatatatatacacacacttgtgtttgcattgttaaaagtagtggtaagtcattggaagggtgggatatgaagtgtcaaacagacaaacagagtatggacccttacaccagtggcagatttattgttgcatggtgtttccctagcttcctatgtggcttgctgaaaaactgtacatgttcttacgtatattatgtgccaggatcgtcaatctggtgatgatgaagctatggcattggatgaaacattctgcacagcccttgagtatggcctaccaccgactggtggttggggattgggaattgatcgccttacaatgttgctgactgattctcagaatatcaaggtctaattatttcttcatttgtacttttgttcctggcattttttatttggtctttattcagttgaggtatttaaaatgctcttttgatgcaaattcaggaagttcttctattcccggctatgaagcctcaagattagatatgtccacaaagcaggaacctgtcagaagggtacgtccatatacttctatatcacaaagtaattctttatgttttttgcccttttaagcatttatgaattttcatattgtacatgttctctaaaatgttaaatatccaggacaataataaaaaccatgcacttttttagggctagtagcaatgtagcattatgcgtataacagaactttgtaaagctcagggtttcatgcgcttattcaatcagcactgattcaattgtgtcgaactatggtcataaatgaatgaaatgtgcctcactattttcaacataccattatgtcaatgtttggttgggggttgtgtcgaactatggtcataaatgaatgaaatgtgcctcactatttcaacataccattatgtcaatgtttggttgggagaaactatatttgcattggacatgatttaggatgcaagtttgtctattgaatggtatgtgaaacatttcacagtatctcgttccaaaagaacaagtactgtaaagtttttttgtcatgcatctgtagattttggaaggaaaagactggaatatccctcaactgtagaattttgcccgccctttgtcaaatgccattgtgctaactgtacttctatgctgcagattaaagcagactgaatgctgactgagaggatttcaattggccctcgagatggaggatttgaaggaaacttataattttgttttaattgtgcatgtgaggtttccatgtcctattgtactttatttttggagaacattggtggtcagttaagcaaacagttaatctcgctgcaaagatatcaagcgtaacttataagatgacttaagtttgtgcaatttctgtggccttacttgaaaatgatagcgcgttatttgcggtcttgaattttgattgattttggaatgggtggagctggaaagatgatgctacgttgttggaattttgacgcacaattccctgttcagtaaattaatgtttatttctgcaaaaccaattgatttggttggagaacattggttggccgactgaagaatgtcgaacgtctgctccggtcagggaatgtgcaaattaatcgatgtgatgctgatagcagcgacctgtagtattgcagcctctcatctttttcttatgcttatcagctaaaatttaaatttttaatcttaaatttggagttgattttgaggttgtttttatcgaagtttattttttaagcctttgcttttagacattacgaacacatataattacaaatatgttgtttagcttatttcccaaataagtggaacgtttggggctgttgatcttgccagcttctcacgtagtacactacaacatatcacgcgccaataaaaggcttaggccctgtttagatgggactaaaacttttaagtccctatcatatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattatgcttaaaaaatttgtctcgtgaattagcttttatttatgtaattagttttgtaagtagtctatatttaatactctaaattagtgtctaaagatagggactaaagttaagtccctggatgtaaacaccaccttattaaggagaatgagaaatcatattggataaaagacccctttttaaaagattcgtgtatttattcaatatagatgtatccatgagtcgttgggttcattactgtaagataaactagattgataccccacgcattgttacaggattttatggtggtgataaacaactttgcaaatatatgcttacaaacagaattgaagaatggaaatatcaaaagtagacattcaaaaataataaagtgtaaagttggcatttgagtagtagatggtcaagggacatagcagtggcttaaaccactcacataccatgtataaaatgctaattgaagaggttctattaaagagaatgaagttagtatataacactgtgggagcttgtagcagttgcacctttaagagatgtgaataccacaaatgtactatgtataaaagatctgttaagaagaataaagttaggtatatagccctgtttgagagagtttctatcagctatagcttcttcaagaatctacatctcctcaaaccatccagatttttattcgaaacttgagaatatggagcctcaacaagacattaatttgtttttgctaatttcgaaaaagaaccccacaaaattctgaacaaaaacatttgaaatgaacctcaagatctcattccaaacttgcttgagatgctcgaaatatgtaaaatttgagtgagatctcatgaaattgtgaacgcctgatgggatgttggagagatagatgagtgcttgggtacgtggacagggaggggaaaaaaagagaggaatagttggtagttcatatggatgcgcacatcctcacccttgttgaggtggaattcacttctatgtacaattgcaattaagctctatatcctttccaattaaagatgtccaattccaatattcttaatctaaatgttctaccttttgttgagtggaacatagatgcttcatcggcagagaacaaatgctaatcttcgtatgtccaactagcaatcttttgtaatagcacctatacatggttgttgtaatttatgtcagtgatgatatactgatctccactattacaatattctagtatatatgcaaatcaggatcagtcttaatcagagtgttctaattaattaatactaggcctttttgagttaagtgaccaccctataaaaggccctcaaaccaaccaattattttactaacacatttggtttagccataaaaagtgttaactgtttagggcacccgcaatgattatctataggctctctacaagagatccatgtcagcatatttttctacttggaagagattaaatgaagagagagagcaaaactatctactaacctggagatagtctatagagaaaaacgagacaatggattagagagctatagataccgttgtagacataccattgaagtggtttactattaatctagtctattgctgagatgtacatgttttatagatagcaacttactttaccattgcgggtgctcttaggataggttattaatcataacaaattattcgtgcacattgattaccccaaagtctataattgttaatacagggaaggacttgcacttgcttttctgggcgtggggacaggagaaaggtgccaactgccaagtgtagtggccggagaagtggagatctcatttgtcggtgcagaacttgtggtgcaagctccatccgtagctagggccatagaaaaagcgttcttgtccataattcgatcccagtggcctctctgacacgcagcacattgcggattcgcggttggctctttccttcacggttacgaaggctgtctcatctcctcgtggaaaaacattattcagcgtgtgttttttggtcctattattgatcgatcatgcagctcgcatcacggtccatcaagctttgatgcctcactgtccatcaagcttgttgttgtccatgccggattgccggtcgatcgtacgggtcttgctagttgcatgcatgtgaacctaacacattcatcccgcatagagaacaagataacttttggctgcgttctttgctgggaactcccaactccccaccatcgttttctgcatgcacgcttttcaaattttattttacaaaaaagtttctatacgaaagttgcttaaaaaattatattgatctttttttaaaaaaaaatagctaatacttaattaatcacgtgttaatgtgaacatcgttttgcgtgccaaagaggaggggttcccagcccctcctcctgaacgcagcctaattactcctttcttcccataaagattttattttttgggtttttatctaacgtttggccatccatcttattttaaaaaattatgtatttttttaaaaaaataatcagcatatacttcctccgtctcatgaaaaacaaaactaaaactagaacatgttgtgacatacttcctctatttcaaaatataagacataaccacccttaacctaaagatcaagaaataattattatcacctcatcgtttagattacctaataaatagaacgcatgcacctaataaaattagagatcttgatggtggaggatttaaataataatattttagtggaaaatgtgtgctagttaatgacatgcatgcatgcatgtcttatattatgaaaacaatttttaaaagtagttgtgtcttatattatagaatgcagggagtattctagtggtaggatgtgtcacatcctgttcaaggtttgttttttttttaaacggagagggtaactagttacgtataagttaaaaataaaaatgaatcaatatgatttttcaaagcatcttttctatagaccttttttaaaaaaacatattattccacctcttagcaattgggaaaacacgcacacaaaacgagggagtagaagagtattctgaacacagccttagagtaagtttaatagtatagcccactattagctccaattcatctatagccaatgtaatagccaattaatacaatagttacttactatactattaatatatggtcccacctgtcatacacacactgcgtcttggagtccgtgctgcagctggctacaaatctatagcccactgccttctctctcatcttttatctcattaaaatatggctaatagtatgctattgtacctgctcttataagttcgtttccactacaagcagtggataaagttttggattttcgtggtacgcttttcaaactgataaacagtgtgtttcgtgcgaaaattttctatatgaaagttgttctataatatcagattaatccatttttcaagtttataataattaaaactcaattaattatatgttattaccacctcgttttacgtgaaacacttaatttttatcttcgtctttatcttcgtaagattcaaacaccaccatactagttgaaatggagcactttttatatattagtaaacgggattgtacagtaggacgcaaatcgtctgtccattaaacaacaggcccgagaagaaggatgatggggccggacggccggtccggggaagtcgcccgtcacaatccgaaaagcgcaaggaggaaaacgtgagcaagcgaaaccgaacaaccaaccaagcaagccatgcacgcgcgcccgcacgctgacgcggcgccgtgtcgtgacgcgccccccggaattagcaccagccgcgcgcgggggcgccaccaccggatcagttcccccatccgcggggcccgggcccagatcacgcgccgtgacctgacctgacctggccccgcacgccacggccacggtgggcggatatgccgcgcgcacggccgcggcaccgcccggatatgccgttttcccctctgtcgcccgcgagcagatcacgcgggagcgcggcagccaacccgaaaaggcccgggaatatgcccacggcggtggtggctatcgataaacgaggatggagaaaaggcgggggtttggtttggactttctgccaccgaccgctgctttttagtacgcgatctcgaactcgagatcccttttgcaatctcgtcgaaaacggctctcggtttcacatacacccaactagtcgtcctaccttgttataatcactactaatcaatgaacacacagggagttaattagtagtagtagtaataaactaacaaactactaacacacaacttgatgattagtagccgttcttaatcaggcacgcgtatctcgtgtggccaggaggaggaagaagagcaaaaatcgcaaatccggaaactggagtagcagcatcagcagtagcagtactaaacttgtactgcaacacatggcaagcagccagggagagagaagaagaagatagagatagggacagagagagcctgtactgcactgcactgctgcctagcctatctatccatccccatcgccacatgcctctcctgcagctgcggcctgcggccaactcgtagtactcctataaggcaaggcctcgctaccccaaccgtcccctttcgcctccgcgtttcatctcctcgcctcgtctcgcctcgcctattggccgcccgctccccgcatcctcccatctcgccgcgttatcgccttccgcctcctcctccgccgccgcctacgcttctcgccgccgccgccgccgcctacgcttatcttgttgtgctggttgcatgcgccgcggcgcaggggctgacggagaggggtgcgcgtggaattgagaggagtggcggatggaggcggtggaggagcaggtggcgccggagcaggtcatcagcacgaggggaggctcggtgctcgggaagaagaccatcctcaagagcgaccacttccccggctgccagaacaagcgcctctcgccgcaaatcgacggcgcgcccaattatcgccaggtgcgttgctcctcgttcctaatctagtaataatctggatggtttccggatcagtccgccgcgcgccgcgaattccttggtttccctggcccccccattccatgcgttcgcgacgggaatctgcagcaatttttggctccaatcttcacgaccacggaagaaacctgccttgcctgtttatgtctcttacatgttttgtgcgctgattgtctgctttatcggtaaccttgtgcagcatgaccgattcttatgtgcgcatcctatgataattttggtgttctttccggaagtgcctttacttgttttcagaatagtaaatgtaaatctcaaaataaattagtacaagaatgttaacacttaatgctatgcaaattgcatttggatttcttgatgatttttgttgatcacactgatgaacatgagcattaacacttccaatgcatatctatctgggctgtttctgctaaggcatcatagtcttcgatgatagaagatataacatttaaagaaaaacaatgtgaaggccgcatggaactttgtatgaactaaacaatccatctgacgtgtttattataaactcttgaatgaatagtcctacaaaatgtgttctccaatttgtaattttcttgtgtcctttttatccagtaaagattcagcaacagcctgggttctcaatcatctataattttctgtcatttactcactgttgccaactgtttttcaggcgggttctttacgagttcatggtgttgcaatgccgacaatgaagggaattgtaaatgtgttaaatcacattggagcacaaaagaaaggaaaacaaacccaggttctatggcatagtcttcgcgaggagccggtaagaacactggtcactgatagaaaattaagcatctctagcataagaacattaaattatgctcaccacttcaaaactacaaaaggttggaaacttggaatgaacaatggattttgaactgtctagaacatccgtttccaattctcagtaggtaggcataaataaataaaaaaacatagagaagagggtgtgtatttttcttaaaaaaatatatgaaaaggtttctaagtaatatgtacttatggaaattacataacttgacatgcatgccttaacagtatgtaaatttcaaatttcaagtgagttctggaccagtttgcttagcttgcagtaagtgtcctttgaacaggttacaccctttccttgttacaacaaatactacttctccctataataggatagagtagtaccttatatcttttttattttatgtttgacaaaaaaggaacttagtaagttgtaatttccaccaatgttgtacaggttatctacatcaatggtcgcccttttgttctgcgagatgttgaaaggcccttctcaaaccttgaatatacggtattctttgatgtttgtcttgaatttttctagtcatgcctagagtgtgtatgcagtatgtctctatgtttcttgtttttgtatgagaagtccatgaaggtgttaaaccaaaaatattttttcttgctaaacatccacagcagaagttatgatacagatgtcctgagacccaggaaaatatatagctctgtttcttaaaggaatgatgatgcattagtgctattgcagacttggaatgcttttcctgttaaatctcattttgatttgggtaattctagatatgttttcaaggctatagaaacatgaaccatattgagaaggcctatcccttcaaaacaactttgattccacatgaagttactattgttctattatcattttatttttccattttaacttttttttttggtatatgtactactactgtagggaattaaccgggaaagagtggaacagatggagtttcgcctgaaagaagatattcttcaggaagcttcacggtacgtcggctgccaatattgttttctacccgtatttactcttaagaggtttgtttgtttgttttacctgaatatttgatggagcagatatggtaataagatcctcgtcactgatgagctgccaaatggtcagatggtggaccagtgggagtcagtggtaactgatacagtcaagacccctcttgaggtaagaatagattcaaggtttggttatattgttttattatttttagtccctttgagaatttgtttcctttgtataggtatatgaggagttgcagcatcaaggataccttgtagattatgagcgtgttcctattactgatgaaaaggccccaaaagaaggagattttgacaatctggttagttctgtatgctttttttgaactgttagttctgcatgttactgttgtttccctatgtgcgagcttttatgtttagttggaaaaggtttaaactaatttgcacagttgataggatccacatttaccagggttcaatcatctatagactccttgtgattaatatggtatactgaaatttggttcatatgatagttgcataacattgaactccactgtttctaacaggtacgccgaatctcccaagttgatatagaaactgaaatcatatttaattgtcaaatggggaggggaaggacaaccactggtatggttatagcaacattgatttatctgaaccggataggatcatcaggtaagtacagactgtaatttgattggtgatattgttgcttcttctacctatatgtacaattgattgataaacagaattctccatacagactgttgcctattttgaaccatcatgtggtgattttgtatttactgagtacaaatctactaaatgcacatcatagatatcttttgcattatattcttacattttgtgcctgtaggttcgtgtttgaattttcttatattgagttgtgccgggtgctattggctgcaggtatccctaggacaagttcaatcgggaaagtcttccattctggaaatgatgtagatgactatatgcctagctcagaagaagctatcctcagaggagaatattctgtcattaggagcttggtacgagttctggaggtaatatcctggatctgttaattcatatcccttttacattagacacttagtgtggtcattttttgatttcatttgttcagggtggtgttgaaggaaaaaggcaagttgacaaagttattgataaatgtgacacgatgcaggtataccattttatgctcttcatgatactaacttaatacagctatattaatatatttgttgttatgacttgttgtgactatggcagaacttaagagaggctattgctacataccgcaatagtattcttcgacaacctgatgagatgaaacgggaggcatcactttccttctttgttgagtacttggaacgttattacttcctcatatgctttgctgtctatgttcattcagtgtgctctgctcaacaatcaaacttttcagaagaagttagtttttctgattggatgagagcaaggcctgaactgtacagcattcttcgaaggtgagccgtggcaccttactataaaaatagtaccatgtacagcttgtaagagtgtatgcaggctaaacatggttctgttttttatacatgagatgagctcttaaaaattaacatgtccattttgttttatatcactatactattcacaagtaaggtggaattcttatattcagtgtaccaatatgtacttactttccttgtaacacattctggactttcattttagatcttgttttagataagatctcaatgcttcttcaatattttgtttggactaattactagggtacacaggcattaatactaggcagcctttgtgtccaagaaatattagtcactgacatttcttgaatcaggtcatcctggtgtcaaaaccatggattgaaaaagtagtcgttggctatttcatggagctaggctcattgcctattccttttcccttctctaatatctttctcaaagtattgtgtgtgtttttgtaatcttcgataagcattaccatcatggttttatccaaattaatttgaactcacctctttatggcttggagaactggaagtaaatagtaaaagatgagctaatcttttagctcttgatcaacatgcaagttggaacaaacaattttacttaaacaacaatggtagttttattatcgagtctatatggcattgaaaatatgaatattgacatgactaactttttgaaaattggttaattcattacaaattcaactttatgaagagataatttaagcatggataaaaaggtcatactttgcacactttcgattttaacagttgtcttgatgagtgtactatgctctctttctgagtcatcatcataacttctgccgtatctcatccaagttatatgatatgatatgattgatatatgaaaatcactacagtaaccagagaccatgtttatctttgcttctcacactttgtatttattgagctcttcataacagcaagagctgtcacaaggcctcaaccttaatttgacaacccattccttgcaccacatgagaaatcacaacattggtgaagtttgtggttcaggagttagtctatagcatgcacaggattaccacattaaaagaaaacaaaatccaggagtaatttgtgaaatttatattggagatcaataagtggtatggatttatagctcaatattacagcgtatttactgtgtgtatttgaagaattaccgcgtttgttttaattaaatgtaatcagtcaatttactgtgcgaaccctaatattaaaacggttttttgtatacatgacactagagaagtgctctcatcttcgttctttgatgtgttcccatatctgtccttcaaaaataagggaggaaatgaaggataaaacagatcccttctccaacttaggcattttgcattttaccattcatcacaaggatcttctaggcatgaatataccatataaatattgggaaatggattttatgcacatagtgcatatgcacctatttaactgtaaactgaaatcttacttaaagtttaaaaggtcattgttttcatagaggacaaggtggtgtggctacatgtactggcttctatagctttgtttcatatggttgctgcttcacggaaacctgctttagccactatagcgtgtagcagcacatgagtacaaaggcatttcatgattccatatgagccatgcattgcatgtggagtcctgatgcaaatttcatgttataatcatacaatgtcaaagggtaaagagcagaaaggttatattactctatttccaccatacactctgcatgcttttaaaacactggaaagtgtgtatgatgatgcatattcaaggacaccgtataaaattatccattttagtaagagcatcagtaactttttgtcttttggcataaccagtaaactcatatttttacattttgataatttcaggctgttgaggagagatccaatgggcgctcttggttattcaagttcgaaaccctctcttgcaaaaattgttgaatatgctgatggacgccctcatgagatggatattgttgctgccatgagaaatggagaagttcttggacgccaaactgtgttaaaaagtgaccactgcccaggttgtcacaaccttcatttacccgaaagagtggagggtgcacctaattttagggaaattcctgaatttccggtttatggtgttgcaaaccctactgttgatggcattcgagctgttattcagcgtattagtacaagcaagggagggcgaccaattctgtggcataatatgagagaagaaccagttatttatataaatgggaagccatttgtactacgtgaagtggaaagaccatacaagaatatgctggagtacacggtatgcatcatgtctggttgctttgacagatttgtaacatagtggatgctcaagattatttgctctaaccctaggttaattttgcacctgatctaacatagacttgtaatttttttccttcctgatgtatcagagtgcaccaatgggaaaactctcataagttattttgaatattaatatccatagctaagctaactatatttgtttcttttaactacttaacttttaatctgaagtaactgtccaaaggacttgttctaattctggttttatgaaaactttagttctttgttcagtttttggaatttgtatacttgtctactattgtgtttcgttgtgcttaataaactaatacttgaagcatgtgctctgttgagcttattcccaaaactgttctgttggtctaaatgatacacaatgcaccaacaccagggaattgatcgtgatagggtggaacgaatggaagctcgtttgaaggaggatattttacgggaagcggaacgctatagtggggccataatggttattcatgaaactgacaatggtgagatatttgatgcatgggaaaatgtaaataatgaagctgtcctgactccattggaggtgtacaaacttctggagtctgaaggtcttccaatcaagtatgctcgagtgccaatcactgatggcaaagcccccaaaagttcagattttgacacaataaccttaaatgtggcagctgctcacaaggatactgcatttgtttttaattgccaggtactgcacttcatttgttttattagtccagaattctatgttaggcaactcttgaattatatgaaaggctacaaaggttgagtttaacttactgatttttgtagatgggcaggggaagaacaactacaggtactgtgattgcttgtctgctgagattgcgaattgatcatggcagacctattagattgccagcttgtgaatataaccatgaagatccaaatgaattgggttactcaagtggagaagaaacaacggatcacaatggtcaccttaattcaagttcaccaagacctcatactgtgacagaacaacatcctagatttggaattgatgacatacttgttttgcggaagattacaagattatttgacaacggaatcgagtgtagacaaactttggataatgttattgacaaatgctcggctttacagaatattcgccaggctgttttgcagtacacaaaagtaattaaccaacagcatgtggagcaaagagttaagagggttgcattaaatcgtggtgctgaatatttggagaggtacttgaaattagttgcattctcagcatatctttggagtgaagcatttgatggtttctgcgggcaaggagaggcaaagatgtcatttaaagcatggatacaccagaggccagagatccaaagcatgaaatggagcatacggttacgacctgggcgttttttcactgttaatgtaaatatcctcatctcttctaaccaaaaatatcatttttgcacctttgaggaaatggcaccattagttataatttactatttgtaggatgaatccaaagcatcttttcagccttcacaaggtgacgtaatgatggaagccattgtcaaagctcgtaatggttctgttttgggaaagggatcaatactcaaaatgtacttctttcctggacagaaaaggtcaagcactattaacttctgtggtgcaccacaagttttcaaggtatttttatttgtaacaaaaatttgcatttaatagttgcctattcaatgcatatgcattttttaatctagttattcatgttattgatcaattctgccaattaaactctgccattcgaactttctgacccatcataggtaattggtagtagcgaacaaatatttctgtctacactccatggtgcagttatttctgcaaaaacataattgagtcatcaatatttctgcctcagtaacaaacaggatttccaaattttggagctttgatgttgtgcctcctgcttaacactaacagtggcaaagatatttttagtatgttttgatggagcatcagctttggtggaagcatgctattgcaatagtttatttgtttgtttggccttctttatgatcttctatcattcgaccatttgatttgcaatttagtttacagacttgcaaaatgcccattctagtacatgaacttatgtagtccatgcgaataaagccaagctgcacaccatggttaattttgtggagttggacagtgattaggatgccatgcagatgtataaatgaggaagagtcataggaacatacatgttcaatcaaccgtatgataatgcatgatggttgtacaataaaatagtacattgtatagaaataattgaagaatgtatggataggaatagatgaaggacaaaaaagccaaaaacaaggagttatttgatataacatgtaacacacggtccttacatgtgcacgtgggccatgacatggcgccctaatcatcacccatttcatcaagattagctacggtatgccgttttggccttggttagttggtttgcatgcactacacttcttacaccaaaatgaacactttataagtttgtgtacttacccccacctcacaaattcagatatcgccagcgtaatttactcatgttatatcttatatgacacatgactttagtagagctttcatgtcttagtgatgtagacaaaagattagtttggtagcacctgcacttcaaagtccaaattctgggaattttcgctcttcatgcttccagtgtttaagtgttaatttatggacaatatcgttcttgttccattacttttcaccgaatcctcccagctgtaaaggtcagcttaccatcccaatcatgggtgatgtatgagttgtacaattccatttctagatgactctagagtctagagccaaagtgcaaacttttgtttgcgaaaaggaacgggatgaattttgccctggtggtttttacagcatcatgctcgtcgtaatttgtccctcctgcaccaccttgcctttgcaccatccaattccaaagccacagcatgggtcaggccaggatcatgcgatttgcttgcattcttctatgtccatccctattggctactgtttgctaaatgaacttgcatcaagctagtgcctatgcaatgctcccactagaatgtgaggctgatcctagttaacatcatgcaacaccacagttgaactgctataactgtcatggctcatttcaatggttcttgtgatgaagtaagaaaatcacttctaataaaataaatgctaccaattccaacctaatcccactgagatttgtttttattatccagtttcaaagaaatacttgtgaacagatggctattacattatctcaataaagagcgatgatgttagccaaaagattggtaatgtttgcatttcaagatgtttgatgtcagagccacatcatgaaattctggattaaacattcatttcatttacgtgcagtgggtgtgaaaacctatactatttctcacttctgtgtgctacttatactagttgtaaagaaaattagtagttgcatttcttctggcaacagaggtagtgcatgtactaaatggaagtttcacttttagaaaactgattttataataaaggattacttagtcatgtaccttattatattttttaatattcctttcaggttgatggataccctgtgtatagcatggcgacaccaactgttgatggagcaaaagaagttctgtcatatttgggctctaaagatactgggagaagcattcctcaaaaggtggttgtcacggatcttagggaggaagtggttgtttacatcaagggaacaccttttgttttgagagaactagatcagcctgttgatactcttaagcatgttggcataagtgggccaatggtgagtttcctccaataatgtaaatattattttcatggcaaaccttaaatgatcttctatgcaggttgaaaacatagaggcaagactaaaggaggatatactctccgaagttaaacaacaaggtggtcggctacttctgcaccaagaagaatttaactcgtcaacaggccaaagtagtgttgtaggtttttgggaacatataggtacggaggatgtgatgacaccggctgaagtatatagtgtactgagaaatcaggggtactgtatcgactacaaaagaatacctctcaccagggaaagagaagcattagcttctgatgtagatgcaatacaatcgtcggttgatgagtatgtgccctaatccacaacttgatatagcttgacaaattgtgttactcagttgcaggctataagaatgatttgcttctctacaggaatgctaggtactacctctttatttcacacacaggatatggtggtgttgcttatgcaatggccattacatgcctgggactgggagcagatgaaaagttcatcatggaacaaacagcagaaacacacttcatatcaacttctcttacaaaaagtgtgtctatcaaaacatcagctgatatagctctcaagcaaggtgactaccgtgacatattaaaccttacaagggtactggtacatggcccaaaatgcaaagaagaggttgacactgttattgacaggtattgtgcaggtttttacttcattcaggcatttatgtaaattaatcaatgaatcatagttatgaactaacggggaacttatattagtttagtcatagatgttactcgtgtgattattgctatgcatattctgaaaaccaatctctcatgaaggtgtgttggtgctgggcatttgcgggaggatattatgcattacagaaaggcactgcaagattgttcacttgatgatgatgagacatggtcatatctaatggatatgggcactaaagctttgaggtaattttcatataggattttctcgattacactgctttctcttcatgcttagaaaagccacagtagtttaaatgtgcacgccccttgcatttacatttgtattgagtaattgactatgcaaatttgttaatggatagagtttgtcctgcttcggcaatttattcggagtgcacactccatttcatgagaatcttctatgcatcatgcaaagtacttactgtatttactgcaattttcatagttcgtatgtagatagcataacagttatatgaacaatcacgcataaaaaattgatcacgatactttattcatatgcagtttgaatgcattagagaactcatattcagggattgaaaaaggaatctcgacttggctgatcaaaaaccaccactttctttaagtgtatttcttcaacactaagcactctgcatgcgtgcagtggatgtctacaaatatagcatagtttctaaaatttaaaaactagaaaacaaattgcacaagtattcatatttagatcaaaatagtgttagtttttgggcacccaagatatagtcacttcaggaggttgctcggtttagttaaatgctaaacagttgcttgatcaaaaagaatgacactgcacaaaattaaggggaaagcacttgtcctgtggaatgtaacaaaaaatctaagagacattttctttgaagaaatatgttgggtttttctgagctgaataaatacaagctatatgtatagcattgtgtttgggtgtagcagtatcctagacggtcggtcctacatgtttacagtatcctataggctgtgtcctaggagtatatgtttccagttccagatggtcaatctcttcccaatatgtttccaaattattaatattatgatttcaactgtttaactgcaggcggtacttcttcctgatcaccttccgatcctacctctactgttcatctttgcgtgagccaacatttgcatcatggatggaggccaggcctgaacttggccatctctgcgataatctaaaactggataaatagatatatgagttatctctccattggatcattgaacagcttgctagttcgtggacttgaggaagatagggctgaaataatttcttaggaaggaggaaacataagaaccggcagaaaggagtagttcgtaggacattttaccagacttgttggcgccaattggcaccagcaaggatgtatatataattccgaggttaaattgtagaggaacatagctgaggttactagttttgtttttctccgtttattttgcaataaatgttatgtaatttgtttatatatatgcatatccttgttctgtctgcttctttatcagtaactcaaaactgttgccacatacggatattgtaatacgagctgtattatgcaagtgtacagtacattgtaaaaaatatatataggaaaagtttcgaaaagaatatactcctatatgggtgaaccgtcatccgcacactagcataaatttaaaaattggaataatatacatccagataactaagcgtgatatattcctagatttttcttttgcacgagcaaatctatactttctattttctatatagttgtaacttaataggtctaaaatttaagatgtaaatatgctacttcatcatctacaagcaataattctacttcatcatctactagcaataattataaacaaagctcatgcatgcaacatcatctacaattcatcgaattctacaaatcaatatttaagcatatcaaataatcaccttttcatattattttcacaatattttcaacataaatatgaatgatttttataatacttaacatatatttatccatataatcaaagcgcgagatatcatatttcatctgtaatctcctatcggtcttaaatttatttctctttgaacatagtttgtgaaagggtcaattaggcctagagagggggtgaataggctaatttaaaactttatacggaagctaaaactgagttagggtcggaaagtctgatccacagtcagactatccgaaaatatcagatagtctgatgttggatcagactgtctgatccactaaagagtcacaacaagcagatctagcacacaaacaagagtatagcgcaaacagcgaatagatctatagcagcacaattaagcaaagctaaagagaagatgaagagatatcaccaacaatgaagttcacggagttgttcccggagttcaaatctttgaggggatattactctccgttgaggagctcactaagagccgggtctttgctaaccctttcctcaagaggttgcactaagcactccttcttccactaaggggtatctctttccttgtggaggtgagatccaaccttcacaaacttctcccggccaaccacacgtagatcggtggctcgggagtgacacctagccgtctaggagtcctcaacctccaagaataacaaacaccacacaactcttggtcaaaccctagtgctcaagatcgagtgaaacacacactaggccctcaaacaccaaatccacaaccaccaagatccaccacacaaagaacaaggagggatttgagtgagggaggaagagttcaaagatccaaagcaccttagcaccaagctcaaccctaaagtgaatgtgaatgaatgagttgggtaaccctagaaaagggttaggtggggggtatttatagatcccccaaaatgtggccgttgggaagggaatcttttcatcccacctcggaaagtccgaggtgacatcggataatccgatgtttttgaccccccccagcaagccaaagacagagaacgaaattctggagaatttcggacaatccgatcgatcggatagtccgatgtcatatcggatattccgttatttttgagtcatgaatttcatcctctcacatagactcaagttccattgagttttggagtctctgggtcatcggatactccgatcacatcggatagtctgatttgaaattcactcaagaggaataaaaagcaattcaaaaccgagagtgaagttctgagaaatttcagatagtccgatgtatcggatagtccgaccttatatcggatagtccgatattttatgaccaacactaagaccaaagacagagggcaaagttctgtgaaatttcggatagtctgagcatcggatagtctgatcaagatcggatagtccgacaggaataaaacaggaacacttcaaagaaaggattttgagcactagtgttctaccaattatatgcatgtggtatccctcttaatagtatggcatcccaatactcaagaacacatgatacacaaggtttagagaggtgattaccacacaaattgccacaaagctttctatgcttaagttccactcctttttcatccttgcatacatctcaacaaaaagcattagttatcctctaattgtgttgtcattaacaccaaaacaaatgaggggtcctagatgcactttcagtttggcaaactaatatccgtttcactcttagctcgattattgagtaaagtgcattggaggtccataaacttctgtgggtgtgtcatctaggtcctagaactctcaaaatacatttttgtgtccctcaacttatctcatgtgtcatataggtccaaacgggctccaacccgctccgtgtactgacgtggcatgccatggtggtgacgtggcatatgctatggtggtgcctacgtgtcagtagaaaccatatatcaatcacatatagaaaaaaattaagaacatattttttctcctctcctttttcatttatttttcaaaattaaaaacattattttctcctctctctctctctctctcactctctctcctctctttttaaattttattttttctatgtgactgacatgtggatcgcactgacacgtaagtgtcaccatggcatgccacgtcatctcacgaagtgggttagagctcgtttggacctatatggcacctaagacaagttgagggactcaaaaatagggacctaagtgacatacctgctcaagtttagtgactatccatgcacttcactctaaaaattacttagtaatttccacagcaaaatacggagaatcacctagtaagaaatacggggttgttaagatcaatgtcatttcaaaccgtaccactcttggcaaatttgttagaggtgtgctttcatttaattttttttatcgaactttgttaaataaatatataagaaatcctgccaaaaactgtaataatgcactactgcttatactggtacaatattcagtttccaaaaatcagtactcctagttaacggggaagaaggatgtgagtttaaatacaaatttgaatttcaaatattaaattcaagtttagaatcattctaagcaggactagtagctatggtaaaatccaaatccggcaacagaggccccgttcttgtgagctaacagatggttggcataccgccacacttcccaagttcctagctttacagttttcacaaaaaattttttcatcgacgtttattatgggacatttttcaactttttaatatttaatttatttatttgtgccctcaaataatatttagtttcatccattgtccaccctaactaggagccatatctttacgatgtttgagaatagcacctattgtcaaggaaaatgcctgtcatactaaaagaggagaaaatgtgtaaatgtggtacgtctatagtcattctaatggcctgatggtgaaaaagggaggagttatgaaacaagaccaatgaggcaactaatgacccagtgcaatacgggctcaatttgtagtcattttggtgaaattaatgtgtcatttagggggttgctgctaacttagcaggtggtctttgttgccaaggcaaaagaatggctgtgttgtttggctgggccttggagctattcttatagcttgctcgagagccgggtggttagttttatagtcgggtttgtggttgtggccgttttttagttgtgttcattgtcgagcttgtggcacatatggttgttataatttaataagggtgtatcttgttttgtactcggggttataccctctcttattttaatataatgataaacggatcttttgggtattcaagaaaaaaaaaaaaggtacgtctaatacatgctcgttagctgtctacaaatacgcaaccagctcacgtactgttatccaggaagacttctgaataggcctgtgaacacgttgtaggcttgtaactatgtatagatatggagttggactcaaaatcaacccatgcgtcacgtgccataataattttgaaactcaaatcaacccatgtaccaacctagctaggcgcgtttttcatctcagcaaaccgtattttttaacccacatttgtttaaattttcatgtaaatgttagaaccaaattgaaatgggctgtttgtgcaagcgtggtctagaatcgtctttttaggaaaagttaatatataccaagttttcatacgtaaatcgttttacactaaaaattaaagccgagcccgatttgaatgtgttcgagtatgtttgcacattagattcggatataaatacgttcaggaaataaaatagagattaaaatgctaaaataacagagccagtaaaaaacactaattaaatagacaacggtaaggaatcatttagcaaacctagaggaaattaacaaagaattttttttatttttttaatggaacgaattgacgaacaaaattctacccacattgtccctatttgaaacagctctagccaatattattgaagttggatattcttagatttataaatctatatctagatttgtgtttacattcataatattaatttgaatgaattattttgtttgtgaaaatataaaattctaaatcactacaaattaactaaaaaccctaacgcgttgtttgttttcttgtttagcagttgtaactttctcttttttaagcacattttcaaataaatcttttctatataatagtttttttaaaaaaattcaaataaacacaatttttaagtttgtagtaatcaatattcaattaatcataagctaatggcttacctcattttacatgcaagtggaaattaaaggtaactgctactccctccatcttaatatataactaatttttaggattcaaatttaccccatatataactatttatagctctcttttaacccatcaaccaccctattttctgtagactataagtcctacgtgcatcaatgaaggggttgtttagtatcccatgatgtagcggtttgggctgtgttgcaaagcccaactattttgttgcagcagggaacagcccatcctcctgtagccgctgtagttagtagcggatccagaaaatcgattcattggtgtcataacgtgtctatcggtgtcatagtatactaattatatttagatcacagtgttataacatatgaataagcagttttgctataggttttgccgaaaatcgtcggtgtcgcctgacaccggtcctagtactatagatccgcccctggctgtagttgtaggtgcagcgctgcagcatgttgattctccgaacaactctgaagggtgctatgattttttcgccttcactccttaatccctccaaaattatctagaaatatctatatttcggagaaaggggagtactgctcactagaactgagcttaaatccaacaaacaaagttttagaattcatcaccaatacacacttcttttagaatttgccacccaatttacttttcttttagaatacaacactaggctgcgaattttcttcattatgtgccactccatctaccagcataggttgccccatccttgttaatccgcccggtgttgccgtcgttcatccgtcggtgctgccggcgttgtccaaatttgattagcaaggaaaaagttaaagagggaaatataaaggggcgagataagaaagagaagcaatccaagcaaactaagcatgtaagatgacgtcatcagttgatgaatcaaccaatccaggtccggatggatgccaaaatccatcataggcaaacgacggcaaaagcgcacgtaggttttggttcgaggtaggcccgcaatgtagcaggaagaggacgatggtgtcctggcacaactggcgttgcagaggactatagcgacacagtgatggtggcaaacagacgatgacggtgccacagatggatggactatagcgacacagtgatggtggcaaacagacgatgacggtgccacagatggatggcgatgcagatgatggatgtcgacaacgatgacgccagcggacagagggtgactcgactgatacgagtggtgaacagacgaacaatgacttgtggcttacgcgagcgcggttggtggactaggacgacgcaaccgacgctggcggacaaagtggcgtagaacgaaaaaaattcgtatcctaaattcctaatgtcatagtctgaaaacaacggatagactgataaattctgcagggcgcattgaatgccatattttgaaatttctgcagatacggatcatacggtccagatccttctacgattctccggggattgtccccgttctttttcccgggctggtgggccgtccgttgcgctctcccagagtcccatttgccccctttctccctgtcgagcaccgcttggccgccgtgcggcgaaaccctagcgattgtagcggccggaatcagaggcggcggaagccatggcggacgacgactacaacgacatggacatggggtttgccttactctctactatctcactctctctagtcctttttccgtatgatcatgggaatccaatctagggtttcgataggcatcgcctgttctaataaatttctaatcccagaccggtcgaaccagctctctgtgtaacatgttgcgccggtaggagtctgtgctgggtgattcgttggcgctcctcatcgccatggggagcatttggggtggtgggttcgttgattcgagtcgaagctagttatggcgattgccgcgattcactcgattggtttttggaaaacgagaggtgttaatgttggatgcgtactggtcttcacgggtaaaaggtgtctttggagtttattcttggggcatgttttgatcgttgagtcgagtattattcttagggcatgtttcgttcgttgagtcgagtaatggctcttagaagttgtctgagattagtttgtcagcaacagaaggggatactgtaaagagtgatattctgtttccctgcttgtttggttatggttaggtttagcaggttctttgaaatttaggtttgcttggatgaatcaattgggttaatgcgacaatcccgctcaccaattatgggaattttcattgatgattctataccgctttgtttgagagaaaagaacattgaacgcagtcggggatggggggttctcatgcgtacctcctgcttgctcctttctatggtgacatggacatgaagggattggctagaccgatataggtcaggggagctatgcaattgatgtaataggaggcttggtgcaaatcatttatgcagcagtataaagaaaggggaaaaatatatatgcatataaggaaaacaaggagaaaaatgaaagataaaaatggaaaaaatctattacatattaagatagatggtcattgtactaatatggaatcctaactttgtcacgctagctaaaaacttagaggatctctaacatcttgcttctaattggaacaagaatgtgtggtttcattcttttctgcttaatttactgtggtggcttggcggttaaaacatatgaattagttagttatatgtccattttctcaggaatattcaattttagtgtaattactaaattacacagaccaaagttatgttcattagtgttggtagaagtgaaaattttgaatttcttttacatttcatcctagtgagatatctaccattatccttgcacaactatatgattgctgaagcactgattgttatatgtcattttaaaggattgttttgttggatattgattttggaatggcattgtattttcctctgcaggtatgaggatgagccaccagaacctgagattgaggtacacacattgctatcctcatgcagtgatgttatctgttaatggaaaagaactgatggagttctgttcaataataggaaggggctgaagaggaacctgagaataacgaggatggccctgatgaggttgtaggggcagaggctgaagataaggaacaagaaaaaactcagcgcccacgcaaaacgtcaaagtatatgacaaagtatgagcgtgcccgcatcctgggtacacgtgcattacagataaggtatgtttctatatatcatattgcacagtattgccaatttgatggctaatagtttaccatacagtattaataacccttgctgttgttttatagcatgaatgctccagttatggttgagcttgagggagaaactgatcctcttgaggtaaattctatttttccaaactatacatgcaataggtatttgttcaaacaagcgataacctctacatattcattattttgatttttgccagttccatataccaagcttatattgtacaacttaaataaccttttacaataaacatctgtttccatcatgaagaatgaaaatgaacaatggaattttcttgtttaggcatacaacacctgactgccaactaattaataaaattaacgtttgaatatataattcaacaaagtacacatgtttgatagctgtatgtaattgtgtatagacataggccagcaattcaatcaatagaatgtctttttttcgtcatggagggctgccacgccgagtcagcttgaaatctaaatatgtgactgacaataagttttcgtctgcaattatactagtatgcacaaggttgtatttgtacacatatttctttcatcaaggctctagatactattatttggtagccttgtgattctgtgatttgtttccacaatataaaaacagataggacaaatgttgacaagcaccctgacttgtctatttgaattagttcttctacccagacagaagttattagtcagggctcttatacattgtttttcatggcatttcaaatatcatgaaattgatctagtttatgtggagaacaagtggcaattgattaattctgtattatgttttagtgtttgatagtccaataccaaagattggttttgttgtaacacttgatatattatatggctgctggctggtaaatatgccactgctatccctgaagtgggactttcatacgcattagttccatccttattccaacttctagaaggtttattatatctaaatcggaagagttaaccggaggttttaaaaattctaggaaaaggaaaaggcaggtgccgggttttctttgttcatgccaaactttgttatcatgatggacagagaaaaggaagagatagaagaaatcaattcttccggaatatgaatacaatttttgttgactcccatattgttctcaatcttaaaattttgtatgtttacacgtgtccctcttcctccatgtcatgaaaaattttcacatgtttttagaattccacaagggtcttagattgcttttcccggataaaaaattattttggtatgttttaggcatggtaactgaaatattttggtagagtactcccacaaaaccaagatgagatgaatgttgactgcacttatcaacaactcattataaatactacttagatttcttctctctttctgtcagaaattgtcagttgattttattctatctttcaaattacttgctatgctaaactattgtctttgtgcaaattagattgccatgaaagagctgagagcacgcaagatcccattcacaattaggcggtacttacctgacggaaggtgagatttgaataaaagacatttatgtgtttcctgattttgtaacctcattataatagtttactgtgtgttcaaatatagctatgaggactggggcgttgacgagcttattgtggaggactcctggaaacgccaggttggaggcggctaagctgtgactgaggctactcaaaacgaacagcaatgtgctgcaagttgactttgcccttgtagtaatatggtctgtgcaactccattatgactggatgctgtatcagtgaactggcgtgatgatggcatgccatgttgccttgacatgtatgccttctttccgcagtgtaactgtgactgaaatttgcatggttgcatcagtttgcttggaccatttgcagactttgtcctgtgaatgttcaaggcttaatgcttggttttttttttcttggcctaatttggtagtcgtctagcagacatgagcgacatttttgcagtacgtagacatcagacaaacgggcggatgcctggaattgtgctggaactgaacttaaattccggttgattcgtgttctgggtccatttccacttttccagtataagtatcaaactctgaactgaaggctatatagataaatcagaaaataatttttttttctccttgtttaatcaggagttatcccgtgtttttggaacttttggtcacgtgccgacactttctttgatggtatttgtataggttgatctctattaaattcagagtagttctgtcacaaattaacaaccacatttgtatgaggcctacagttgtgtattcttttcaccaaatgcagcacacatcattccctaataccattctatcacacatctgtgctttcttgtacatcataccgtgtcgcttctttctttttacattgaacaacagtggccactaattacagcttctccttgctaataaaactcgctgagactgtagttcagttcattcctcggaatcggaatccattgggcatgatccgtcatccacggtggcgagtggatcaaacatgtgcgagtttggatccatgcaccctgacacaatgtccagcttgcagcgatctccctgccagtgccaggggatgcagcaacggttcagaactggctaggattaatcatgaatttgagataaaggttaaaagttttaccccctcttcgtagtagctgcccatctcgcagcttgtgatgacaacgttttcgtctgggaagatggctctgtcgcatgccccttctctgttcagttcgtctgctagaccctgcatcgtcgtcacagataatttttaaaataactctctttattagcacaaaaggtgcattctaaaagttaacactgatccaaagaggagtttcaacttttccagtgcataagctatcaagaaatggtaattaacaataaaattggattcaaggtacaaatcaagcttgtttgattgaaaacaacacgaactcggagcaaaattttacctcgttgaagaagctcaagggcttgttgagccatggcttggggaccctgaacttgagggtgtacggtccatcccaatccaccccgtttgtgaaggagaagacgagggtcatggctgcgagtgcaaaaccaaccagacaaaatctcactccgatgacaacatgctattacatacatacagtactagtaacgaatccatggccactcagatgacaacatgctattacatacatacagtactagtaacgatcacttgaacatatggtgtcagcatgatgcaaaagcttaatttaagttaatgagaaattgcaggcgaatcattcatatcttcaacgaaacaaaacaatcagctgctgaccatgctgcggcacacgtatcctgatggtgtatatgggaggatcagctgatcccctctcttgcagcgtcatctgcctcggctcaccaccgcacatgatcggctggttaaaaccacctgcagcaaataaagtctcagttatcaactcctgaatcagattcagatcaaaccaatttgtagcctgaatttttcccggacactgggtgggtgaaaaggagaattaagagggtgctcaattaccattaaacgcgatgccaaactgagcgttgggggtcatcttggtcgctgccgggttgtagaaaaggatcaggccctctccctggtaagaacacagcggcagcttaattagctactatttccatgatgaatctgccaggttgctagtactaccgctgttccatattataagttgcttttgactttctttttcttattattttttaaagtttgaaaatataacaaaattcttaacccaaaacaaacatattatcaaaatatatcaaatgttaattttaatgaaactaattcggtgtacatgttggtaattattttaaaaaaacatagtcaaatttttttaaaaaaatgattaggaaaaaaaaatcaaaatgatttataatataaatcagaaggagtagttgttacatgtatgatgagtgaaagtatttctttttgtgaagaaattaaacttacagccgatggaggaagaccgttcatggtcttccagtagaccggcgccttgcccagctcgaactccgcccatgtcggaagcgagcacctgcaacaaccaatttttttttttaaatcaacacaactttttcatcagccacaaattaaaggggagagctcagtttgtgagttactcactcgttggtctgcggcacggcgggcgccgtggccgcggcaggcgccgcggcggcgcctgtgcggactaccctggccgacgaggaggaggaggagctccggtggcaggtgatggtcgcagcgcttgccggccgccggggacggcgctggacggcgccgccgccggtgctcaggcggctgcaggaagagagcgtggccatcctacagtctacacttgtgaattgtgatagctgatgaaagaaagagaagagaatccgaagtgagtttgcgaaggaggcatatataaggatggatcatgatattatcgtggatggagaggtgaggtgaggtgaggggcttggctgcgcgtgtgtggtggtgaggtggcgacgacgagctggccggggcgtgtggttggattggatgagtattcttctgccttgatttttttccctctttttttttgttattttttcatttttcttgccagccgcctctgttttcttcgctatgggacaagagaacgcgaggctcaagtacattgttaggcgctttagcttttgccctgtagcgggaaagatctccttcgccgctaaaatatctggccttttgcgtacaaatatctcacaatgagagagctggttttacaacccctttcagattatattttgtgtgctttagaaaattttgaaaataatatgttcgatatatagagtatgttgtagtaagactgctttcttctagcgagtttgaagaaagattcatcgtacgcataaaaggataaaactcattaacatattattaattaatcattaatcgttataaacttaaaaaaaagattaatttcgaattttttccttcgaatccaaactttaacttacttgtttttcattagcacacttttaaactactaaatggtgtgttttttctagtaaaaaaagttttatatagaagatgtttgaacaaatcaaattaatctcttttttcaagtttataatgattaatgcttaatcatgtgtagaacttctcttactttttaacaaaatatccatttctctccacggtagctaagtgatcacagtattgcacatctatacttctatatctatactaatataaaaaagaggagttgccccctccaatcctactggtgaaatcatccgaatcaatcactaccgttcatctgcgtctctcctgatccagatcgtccgtccgccatctctcctatccgtccgcttcctcctcctcgcgcgatgagcgtgcgctgaacacgcgggactcgcgctcctccccagcgcttttgctgccgctgccatcacgcgccgattctcctcgccccaccgctgctcccgccggcgctcctcctcctccgccctcttcctcctcgcattccccgttcgccgccttcggagggtcgtccccttccggcgtcgccgccgccgccgccaacacgcgccgcttctactcgctccgcctcgatccaccacttctccatccgtcaatcggctcggtgaaatcatcggccagaaatccatcgctgcatcatccacccaaagccccatccccattctcatccccatcgccatcgtcaatctcgcctccttgatggcgcaatccccgcatcgtcgcaataactgccaaggcaagtatatcatcccctcagcccctcatgccctcgcccttcccccgccgttgtcgccttccaccacccgtatcccgcagcggcgtccgtcgccagctccccttccctgcacgcaggcgctgttggatttggatcgagagccgtcgtccttggatcaaagtcttcgcctcactgccgtcgtcgggcagtggagaagaggagatccagtgtatatgcactgctacagctgtcccaccgcctacggtaccacgtcacgtcaggtggaggaggaaccaaggccatccctcaacacctcaggcacctcatgagttcgactcccacagtgcacgccgccacgtcaggtagaggaggtggtgcttgcgtgtgaatgcaaggtcggtggtgatggcacattgcttggacaccgccatggccccgccctctctacttggtacttgcagtatatggcgatgttgccggatctagcgcatctacacgatggatgaccttgtcatgttcaggagttcaggtgatgttcctccccttctctaaagatttttatctgatgttggtggcgtatggtgtttgattaggggaattgagtggtttgcagtgtgatactgggttcaaccttcctaagaaggagaacggcagctgcggcggccagtataacttggcctcgaaaaaaggtaggtaaccatattatattcatgttgttctcaaagtttgatttattcacatcgaaggagcagccaaggcatgattatggcatttctgattctaatggtactgtgcttgttgtcaattaagattttatttggctaataaaaaaataagtgtatatgcaggtgatttgccaactccaactattcaggtggtactgcccttctctgcagtgacggaggatgaatttcagaagcagttgactcaggacaggttgtgtctcattattaatttaaatcgatctcacctcaacatcataacatcatgtaacttgcagtctgcaccctcgactaattcagacaaacctatcaagcctgatagactttttgattcccaaggatcaatccttttttggctaaattagcacaatagttggttcaagctgggtgccaacaacaatgcttaggaatatacacatctattgatcccttatgtgcaaagttgctctaatggcctcctatgtggatgtactgttgcccagtgatttgctaaagcactttctcctgttttgcacagcgaagtgagtgcttcagcttcagagccatgttcaaagagcttgtgtgttgaaagattgagcaaacgtgaagtgcagaaaaagcattaagaatttttggagtctaaaagaggaaattgtattcattttgtgtgaattgctgtaagttttttttctctgatttactttatgatgcaacatatctctggtgacactatcttctttaaacattttaaatttccctttgccgcaaaacatcacctttgtgaccatgtttttctgtacggtcaatctttttggctacacgactcagctttggcgagaggccgcatgggataaaccaatgtttctatctaaagtgttctttcaaaatcgtttttgtactgaataaaaaatgaagcttaatggatctgaagctatgtacaggaatcagaagggctatttagcagcaactgcagagtaacaacagatgattgtgcctcttctatttgtgctatttaaaaaacacttttttaacaaatttcatattgtccttttgtatagtcagccagatgcagcgtgttgcatgggacatggagcatgcatgttaccatatgcagttcaaggcatgggattagtgagctttaattgggtatcctgctaagattcatttctgaaaaaacatacaagaatgtcgttttcaatcatgctaactgtaatttttttaacaattgggttaagaccaaaataaaatgatataagcctctatttcttctatcagagatctattacaatttttttgggggacaataacgaataaaacaaactggtgaacaattttctttcccttaaatttgtacaaaatttgttgtgtctttgctgattagctgcaattgtgtgaacctggtggctaacgaggaatgatatggtgtttagagataacattgcttactcccttctaatttaactttttcaaattatttctcaactgatgtagtggaaacctctccttccccaaggagaagcagatggaggctctggtggcacgtctgaaggggcaatagcaaggctgcgaccaagatcaagagttggatgatgtttttcctaccaaaaaaagtttgaagtccgtgttaaagtaagagttgtcaatttctgctatgggagttcttacccctttttgtttagtttgtctatcctttaagtgaccctagctggtcgggatgtgtgaccatgtgagacttcccttttgctctgagctcatgtaaaccttgtaatcccagcgaacctgtcgttgtggctttcaatataagctacggggtaggtctgaggaccttcttgaaaaaacatttattcctatgttgaatgaattgtctagaattagatccacaatcttggacacaaggtttgctgctttgcttctcccgtagtaatttacatggtgcacagcttggcactccaggagtacacataacacatgctttttactagggtctatgatactctttttttacctttagaatttgtatggagtgctctatataaaaaaggtacatttattattctattttttttattgtacataataccaaaacatgccttacatgtgcacgataactagtaatctacaatgacacggtccatccatgtttgtttagaatttcttaaattgcacaaataaaattcaaaaaaaaatttgtagcttttcagataatttaattaaaattccggtttgcatcatctgcggatgaacaaagccacaagacttgttgcaaattttccacatcaaacagaatgagaaatgggagacaaaaaactagagctgtctaaggaatagactgttccaatctgtttgtacgatattgctaaaatcttcttcatctatgcgtgtctgaatggctcgatggtggtcatttacaaagtgctactaccttatcccgacagaaatctctggcagctcccttggtatctagttagaaaagagatgtagtacctagctagttagaactttctgtttttttttaatgtggtggcaaaaggacaaatccttgataaattgtacttccactattcacaaatgatcagcatatatggtttgtgtatcgataccatcacacttacacatgtcacttaaattgacatcgattaacatgcaacaccatttcttgtgtcctatatatatgcttcaagggcaatatgcgccaatgatattgcttgcatgcatgcagtcatgcaccacaattacaattagttagtacattgaacaatacatgcaactgattattttatactgcacaggaaaacaaaaagtcacatgtaggaagtaccaaatatactgatcatttctgaataacactgaaaaatttatatgatgataatttgtgaatgaagtgagtccatatcaatcttggcaaatttcccctccctctaataacacgaatattttggtgtatatctcaatgtataccaggtaagacataaatgacaaaattaagttcatttacaatcctaaatatttgttttaaaaaaatgtaataacactaaaattaactctaaaccagacaatattcaacttttaagtttcaatatcgtgcatttttcaactttggcttgaatttagattagttttagatgacatggggaatttttgtagggctgtttttttaattattataaatatagttatttacttcaaaaggactttaaaaactagaacttattttcaagagtatttttaacgtaaagatattaataagctctaataattggcccacagaagatactagtactgaaatatgaacaaaattccgctcaaagaaaacaatattttaggtgaaaactatattccacgacgcaccaaatttatctaggttttcacgaagtgagcgtatcttaactggttaggtttcttgtggtgaaactagctcaccagagttaaaatttagatttaacacgggtgctcgtatttatggctaattgttctttcagtaataggcgacaatgaggcgccggttcgtggtgactttgttaatctcaagatatgctaatccaatcttccagaagtgcttagaggtaggttatacgcgcgtgctcataggggtgagtgtacgcgcattgtggatgtctgcgtttgtattatatttctaaaaagaaaagaatttctcaatcgttcaatgcgcaaaccgtgatgattagacaagcttaaaattaccctatttgacgtttgaagcatagctgcacagagaaatagacctcgtttgacagccatttttgctgctacagattacagccgttttaaactactgcagccgcagctgctgccaaaaaaatctcttccaaacacacccatagatgaatatccatttatctttcccttttcgtacgcttggacattgccatttgccctacataaacacaccactcgtacagtgtacttgattgagttgacagtcatactctactacaacggatgaacatgtggaaatgaagacacaaatccactccctacttgctttcactgtcaagtgggccccgcacgacagtggcgagcgaaacgggagcgtgctttttccatcgtgattccttcaccgtaacgggatcatcggtagtaaggtcttaccgtgcagccaccgccaggtgggccccccgacccgccggcgccgcccactcccgtctcgtctcaaaccccacctcccctagtcccctttcccgacaatggcagcggtgagccgctgaccttgcctctccggcgaccacgatccgccgccgccggccggcgagatggcgccgtggtgccccgccgactcgaccaagccggtcttcgtcgggatctacggcgccgtcatcggcgggttcgccgtctccgcgctcttcttcctcctctcctccttctcctcgctcgccgcgcccccgctccccatccctcccgcgtccgccgccgccgccaacctctcgggcgcagtctccggtgtggcgcagccggagaccatgtacaatcggcccatctggaagcccccgccgcggagggagcggatgcccgcgccgcgcgcgttccgcctcacccgcgagatggtgggcgcccgcgcccgcggcggcgccattgtcgtcaccttcggcaaccacgccttcctcgacttcatcctcacctgggtgcgccacctcacggacctcggcgtcgacagcctcctcgtcggcgccatggacaccaagctgctccgggagctctacctcaggggcgtccccgtcttcgacatgggcagcaggatggccaccgaggacgccgtctggggctcgcccaccttccacaagatgggcagggagaaggtgctgctcatcaacgcgctcctgcccttcggctacgagctgctcatgtgcgacacggacatggtgtggctcaagaacccgctgccctacctcgcccgctaccctgacgcggatctcctcacgtccagcgaccaggtcattcccacggtcaccgatgacagcctggagaactggagggaaggtgaattatctacactttgcaataatgcaccttatctaagtcatatgttgtgacgagatagatggtgtgatgcattctctatttttcgatatttcccagtgctaatctatctacaataatcattgccctgctgtaagatcaggaaatcagaactgcacaatactgagatgaattttcttgaccttttgatactaaattctgaaagtttggaattaattttagttcaacttatgagaatagaactaatttttaaatatttacagtggaatgactctggaattggacttctgttggtgaagacaattgctgtagaatatagcttccaatatgtatcagcaatagcaaatcctagagaattagaacctgatgtgaactaatgttcttgttactgtatttttctgatgttttaaaaaatctgctccaatattttctgtttgcctgtataatattttttttccctgtttacctgtataataagattttttgttctgtttaccatcaattgcagttactatttgaacctaacatattgccttccccccccctttcttatgcacagttactggtgcatacaatatcggtattttccattggcgacccactgaaccagctaagaggctggcaaaagattggaaagacttactcttatctgatgatacgttgtgggaccagaatgcttttaatgaccttatacacaaaaaatttggatacccggttgttggagaagatgaacttgtatattcttatgatgggaaactgaagcttggagtcctaccagcaagtatattctgtagtggtcatacatattttgtgcaggtagttgctcttatttgtttgaaattggcaaattaaatatcttgcatgtcaaaatttttctttggtgagtaaattttcagttagttagcaattgcattttttatctttgttgtcctgcatatgtttggttcttgttcttttgtttcacacactttgtgcatcttgtttatactgtccctttcgtctaaaattctctgtaattttcttgggttgtttatacctgaaatgtatttttttcttgagttgccagggcatgtatcagcagcttcggctagaaccatatgctgtgcatactactttccagtatgcaggtactgtgggaaagcgtcatagattgcgtgaagcaatgcttttctttgatcagccatcatactatgactcaccaggtatgtttattctctgaccctatcatgacggaacttctttgggacagaggttcatgacttcatgtttaaagatcatgatgtgttctagtgtacaaatgccttctgattttatgtttgaagaccatgatgtaccctagtgttaaaatgtttcgtctgtatgggttatctcagaattaccaatggagcactgttaaacaaaccatgtaggctgtagccatatatgatccaagaatgaaaagatggtcacatgaaattattttcatgcatataacattattcggatttgaatcctacaatctttacttactactttttttcatcatgtccataatttacctggtattatgatgcaggaggtttcctatcatttagacccaacattcctaaaagcttgctgttagatggcgctcatactgttaaatctcattttgcattggtcaattaccaggtatctgcagctacacatatatttctgcaaatttgtggctgcacttctgttattgatggttattccttttctttttcctgattagtcatgtgcttgaaaattttcagttgaagcaaataagaactgcactcgctattgcttccctattaaagaggaccctggtcagtggaatttctattctttttctagtttgatttgaactccatgatggtagtgtgaatactacacacttactattcgtgattgtgaggtagtggacatgcagatcattaagtgtaaacatttagttgagattgatttaacctgcaattcgatttcttgaatgtgatctctttccataaactttctatatgttaaaaggttgaaatgattattaatatgttcttatcttttagatgttaattttgtctttactgatgatgtgtgcaccatcttaatttgatacaaaatttacaacttgcaaaagtgcatttatccttaaatgagtaagctgcagctaattagtgagtattgaggtgttgagtagtaatgtatggtaggtgcttcatgcttgcttttttgaggataagtttttatcttagataacttctggaggtgtttgagagcagaattacgctgttcgatgtattgtgctcaaacttgtggacacccaatttctgactactgtttgtacttttaggtaatgcctccattatggtgcaggcttgataggatgtggtttggacatcctggagttttggaaggaacaatgaccagacaacctttcctctgtccaatggatcatgtttttgaggtgattacactgggaatttttttcatttctgttatcataacattatttactatttttcatattatatgacatactattagttggttagagaaatagtttccttagttgtatgaatcatattttgtaggaaattcatcacattttttttttcaaaagtatatatggttagtgaagttaaagtaaattatataactgggatttcatgttatatgtgtcagcataccttagatttttggaaattctctgtagttttagaattttagatgtcattttttttagatgtatccaggtggcaggtggctgaagcttgccatgctttttattgtccaagctttggtggtttggagtttagaccagaccacagtgctatgtactgaaaacttcttttcaacatattattgctgatctggttactgtactgatatgcgttattcattattttgcaaccaccctcagaatgtggcaatgtgcagataaaaattgacatatcgggccattaatatttttcataaatatagcaaaagtaccaccggattaccatcacaggaataacaaatgatgtgtggtcaacttatggttttttgtgggtaaaatgagcatggatactgtgggaaatttgcatagggaagttgaaaaggacaaatatgtgaacaaagctttggtgaaatgctagatatttataagcagatagaatagtgttaatgatggcgtttcataccaactggtcagcaacacaaataaagttgtcttgtattttgcactacataataaacaggccagagaagtccacaggtggatccagtatgaagctaacattcctactacgatgatttaattctacaggtacatgttatgctaaaggacttacctaaggaggagtttggcccacacattgattttagagaatactcgtttcttgagaatccatcattgcctaaacaggtaatgttattattgtacttgttttaacaattcactatgaatatttggtagtaagaaaggtgggtttgccttctaataattattgttttgcatcttgcataggtcaaagaatcatttcttgaggttgagctctgcaatgagcatagcaccagatgctcaacaactaatagaaccaataaaggcgcgcctgttctcttaccaaggaatagcacagaacaaacggtaaatggcattgtttgcacattatgcatgcctaatttatctctcatgtggtcatgcatacaaatatacaacatttagattagaggatacttatttgtcacaacatgagggaactatactagtacccagattataggatttttagaaaaaggaaactcaagctaaagtgagaactggagcaaaaggcatatcatgcaaactcagaattaatgctgtaattttgaagttcgcaaacatgaacattttatttgagacaagactccaattttattaagaaatatgtgtgcgacaagccaacaagtcaccagacaagaggtatcatgccttgatcagctgcaattgctgctgcagctgctgcagccgcagtagttgaaagccgctgcagcaatcacatccgaacacacccgtcattaaaaatcactaaacataaaggtatatcgagacatatacacacctcagataagaggaaacggcataccctgtggaacatagagtaggattcctatactcctagtagcagccattgcctattgcaaggtctgctttatcttttggtatcttatggaaaaatcatattctgaagttgctatttttttttcagcttttggatatattcaaaccatataaggatatcaaaatcttacagttctcatctatggttaacgccttcggaggtttttctgatgcagtaagcttccagtcttcaacaattttgtgctagttctgaataaaaggatgcatagtaactttattgtttaaaccaggctgtggacacgaaatttcggaatcgagtaaagagatatgtgggcctatggtgctgtgtgcagctccgtgaaatagggcacatatattatgacatgtactgggatgagaaaccaggctggaagccccttcctccacagaccaaggtggaggaccatccaccttggttggaggtacaggaatgaggctaactacaatcacggatgttattttttgattcaaaggcaagatagattccttactacagattaactcctattatcatagcagtcactacctgttggaaatccaattgattcttcttgactgcttactgtgaaggaaatagaaatcaaatggcaatcagttttgtagctctgatctttgataggctgattcacttatggtcgatcagtgatcctttgctctgttcttacttcacacagatctctgataaaccgtggtccattcatcttgtgaagataatgttgtagataatgactttgactcagaactgttgcgctatgttcatagttcatacagacattagcttcaaaggagaagatagcttttttatgcaaaatgcctgaattgattgtttgacagttatctggctggtacagaaaaggagtaaacatgcatcattattggctgtgtacttagttagcataaaagggtattttcgttcctaactctccatactttcttgtgtgaaagttaattatttatgcgaactaatcagtagtattcagaagttccatatgtggaacacaagctgatttggagagggagaagggaccatacgtgctcccgattgccgatctatggctcagatccttcagtagttggtccctcccatcccacaaggctacttatcattttcttatctcccaagaccaagggggaaaaaaagaaaaggatcacaggcgacgggttaattgcaatgggcatagattaatctctgcctccaaatcacgagtaatcgagtggataactggatgcttcatcgcggctacattttcatctactttctcattttaaccaatcgtaacatttttcaattaaatttcatcaacttccttaatacttgtgttcaatcctaaaattctttatattttgaaatcatccatgtgctccagccttcaagcctccactctaaatggagtaggaaaacacctactacttgccacgcgttcccacgtgttcctcattgaagcttctccgctggaaggaaggggtagtggtgttgccgagccgtccttcaagtcgagctcgtggccatcagatcacctgaatccggttttccttcttttacttcccttcatctcgcactcacttgacctcgagcttcccatgattcttctttccccaccacggcgagatggctagaagaaaacaataggtcgcagtctttccttctccctgaatgccttggttgtgagaggatctgtccttcttgaaaatttgtggttttcatggggatctttgcctcttttgtgcttttccaatttgctcgccatggggattacaatcgctattggtttgccgcgaggcaggccaaagattggggtttttaaggggtttttggatttgttcatgtgtttgctgcgaggtaggccaaagattgggttttttaaagagttttttttgaatctgttcatgtgtttatgcttcaacttttgtcttttattggctttgtttattgttcttgtcttgtggtgtggtgtatccgatttgcttcattggttgtattcaagctatgaaactctaattttgggaagttcttttataagattgattattgaattattgtgttgttatcacttaatgaacacatcttgctttcctgtctccgattcagagaatgcaaaggaaacgcttcatgtggggataacgtgtgaggaaaaaacaccttgcaagtgttgggacaaacgaagggagcaaaagaggattgagacggacataagcatattagaacgatcggaaagttaccagattaagtagttaagataagcattggtcccgctattttcttttctatttttgccactttgttgacatggcactactattgcccttcttctctgactcgcttccccaacccatttccctctctataccaggatgagaaggtaggagatgaatcaatgatgatgaggggtggtgacaggccgatcatagtgggtgcgtacgctagatccatgcgacaatggaggaggtgcttgccaccttcaagcccatgccgtcactcctacacaccaccacccttaccatccttcgggtttgtgatatgagtaggggtggcccgaccttacagtgagctaaagataactattatttgagagagagaagttgatgaccaaactataatcgtactagatgttagatgttgtattgcgctttagtgactaatacatctctctatgggttgttgattttacaaaaacagatataccttgcaggggcaggcctacaacaattcaagggtattcaaattaaatacccaagaattttggcaaaaaaatagatatatatatactatatattttatatgtatattaaaaaatttaaagaaaagacatcaaacaacccatcaagcaaagaaaccatcctttttaggccgtgtcctccccttctttgttggcccattagcacaattgattcactccattttacccaaccaaaaattctatatacatgaacttatgctcaattttgtgttatatatgtcttattagtttgtgatattatataggcaaaatttgctaaaggatactcaaaaaacgtgtaattagctatgacatcgtaaaaacgtgacgcggctgatagacactacaaaaattgcgtaattagctgtaggacaccggatacaatattttataattttcgagtcaaaagaggtgagaaattttttaaaatgacaagattgcccctggcacctcacctctcctctccagctcgctcacgtacagcatggagcgcggcgggtgcgcgtccagccaggcgcggtccggaccgtataggcacacgaaatggcggtactgttccgccgccgtcctcaccgtggtgagcttgtgcagcggcccgacggcgaaggttgacttggacagcttggcctcgatcttgcccagctctgacgcctcgaaggcgttgaacatgttgaccacgaccccagacgccgaatctcgcatcgtgtcggcctgggtgctggcggcggcgggggcggggtagaggagcgtttagttgatggactgcgcgccagtgtggggccacgcgtcgacgcgcggccgcagcgcggagatgaaggacgcgtgcgccgccgtgccgcggttcgcggacgtgccggtgcggctgctcactaaccggcgcaggtgcgcgacctggacgggctgggcctcgacgccgacgcactccggctgccggcccacctcttcagcgttttcgatggccacggcaacgccgaggtaagcatgtgcttggaacgatccgaaacgtccggattggtcactggtggcgcagccaacctcaggattaatttgactgattccgtggcattgtgttgctgtgcaggtggtgaactactgccgtgaaaggatccacgtcgtgttgagcgaggagctgaggatacagatggtgccgcacggatgtaaccggagcgccgccgccagcgcccaggccgcgccgccgtcaccgacgaataggtggctcgggctgatggtgtctctgaagtagggtgtcaggaagtaggagaacttggagttgagctggctgtcgagctcgatgatgccggaggcgccgttgagcgctcccggcgcgagatcctcgtctggctaacgcagccgaaggcgagggtcaccgtcgtccccgacgacgggaacgtgaacgcgtcagtgcccagaacgctgagctctacgccggcgccgtaggttgccacgaccacgcacacgtcgtcgctgccgcgcgcgcaccttgccttctctggcgcgacgccgcacagggcgccgtcgtcgcacggcaccgcccggacggtgcgcgacagggaggagttgtagtaggggaggtaacgagggaagcagccaccggtggcgggaaggcggcaggcggagcactgcgtctagatgaggtcgctgccggtgtcgacgatggcctccgccggctgcggcgggtcgccgatgctgtagttggcgatgtactgcgttttgtcgtccatgcggatcaggtctcacacacggagcggctcgagctctggcaccgcctcatccagctgctctcctgcaggacgcaaggctaggcggaggcaaggcggaggcggtcgcgcgcgaggcggcggcggcgcttcgtgacaacggcggtagcggcaagctggcgctgtgggagcaggaggcgcccgcggtcgagaggcagcggcggcgctccgtgacaggcgagcgagctggagaggagaggtgaggtgccaggggcaatctcgccattttgaaaaatttcttacctcttttgactcggaaattataaaatattgcctccggtgtcctacagctaattacataatttttgtagtgtctatcagccgcgtcacgtttttgcgatgtctcacagccaattacacgttttttgagtgtcctgtaataaattttgcctattatataagccaattattaggatttttgagtgtagaaatatttccccctctttattttgaatacccaaccttaaaattctgggcccgcccctgataccttgttcctacaaaaaaatcgaaaaacaagcaagaacaagataaacacagtctaaattgcaaataggaattaaagctcatgacgaataaaacactcccaaaggtggtttcagaaatcgagtaactagatgatctggccaaaacacacaattacaaagaaagtagtaatgactaaactataatctaaacaaaacccgagaaaccctgaaagggtatctagctatttaaggaggtgtgaggactaccaacgagtccctagggccatacttcaccgggttaggcacactcctctggggtttcagacgaagtcataagcccgtagacccatgattggtggtacaacactttgtttcctccattacggttgagttatatgaaatttggttctaaggtggtccattgaaaagaggactccaacagatttgcatcaagtactcaaggacctaaaatagagcttgtatgtggtcattcaaagtcacaattgtcttttgtaggtcgatctagatttcataacatggcctgcttgaactctttctttgcttcagccatggatgacgtggtggcaccaaggaagacttgtataaggccgtcacttggtccccaaatcaacatttttttattttccatgcatgcttttgcacttcctttcttttcctttaatcccacttatgaaattgaaaacacacaaaaactcaagttgtagtatccttttcaaatatatggaaattaaacctaaccaaaaaaattattacctttggtatggaatcagtgagtagcccaacagctgttggtgcaagtgagatgcaggaggacgccgggtgggaagtgagcaaacagacgataccgatgggaggtggaaggaggcagccggcgatgagtgggaggttggagcaaggggcaccgggagggaggcaagaggcggcatgcgccagtgcggaccagctgcaatagagggcttgctatgaggagagattatatgaatatgtgctgagcacagctagcggaggactgcgacgatgagcaattcgtggcttgcgagctgagtcatgagaagtagaagcattgcttggcagcgtgccacgtgcgattaagggatcaatcgaaggcctagggttttcttgatacttgtatggttactcctccactgcacgggccttggtgggtttcttttggagtgaactattaactatttagagcacatttcacaattttcgggggcccacaggtgaaactttcaaccttccctcatccccccttggatttagggccccgcctcgacaaactatgggtgaggaatttgtatggcaaatagtaaaaaaaaatcctaatagagacatggaaagtactacacatctcacgtgcaactcaatacctctccaagaagaatgtgattgcaatttgcataacattaactccattagagatgaacattttgaatcgtgatatggtgtatcattagttcatcttttaggctagttctgacataaactcaaagctaatataatcctggctagtatccttgatgtggatggaggaggtctgttgttcacgtctttgtgatgagagagatccatcatccgtgtcgttatcctccaggtagatgttgtagattgataaaaagatcccattcgaggtagagaaaaggaaaatgctttttttggaccaacaaaagcatttgagccatcgatgaagaaaggatagcgcggaagtacaatgcaaatgcacacgtgacacatccatgtcctacacacacccatgtggttgtgtcctaacacttgtctaaaaaagattagcggctaagtcacataatcgattagaaattaatgatagagaaaaactaatctgaattatctcctgaacttttactcttgtagtgtaatttacctattgaattacaacaacacatatttttttactccttatattttactccatatccatgttcttaccccaaccgttgttggatcttgaattttccatcacggggctacccccttaaaataataaggtggcggagggccgtggatagggatggcaattgtgcccgtttgcccgtttacctgcgggtaaaatccctattagggttgggtttgttctccattttatacccatgggtatcttattgggtcaaaagctatgcccgatgggtaaatgggcatgggtataggtaatcactacccatgcccgctttgcccgtttatccgcgaaatctaacttacatgtaggctaggagcaaaatccactagaatacataagccacgttctttcttttctacggtttcccttttatttcccttattatttctctcctcttactctatcgctgccagaggagagacacgacaccgaggcggagaatatttgatgttttaagttcgattcgaacttagtagcttgtagactttttgttccactgcttttgttgtggcgggtaaacgggcacgtccgtgggcataaggcgcccgcgggcaatgggcatgggcaaccatccttacccgtcatgtagtaatgggtatacccacgggcacaaataatctcacaggcatgggtatggataggcacttcccgtgcccgtcgcgcccgattgccatccctaaccgtggagaatggcaagactagttgttggctcttgtagcaatcagagccaactcgcagaggactcagcgcgggtgacggtgaactcactgtggaggtagcatgggcggcttcaagctcacagtggaggccgcacgaccgatgacaagctccatgaccttacaccactagcctccgctagctccgtcgccacgcatcacctcttgtaccttggtgtcgcgctcctccactagctccgccaccatgagtcacattcactaactccacacgatcgcgtgtcctcctccccacccaccctcaacctcatcatcgcttgcctagcttgcgttccttggtgtgcaaccaccatcgagatcaagagagagagagagagagagagagaagaagaagaagaagaagaagaagaagaagaagaagaaggtcgatggtgaataggatggcaacaaactagccattgctgatctttgtgtcgaggaggccggatcgccgttggagggggagagagatggggaggaagaaggtgatgacaagtgggtgctataaatttattattattatttgactgggaattgccacattggtgccatgtgtgctaacttggaccaaaaccataaaaaaataatgctcaaggggttaaatcgtttggtgccaaaaattagagaatgatgtctgatattgaatgtagttcatggggtaaatcaaactaatgcaacaatttaatggggtaattcgaactttcactaccacaaaaaagatttttatgaacccccgtatttttaccaacgggctagaaaggcattcgtttgcaaaaatatgtaagaggtgtccggtcaaggctcacttacaaaaaatgattttcatatacggtcatcttaacaggtccgcttgtaaaagtaggcgtatttttacggcttgcttttacaagtgacactcttaagacaaccacatgtgaaaaatcatattttttaaacctaagaggcccacttaggaaatacaggaccacaacctgcccgcccgtgactacataagataaccctcaccccgtcctctcttatcccctcagttctctctccctcctcactttagtctactcaccttctctctttcgatgatggcgtcagagattggcggcgatggtagaggtaggtagctatggcattagtggtgcctctccctccgatgacaacaggagggaaaaatctgtcgaggagggccccgaccacagcgatctgtctcctgctagcccagaggtggcggatctagtgcggcctctcccccttccttgtcgttctggcgatggcggttatagggaaggtgaatccgtcgtggtggtggcaaaaggggaggtgcgatgactgcattggcaaagggagacgacacgggcctcttcagagccgcctcccggccatctcatcgcctcccagtggaggtggtggtggcagatccacctccacacctcccattgccatgcgtgtcgtcgcctcacgggggaggtggaggtggcggactggcggctccatgcggtggtggaggcagcagccggatcactacgcatggatttgtttcaagttcatgtttgtttgtgattctagttcaagttcatgttctggatgtagatgactgtatctgtgatgaagtttatgttttgttctggttctgtgtgtgatgattatcatgtggatgtggattttgactagagagctagggttatagggagcggcaaggattaggtgattttattttgagtaaattttactttgggtcgccttttatttgtttcagtttggaccattctttaataaaatattttcaatttgaaccgggtaaatttacctttgtggcactttgggccaccctcaactattttatctatctgcatcaacttgttatatgccaaagcaatagtctaagtatagctgtgggagttcatcgacaaacagaaggcgacgtactcgacatcgttcatatgcgagaagatagtcgagatggtccaaagtaaaggtaagattatccggtcccaagtgaaactatttgttagatggtggtaaaaaggaacgtcagtaataaaaaaggtaatccaaagtaaaattcactcttttatttttttcataaaaatcattaccctagtcagtcgtcttaaatagtcacctgcgaaaattgatttttcgtatgcggtcgtcatgcccacccgtgataatcatcattttcacgtaaagctactcccaggcggctggtgaatgcacctgacataattcattttaaccgtttgaaaaaattacttctgtagtgtaagtgtttatcctcagtaatacgatacaacaatgtggatgcttgattttctccaagtatacacgggattagtaatgatcgatcagttgatcacccttaccttaccttaaatggtaacctgccgtttggacaaataaatggacggggacaaatcgatcggttcttaattagcgagattaattgttagcgacagaccgatcagttgcttgcttcgctgccgagaatctgtcacgcatgcagacgcgtgctgctgttggagggagcggccagaggaattgatggctgcccctgtcgtttgccgcctgttggctacctgttcccaaattagttgtccaaccaccatttaaatttcacttatctccctaaagtactgcttgtcttactcactccgtctaattttatagagaaaatctataaaatactattgacaagcattctaattccagaaatatcatcgacaaagacaacttcctaaaaataccattgcacgaacctctttctcccaaaaatactatcacaccataagtattgttaactcatctccattaagttatatgaaaagacaatcttaccctaggcatccatttgcacacacatcatcattctatattatttgctcacacaatattattttgcattcatgcatattttttctgtccacaactaaattcacagacatcgttattttgttatcaatcaaattatttcagaattaaattcacaaaataatttcacacattttgccatcgcaattccttcagaaattttgctatcaataatcaggaaacagaaggacaactgaatcaacctactatccacgcacaaagttcatctcttgcagatttcaaattcatcaaaagaagcaaaaacaaatttaccctcctcgccggcaccaatggggctttgctcatctacggcccccgcgctgcaggctgcgaccgtcgcaccgccgtgaaccacgtcgacgtgccctgcagcgccgccgccacgggcctcctcgccgctccctgccgcgccagcgccacgggcctcctcgccgcgccctgggcctcctcgccgcaccgccgtccttggcctcctctctgcgacgccgccctgtgctcccctgccgcgccgcccccgtggaccgccggcatagcggtgccaccgccgtggaccactgccgagccgccgtcgctgagcagccgccgggcctcctcgccggatcgggatttcccctccttgccggcaaagtcttcaaatgaaatcgaacaaaaggggaaaaattcaaatcagagagttgcaccacctgctaggactgcagcctcctcggcgacctcagtgacctcagcgactttagctgtgggcctctcctccccctcgctagcgcctacggcccccgcgccacatcctgtgaccttcgcgccgccttggacctcgtcgccgtggacctcctcgcagcgccctgccccgccaccgccctgctcctccttgccgcgtcctgccgcgtcgccgccctgctcctcctcgccgcaccctgccacgccaccatcgccgtggaccttctcgcggcgccctgccgtgccgctgccctagtcttcctcgccgtgccctaccgcgccgcacccgtggaccgctagcatagagatgccacgggcaccgccaccaacccgccctcgccgagacgccgccggggattgggatcggcagaacgctggatcaggggattgggatcggtagcggtagggttaggttataattttttttctttgacagtgaactgggtatattttgcaccgagggcaaaatggtcattattaaaaaaaaataacggttctaacggtttggagttgacggtgatggcatttttgggagaaagaggcttgtgcaatggcatttctagtaagttggctttgtagatggcatttttgggattagggtgcttgtcgatgtcattttatggattttctcaattataaacgtagttatgagtttccgtgtccaactttaattgtttgttttatttgaaatttttttatgattagtatttttactattgttagatgataaaacattaataatcctttatgcatgaattatgttttgttacttttttcaaaaaaaatatcaaataagacagacgattaaagttagacacggaaactcatggctgcgcttaaaataacacgaatggagtattaatcacgtcccatttagatttcttcctattttactctcaatcacctttttattcttaatcataacttatttgataacaatattatattatagtcttttagtttaaacctagtatatgccaaacaacataaacaataagtaatttagtacagaggtaatgagtagttagtatattttagtaggaatggtgtattacttccttcgttaaaatgaataaatatagataaaatatgggggtgtttagatctaggggggtaaggttttggcgtgtcacatcggatattatatagggtgtcgcatggggtattcagacactaataaaaaaactaattacagaatccgtcagtaaaccacgagaagaatttattaagactaattaatccgttattagcaaatgtttactataacaccacattgtcaaatcatggagcaattaggcttaaaatattcgtctcgcaaattagccgcaatctgtgtaattagttattttttagcctatatttaatacttcatgcatgtgttcaaacgttcgatgtgacatggtgtaaatttttcgtgtgggaactaaacatggcctatgatacaagctttagaattggccatgtttattaataaagcaggtagaattaaatggaaagatgttgtaattggtggaaaagtgaagatgggtggaaaaagtgaatggtggagggttgtggttggttaagaaaagagtgttggtggaaagttattatattttggaacaaattctgagtattagaagttactatattttgagacggagagagtatattttagtgctattaatttaaataggaggtcatatcttatattatatttgtttatttttgagatggagggagtattctcttgcagacattattggtgatcatatccttggaacagaagacactactacaaatccggtttttccatacggtcgaatcccggttttcgcaggtggtagggcgatccgtatgcacaaatggtttgcaaaaataactatttttacgtgagggtggtggaattaaatttgaaaatatactatcatttttttttcttaaaaatattcggggttcaaattttttcacaaatataccgccggtatatacgcgagaatgacgtggcgtgatgatgtcgtgcggtcttgcacaaccaaagagcgaggtcatttttgaaaattaattagtgtttattaattggtaataattagtgattaatcatcctaattattaattaattgctaattaggataattaagcactaaataagtcatcaaatgacaagacatcgggtctcgcttgttgtcgtacaacggtctcgctctttggttgtgtgagaccgcgcgcgcgagagcgagcggactcgcgctgttgccgcacaacatcgtcagtatcgtcacgctacatcattcttgcgtatctgttgagcgataccaacggtatactgccaaaaaatttaaaccccgaatatttttaagaaaaaacaaataaacaatatattttcaaatttaatttacggtggtgcatccgcaagaaaaaaatcaaaaaaaaaaccaaaaatcaaaaatcacgtcctcgtcatcatcgtgggggcgtaggaggctaggggccgccaggtctgcccgctcctatagccgttgtcgcctcgccagagacatagccgaatcaaccgccccacgcctccccaccgcctaatcagctgacgccgtgcctccctaccacccgatccgccgccgccgtgcctccctaccaccagatctaccgctgctgaacggggggacggccgccgcgcctgatgtgaccatggctactacggatacaaccgttgctcatattatggatgagcagcacgatattaagttcaagtcctccaagtattggaatccgatttcggccacttgctacactgctgatttcaaatggccgccgaatctgcatacgacctcggtttttggctcgtgagtatttgatggaaagctctcggagtcctctttccaacggatccagcctcatccccgaattccatctcctttggccgcaattgcagaaacaaggtgctgcgtcacctatcatgggcctttgggcttgtaacttcgtttgggaccccggcccaagtggggcccatgtggggtgcgccccaagctggtggagcacgaccctaggaccctcttggtcgttctcccacatccttaaatagctaggtaccctttcagggtttcttgggttttatttagatgaaagtttagccattgcaacttccttgcagcgtgcgtgtcggctagaccgtccgtctgcttgtatttgaaaccccaacttatcgtgtgtgtgagattgcttttatcttgttattgcttgtttcttcgatttgcttgcaggaatagggttgatctgcaccggcaagatcaacaacccacggagaggtgtatcaatcgctaaggcgcaacacaacgtctagtacggttgtaggtggatcgtcaacgtttctttcaaatcgtagttatcatcaactcaccgaaagatcgggccaaacaactgccttgagtgtcgaaaggaactcagggtccattaggtggtataagagctttcgttgctcggtgagtttttatctacctataaccagaaaatagccagacaaaaaaaaattgtatcatttacctagccatattgtgccattgcattgttcttttcagtctttgctttgttgaattttgtgttgcattgtcacgacgtgttgctggtcttagcgtctagttcgtttagagtttcacgttctggtcaagttttgtaccacagtcgtcgcaaccaccgtgtctctgttgtcgtcgggacctacgaaaacagaatcggctcgctgccatggttctattttgtagtttttagaagtttttatcggtcatttttggagttgcatctaggttttgcttgagtttttggtttgcccatgaatagataggccgtgctgtttccagcgctgagaagaggaagaagaatttctaaatatgtttttggaagtgtgagtttaatctagaaggaaatagtagattagattgattgaaaatcagtttcccttttcctctcaccaaatccgaactctagtggtgccgtatccatccactcgtcgcccactaccaccgtgaggagaggtttttacctgtatgccactaaaatatgacccttgcctctgtgccactaaaaagttcgagcctccctctatgctatcgtcgaactttatcgcgccctccacaccattctgtcgctattctgttagggttcatccgtttggcagctctgacatgtgggcccgggcagaaaaaatgtccctattgccctttctttcagtttcttcctctcgctccttccccctttctcccacgcgcgagcgcacataagcggcgacggccgggcacggcggcgcctggtgcatggcgcggtggagacggccggtgcgccgacgcgggcggtgtctgattgcagtggcatgggtcgggggacgaccggggagcaccgtcgatggagcgctaggcaggaggcggtcgggcgctggatggggaggcagccgacggtgtcgctggctcgactcggcggagacgtcggcgccggtggaagagaaggccgtcgtgcaccccgacgtggccgtggaggcggttcgacgcggcggcggggggacgacactagcgggggacggccagtcgtcatctccgggtccggcagctcgggtatcggcgtcgtcgacacctcaaaccccagcggctcctcttcccagtccacccctttcccggcggtggcgtcctcgtccgtgctcctacaagcgccgatgcgtgtgggacgagacgccgcctctacgcggctgctgcgcacggtgatgagcgcctctccggtggggccttggagcgcgagctcgccggcggaggcggctccccctccgtggccgtggcgaccaggaagggcggggtggcgtggcgaggccggcgaccggcgctgtgcggcggctgggcgcaggttcgacggtggcggccgacggccgcgagggggcgtccccggactcgaggacctcgctcccgacggccacgatggagatggtcggtggcaaagagaggctagagagagcgccacagagagaggccaggagagatgtcggcggcgagcgaggggatgtcgccgttggccacgccggcgagggaggcggcgaagaggagggcgaacgccggggtgccgacggccatgtggcggcgcaggtcccaccccctggcggcgagcgaggcgacgaggagcgtggagacagcgagcccccggtggtaggcgaagtgggagacggagcgcttggagaggaggcgcgcgtacggaggaagtcgatggtcatcgccgtcgttgcgtccgccgctgctgccatctccaacccttcctttcaagtctaagggcaaataagtcatttggctgtgccgttaccaccgttagaacaaaaaaaacggatggaatggtgtggagggcgcgataaacttcgacgatggcatagagggaggctcgaactttttagtggcacagaggcaggggtcatcttttttaatggcacacaggtaaaaacctcccgtgaggaggctagtccgactctctccctctcccttttcggtttcaatacatattgtgaattgctagacactttggtgaaaatttttggagtgtcggattggagatccgtttaaaaaaatggaacctacgggacgagagcattccatttttgtataattttaattttttggtttgcacttttgtatttcagtccctgtaatttttgtatttacatttgagtccttgtaatcttgctttcaggcccttgagtcatttttgctaaaaaaaagtgagaaaaggcagaaaggtgcttacaaaattgaaaaaaaaccgcacaaaaaaatggcaaaaaaggtgcataaaaaagaaaagaaaagggcgcaccaaaaaaaagaaaagaaaggaaaggaaaagaaagaaaaaaaagaaagaagaaagaaagaaaagagaaaatattgttatgtttgagctgaacttcatatatcagagttgtgcgtgagttgtgagttatccctagtgctatcttgtggtatcgtttgtgtctaggctcgcgtctctaatacattctagcctaggaccaacacaatacttgactttgaactatcattcaactttgcattctctaatttgtgcaattgctatcatttgctacatatttaagcctacccaaagctccacagatttgattgcagccgtacaacaagtgtttgccaaggcatcgatacatccaatctccattggggtgcttggttgagtcagtgtatgccaccattccgcttgcattggtaagatcttgtaagagcttggttaaaagcttgagtgtgtgtgtgatatttgagctactactacctagtagttaataggaacgtgcatatttttgtgtatgtttcttgttttctattaacaatggcagggatacacaagatcgttggatatgaccttgctcgacaccaacattttcatcgagacatgaggaatgatcaacatgaccattatgaggtaagtgatgttctagctaagatcaaatctgcactaccttattttgaaggaaattatgatcctcgtgcttacattgattgggagctagtggttgatagagaatttaagaagcatgacttgtctgagaaacatatggttatgtgtgcctctaatgttctaattaaaaatgcttcttctgattggaaacatctttgtaggcataataaagtacctcaatcttggaaagacctgaacgacatttgagagatgtttatgttcccatgtattatgctgacattctgttcaacaaactacaatgtttaaaacaagatactaaaagtgttactttatactataatgatatgcatgcttgtttattacgttgtggtttagatgaatgcgaagaagctacagaattgaggtttttacgtgggcttaacaaagaaattcaggacattctttattgtcaaagatatacatctctttctcatttgttataacttgcttgcaatgctgaaagtaaaatagaggaggacatgaagaagcaacttgctatgtttttgccttctattactaaccatttgcaggaagtagataatcatgaaaaggaggagagagacatgaaaaagccgccagtcctattattcacactcaaagtcgaggcacctccatcatctgaagagggcatcaaaggtaaagtaaatggtgctgaaattaatcaaggtgaatgtgttgttaatgaagtaaatttttccacttttcatgctaaagtagagcaaccgttagtggaaccaaatgctgaaattcctttatcataagttaatttacttgttgttccttgtgataaagaagagttgtgtgataatgcttcacttatatcaatgccacaactagttaatgaacatgctattcctaatgttaattctgctgattttaagtatgttgttcacattgctcatgaagttcaggaacgtcaattgataacttctttaaatactttgggctatgttaactttgataatttttgtgagctcgataatttgaaagagaaattatttgctaaatctgatttgccatgtccaaccaatgctatttttcatatctttggcgaatataataatagaaaaatatatttggtgcatagagtttatatatgttcggatttagaacctcctctacatgtggataaaacttgcaagctaaagatacatgttatttctaatcatattacttccaatctctcttgttttgattggatgaaacatgttgttttaaatcgaccacgcgttgagcatcatatggaaaaaccgaggacggttttccgtaaagaaggggaggatgatgtgaccatggctactacggatacaaccgttgctcacatcatggatgaacatcacgatatcaagttcaagtcctccaagtgctggaatccgattcggcctacttctacactgctgatttcaaatggccgccgaatctgcatacaacctcggttttcggcccgtgagtatttgatggaaagctctcggagtcctcttttcaacggatccaacctcatccccgaattccatctcctttggccgcaattgcagaaacaaggtgctgcatcacctatcatgggcctttgggcttgtaacttcgtttgggaccccggcccaagtggggcccatgtggggtgcgccccaagctggtagagcacgacgttaggaccctcttggtcattctctcacatccttaaatacctaggtaccctttcagggtttcttgggttttatttagatgaaagtttagccattgctacttccttgcagtgcgtgtgtcagctagaccgtccgtctgcttgtattcgaaaccccaacttatcgtgtgtctgagattgcttttatcttgttcttgcttgtttcttcgatttgcttgcaggaatatggttgatctacaccggcaagatcaacaacccacggagaggtgtatcgatcactaaggcgcaacacgtctagtacggttgtagttggatcgtcaacgtttcttccaaatcgtagttatcaccaactcaccgaaagaccggaccaaacaactgccttgagtgtcgaaaggaactcaggatgcatcagcgcctccccatcgccggatcagccaccatagcacaggcagagggcggccaccgtcagatccgcacaatcgtgtgcctcctccgtcttgctccgctgcccgagtccctccaccgccgttaggaggaaagagaggggagagaagtgggggagaggaggaggaagccgtcgccgtcgcccttgcccttgccccccgccggagcctgctacgtgctaccgagagtaaggagaggggagaggggagaggaggtggggagagtagtgggggatatgagtgggagaaccgggagaggagaggagtggagtggagtgagggtgatgggggtgggtaaaggagtgggaatctttcggggtatttttgcatgcatgtgagttaagaacaccgcatgcgaaaatacccttatttcccttattttggtgcggatatttctaagcggttcatctagaaaaatttatttttatatatatgttttaaagagctgtatggaaaaatgaggatcgatctttacagacacggacatttatgtttcgtccgcaatatattgagatgctcgtgtagaattttttttaagcagtgagaatatcttagtgggaagacggtaaagtaggcctcgaaccactctctctctctctctccatgcatacggaggagtaatttctctctgtgctattgatgatatggggatcgagttaagaatatgctgacacgtctgatatacctgtcaggccattactaggatagggcacaccactttgtcaggcccaaaccgaatgtgctgctgcatgctatactatctgcactggatatatatctgcatgcatctctgccgccaatccatcataaagtaggagtatatacctgtatacagtatatcatcatcagagagagtagtagtagtgttatgcatgcatgggatcgatgaattaactgctacagttaccggctgcagcagatgagctgagctgaactgtgctaggctagccatgcacagatgcactcccctattaaattaccaatcactctattccactctatatattcgtccacgaatagaaaagattatacgaagccttttaaaatataaaggcctcaaaggttatccataagtttattataagtcataacaatttattagcagccaaaaataatttttgtaaagttttgtgtatgtgttcttagcgatttaaaagccaatgctataaaataaactatgctaaaaaatattttaaaatcaacttcaaaattaagtttcaaaatttaaattttgactttgactttggtgttttaggcaaccgatcgatggagctcaaacattttagaccgtctataaatatggttagaaaatgcttatattttagagcgaatgaagtatgttgttaaaatatatagcttaaggggttgaggtgaaattattttggtacttctaaaaaccttttatttaattaaaaatcacgattacccatgtaagtgagcaatttaatacaatgaggaattggaaaagtaatactctaaataagatctgttatatttaatttgtagacgagttctaaattaaaatcaaaatctctatagcttgtactcgtgtatggagcactaagcaatgtattactactatctagaggtagagggtgcatgcctgctagagctagctagcgaggttgcatgcgtaggattcccgtgacctggtctggagcgattgttgctaattatcagctagcgcgtcgatcgatcgcctatggatggatggatggatatcgatcgatcacaggaggcacttggttagattgctattagatggatggcatatgttggggggaggacggagcgaggaggggttggttggactggacaaccgatcgatcgacgcgtacagctcacacccacaggaaaccaaactcgtactgtacttgctacagctatatctcctgccattgcatgcgtcagatcgacttgctacttgcttctctccatcaaccatatgatatgagagagagagagagagagagagagagagagagagagattggggagagttaattactcagtttatcactagtactccaataagcatatcgatatgcaactggtgattaattcactgtacgaatattgttgtgcgacaagattaaggtatgtttgaggagattttaattttgagaagtaactagtaggaatccttggtgataatgtgaataagttgagaaaacatgccaacttcttgcttcaactccctctgtctcaaaatatagtcacaacaactgttagcattaggctaatctaatactaggttactatatatattttgggagacggagagagtacaactgtggcttcttagaatctagatgaaaaattaagatggattgtttgaacgagtttttattctggaaaaagctactaaacaagcccaaggagcaaggtttcttcgactaggtcaagtagttgggcttcatttgtgattgttgaactatggtgtcaggtttctttaggtgcaggatattcgatcgttccattatcttaaaaaatacagttattgtgttatgctgaatcgtcgtgttttttgtttttgtaatttgttttaaattagcaaatatattgtttcactccgaaaagttgattttcgtagaacaatcatggcgatttataatgttagacaaaatatgatacccaatataatcgttctgtcccacccagtggcaaggccaagaaatttaacatggcaaatcgaactgtgtgctaagtgtttaccgatgatcctgggcagccacccaggtcatcgggcggtggatagcgttattgcttgcaagttagattaagagatcaactcatcaaagaaaaaatgctgaaaacagttgcatgaaacgagattatttattatacaatgtacttcaacaatgtcaattaagcaaactattagcatttaattacaaaaaaacaaaatactacataaatcatactataacactttaatccatcattgatgtttagcttgcttacatgtaaattaaaaaaaaaaagtaaagtaaaaaggtaggaacaacctaggtggaacaaaatggatccacatgcatgggatttcacaacaaagctagcatggacgcaacaaaagtgaaaaagaaacagaactaagaaaacaaagaccatgacatgatacacggactttgatgtcagaatgttatgacaaatactataccacatatagtaataatataatcagttaattgattaatatctcaacccagttagctagacacaataactagttaaattactagtaatgaattagccctgcagctaagctcaattccttcggaatcagctgttaatttgaacccatccacacctccatcgccggcctagggcagcatcgcgaacgtcgagatgtcgccccacgccgggatcgcgctgccgcagttggaggtggcgttatcatcgccgccgctactccggccgccgctgttgaggttactgctggtggtggcggccacggcggcagtggcaggcggcggtggggaagggagcccgtaggagcagctgtccatgaaccacgacgtcgccgacggcatggccgcctccatgctgggaacactaccagccatgtgcatgaaggcgccaccgcctcctccggcagcatgccctgacgctgtggcttgggcgccgttgccgccaccgtcgttggcctgggcggcggcggcggcggcggaggcggagcccggcgggccgaggaacatggtggcgagcctctgctgctgcagcttccagtgcaggtcctggttgatgaagctgagcgactcgatggacgacgcgatggtgctgctcaccgcgccgtggccgccgccgccgttcaccgcgttgccgccggcaatgtcccccgagggccactccccgaacggcacgtactgatgatgcccgacgccgccgccggcgggggattggagccgcggcagcggcagcatcccgacggcgccgccctgctggaagtcggccaccgcggcggcggcgccaccgagcggcgacgtcgacgacgacatcatcatcgttgttccaccgccaagaaaccccagcctggcagcagccgccgcagcggggtcggccgctgcaccgccgataccctccaccgtcggcaggttgagcgagaggcgcgatgccgccgccgcggagcgggatcgcttgttcttgcggcagccgccgccgactgggacgttgcggagcgcgccgcccttggtccagtacctccggcacgtcttgcagaagtggcgcggctggctgaggctgtagttgttgtagtagcagaacttggtgttcggcgagtcgcaccgcgggcaccgcaacccctgctcctgcggcggcggcggcgggagcggctgctgctgctgctgctgcgccggtggcggcggcggcggcgtcgtcgtccccccacctccagctccctttcgcggcaccaccgcgtcgtccccggccgccggcgccatggcacaccgtacaacaacaacaactgtagctagctagctagctggctagctgcagggggtctaagctggctagctccgtgatggcgcgctagctctaggttggtctgggtgtgattaggtggacagggaggggtggccgtgacgccgcgtgcatataagaagaagaggagggagatcgatggtggaggagggtttcgtgcgggggagggaagaggaattgaatggcgtctcatgtgtgtgtgagggagaggaggaggatcatgcgctggggctcggatcggctgcatgcatgggattaatgggaggtaaaaaagcgacgtctcggattgccgcctgtgattgccatcaaagtgctcagctcagcaccacacctcacctctcatctcgtctcatctcagcgtctcagcccagccagcctaccagctagcccgggtaataatcacctgtgattaatcaatgttgctgcatgccttctccctagcgtagctagctctcgattgattaatcgatcgatcgatgggcccctgttcactgtgcaccctagtacaagctgtctgccgccgcctgccggcgtgtcagagtattgtctgcggcgacgaacagtacggaggcggtagccgtcctggatgttttacactttcgtccttttcaaaaacttgtttaacaaataaacccctaaaaaaacttacaccgtactagaaatggttctttttggacgtcatagtcattggcgccgtggtccaataggacggtgacatcatctcttgcaccgtccccctgccatcgtggctggccggcgctgacgtggcaggggaagcgcgccaatgataattttcttttattttattttatactttttcacatttaggagcacacaagaaccaaacatagaaaaattaaactcaaacgaatgaaatgtgacctgtagaatttttcaaagctctatcaaaaaacttctcgccttgaaaacacaatcttgcaagcagaatttcgagattctaatttcaccaaacccgggcgaaatgggggagaatcagatgtaactttttatgtagatatttgtaaatatataatttgcctttttctgtatttgttttaagaaaggtcactcgaatgtaacaaaaaaactcaacaaacactaacaaagcaatgctagtaaaaaaatgctaaagggtttataggattaaggaaatgtaatctaatattgttttggtaactttctgactataggaaaaataaaaacactgaaaacagaaagtctcttaccgataaatcttgcgtggatttgagaagagggagagagagagagcaagagcagcggcgctcgggctcgcgtagggagggcgcgggggatgggtgtgaccctcggggggagcgcaccaaggaaaaaaaagatagcattgtgggtggggggtagcatcattggcacgctcccccttccacgccagcgctggtccgccacagtggcagggagacggcgccagatatgctagccccatcctagtcccattggaccatgatgtcactgactttggcaccctaaaaatgaccatttctgggataagtttttccagaggcctatttgtgaaataagtttttaaaaaggaccaaattgtaaaagattcgggaagcatacaaaaataagggaatggattctaaactctcgagggaatatctctctgcatgtcatttaaatagttatgaaaaaaaatttaagaagatgtgttacatgtaatatatcaccacaaacatacaagtccaacttctacatgtcacaacaaaaaataaataaatttgatttttaattttttttttcattgcaatatgtagaagtttaatttgaacatgcagtttgtggagtcgatctagtaatatatcacatgttaatacatattcttaatatttttttaatttttttcataactatttgagtgacatggagacaacaagaggatatcccctcgaaagtttagaattgttttctctaaagataatactacatccatatcggaatataagtgtttttgacggtgatatatatggtcttcgaaataatactttgactgaaaaatatttataaaataagttatttcaaataaatggagtaacatattataatagtttgtttagtgataaatacatcaacatcattctcatagatcaatcttttttatgtttccctattaatagttaaagtgaaaaatgtttgacttaaaattattctaaaaatttttatattttgaaacggagggagtatcttagtattactaatcgaagcatgtacagattcataatactagtatacatgttttacatattatattttaggtaaggcagtatatactatcactggtggagaaaccgtctttggtcggtcgcccgaaatccacaatagtctcggttccactaaaaaccgggactaaaa

SEQ ID NO: 27814 - DNA, 9388 bp, Oryza sativa
accaaccgatctttagttccgggtatttgaaccgggactaaagataacgatctttagtcccggattggtagtcccggtttgaaaaccgggactacaggggggttacgaaccgggactaaaaagcacttctccaccagtgtatattcaataaaattggcacattctaattgttcttttttcaaaaaagaatacgtgacggtaacgctagctcggacggttgcgcggcttgcgccattgccatggctacgtgacgacggcatgcaagtgctatgctgtacgctggggccggctcgcgagcagaatcaccagatatggtgctcgcctatactgtgttcatcgagagtaaccgaacgaaaatgtatatatgtaactgaagttgcggcgttttgcgtgcatttttagtaaaagtcatcgagggcaaaactaccataaaagagaacgtaacaatccgcctcaccatgtcttctgcgtacacccttgctcccgttaaatttataagcacataatgatttaatttattttataaataaattatgacattgtagatgtaaactagcataaacgcatcataaaatctacacatgtaaactagacagtaaagcatgaataaatcgaatatatacaacatgttgaacacgtaccaaggataacagaagaccggtttctctgcagaaagcatgggcggacctaggggtgtgccgggttggcaccggcatacccaatttcttttgggaaaacactaggatgtatatgcaatcaaaggacagaattaaaaatagaatactctactctcagaaaatagaatataacaatgatcacagtttgtcatcttgtaatcgtcaacaaatcaaatcaggggaagagggaaggacatgaagagaaacgagaaacaatggggaaaaaagaacagctagatagattacgatatggggttgatagttctgaattttatagatttttcataaattatggaccaaatttgaatagaattttgaaaaatcggaccaaaatctgccaaaattcttccatcataattgggtgttttctttttaaaaaatatatagtgaagtgatcgctagaatgggcacacccagtgcaatttttctaggtccgccactggtaggaagtactcgcggttgcgggcgttgatgatggcgcacagcacgcaagcgaagagggagcagtcgcgcgaagcgcttccaaaaaccttattgtcaccttctcccggtgcaggacatcgaagacgaatgttccagagacctgctctcccgatcgccagtgcatgccgatgagcgggatggagtagactacgagcgacgacgtaatacagaggggaggcaaaccttagattgatttcacctgtattccgtggaggcagtgactcaacttatatagaaatatcaggacgcctgcatgatctccactccacgtaatcgaactagataagtcacgctcaacttatccagactccacgccgttttatgcaccggattattcagagtagactatgagcgacgacgcaatatagaggaggaggcaagccctagattgattccgcgtgtgttgcgtggaggcggcggctcaacttatatagaaatatcaagacacctgcacgatctccactccgcgtaaccaaacctgataagtcgcgcgtaatttatccagactctacgccattttatgcatcggattattaggagtgtttccaaaacaatcaaatccgaatttaccgcagcaaaacaaaactgcaaaagaagactgcatctgcgcaagggtgagaaaccaattttggcggacaattgcatatgtcatgcacgcaccgccacgccatgccatgccaggcgagcaactatgcgcatgttccccctcttctctccacctcacatgcctcaagtggctaggagagcatcctcccttataaggagatcttcctttactatctagaatagtcaaggtgtactaaatttcccatccatgccatctcataaggtgggcttttatgattttctaaagaattaatcttcgaatgggctaaggtctagctattaattccgacagctcctaatctcttttactttgttctcgttgttaacactggcccacctttcaccgccggctacacagcttcaattcatcgttatgctgtcgctcgcacgctgctatttcgctaagcccggaaagttaattttcccccctcacctcctatacccactcttcccattccatctgacctcaaccgcgaaccctaactgattgggtcgccatcttttcgcctgagcaagagaaggagggcatcacattcccgaatgtggtgtggatccattggcggaggattcaacgtaaatctactagcataaataaaggtcaggtttatttctttaaatgaaatagtgctacctctattttgtaaaaaaaaaaagattgaagtaattaacaaacatcatctaaataaaaatgaagggagtagtccttaatttaataaaataaacttcaccacaaagtttttttaacaatacctacgttgtattgtgtaatttaaaaaaatagaaattaatgctaagctctaaatctcgcttggccgaatccttctcagcctaattccttttcttctcttcactctactactgttcccctcagattggatgggcctaagcccatattctctccttttctttcgggaaaagtacaccgaaggtccctaaacttgtcatcgagatacaaaatcgtccttgaactacaaaaccggatacaacgcatccctcaactgacaaaaccagtgtaaactaggtccctcggctgttttgaccccggttttgaccgacgtgacagttgactcagcgtgggacccacatgtcagtctgtccacgtcatcacccatctcttttccttcttctctccgttccttctctctcttctctccttgcgacgatggtggggcgcagccttgcagccttgcggcggcggcgtgaccctgtggtgggctggtgagggataggcggcggcggcggacctgctctgcggtgcccggtgagctgcagcgccatcgacgctgtctctccccgttccccttttttttcttttatttttaacttgtttctctccctcgatgccgctgctttccatggcagctagcgtggaggttcgcgcaggcgcagcggctggatgtggccggatgcgaccggaggccaggacgacaccgcccacagccgtcaagcccccacccgccgcacacctctcccaccggccgagctcgccgccgccgtctgcaccctacaggtcgagctactcatcgccaccgtctcaatggcattaatgtctcatcgccagctgctcccggccaccgcccgcttcaccaccggttagctatcccggcattaatggcgatcgatggctaggggaaaagccgcgacgagaagggcggaaaccacggcgccctcgacctcgctgagagacttcggtggtgggcgccctagcaggcgaccgcgatgaggtgcggcgcggctgcgcgtgctacggcgtgaaggtgcgcggcttctacgcggaggatgttagcgacgaggggcgctgcagccgcgctcacgacgacggcaacgagtgacgccaaggccgcggtcacgtgggcggcgagtggtggagcgaccgcgcgaacgacgactaccaggggctccgcggccgtgcacacgatgatgacgtgggtctcctgctccgggaccgttgcggccgtgtggcgggtagtcctgacgagccgcgccgtggagacgcggcggcggtgggggcgcacgtggtagatgaggcccggcgggtggggaagagactggcggggtaaggagggagaggtcgggcagcggcgacgcgggagaaggggaggagagcgtcatggcaccggcgcacggcagtggtggaggagaaggggagcgcaggcactgctgttgtcgggagctggaacggcgggaagcatggcgtggggacgggggaggacagtcagagaggcggctcattggggacagccctcacggatgagcaagggcaggaaggacaacggcggctagggcggcgatgacagcgtgtcggccgaccaactccctcctcgctgcatcgtcgactggggggacttcgacagggcacgccgcgtcacggacgctgtgctcgccgctgcagaccctatgggcgaggagacaagggaggccatggcggtgcccaaccgcgatgtgctcctctacatgagtcgcggtggagcccggtgtggcatggcgccatccacggtgaagacgtccgcgacgcgaagacggcctcggacgcaacggccgctaacgtcgcacgcctctttgccctctacctgccagcactcacctacggcatccacaccaacctcctcctccgcctccccttctcctgcatcgccgccgccaacctcattccctcccgcctcgcgcccaccggctagctgcctagactggacagagaggaggaagggagagacatgggaaggagagagatgatgtggatagattgacatgtggggcccacgtgggtcttacgctgagttagctgccacgtcggtcaaaactggagccaaaaccgccgagggatctaatttgcataagttttataagttgggggatgtgttgtatccggttttgtggttcaaggacgattttgtatctcgacgacaagtcgagggaccttcggtgtaccttttcgttttctttcccgcaggggctaagcccatcagcctagacgcactgccctccctagtaacaaaacccatgcaccagaccaggccaatccactctctttcctctctttcctctataggcaatccaatcgacgcagacgcagacgtagaccaggccaatccactctctttcctctattggcaatccaattgcgtctgcgtcagactcaacgcggcgcggaccacggaaacggagcctgcgtctgcgtcaagccgtccacgcccgcgcgccgccaacgaaccctcgacccaaaacgctcaggaggacgccaccgccattgatggtccgagctctgatctgcttcatctcaccacatctgatcatctccatcggaggcacgaagtatggtccagtggttctttcttggaagtcctaaagaacacaatcgatctaggcgaaatcgctgttcggttggagatcggaggcggagctctaggcctccatcggtcgtcggacgccgccacaagccccacaacctgggagagtgggcgctgcttgcctgcttccattgacttcctcttcagccgcagccgcctacggtgatttaagtttcctctcatctggtctcccttcaatcggcaccaatattccgaaatataatccgaatggcctgacaaccaccaacgaacaaataaatgcatatgctaattgtgactccatgtcgtagattttcaaaattggtactctctccgttgcacaatctaagtcattttagtatttttcacattcatattgttgttaatgaatttagtcatatatatccatctagattcattaacatcaatataaatgtaagaaatgctaaaatggcttagattgtgaaacggagatattgtgaaacgaaggaagtacaatttatttgttcgtggattcagaattggcaaaaaaaaaattagtttgtggaaccttcaaaattttgtcttctgctaattatgtgtccatgggattataaaacgtgtgttaatcctttaatattacaagttaacaactgattctatgcaaaacaaattaagaaatatcatgaatcatcaaaatacttcaattatttctttgtacattgtttgaacatgacatttttctatatgttcatgcacgataaagacataatatccccttcctcaccccaaaaaaatccccaacaattaaaattttatttttctaatactttgtaatttcaatagtttattctacaccatattcactttactttcatagaaatttcattatttatattgagcaataggtggctaacttcgtaccccattcttgaaatcacatgtgtgtcattgtggtcttaggctgtgttcgctgcatgcagttgggaacatatctccagcgcacggaaaatagagcaatccattagcatgtgattaattaagtatttgctaatttctttttcaataatggatcaatatgatttttttaaagtaactttcgtataaaaactttttgtaaaaaaaataacgtttaatagtttgaaaagcgtgcgcgcagaacacgaggagatgggttgggaacccatcctgccgaacaaagccttaaacttgttccgaaaatacttctaatcggtcgtccgatccaaacataaaaatcgaatggctcttgactaacttctctaacactcgtgactacacatcagcacatgcgctgcataccaccttttgccagtgacttgctactgcatacctgttgcttctctctctcttgtctctgcactccatactacttgcatgcattcatttaataatatacaaaacgatttttctcctaaattacttatccaatatacaattcgatcacaccattgtattcgttgttattgaacctttacaacaaaatgtcacatgattatattctaataaagaatagtcatatgtttcgatctgttaacattctttgtttcatacgtaatagcgatatgtttcaatatgtcttcaacatgtttcacaaaatttccaaaactaactgcactactctctctccacctcatccatacatgcatgcatgcattttaacaagtttcaaaatattttttctcctaaactaattatccaatctacgatccgatcacactgttgtattctttgtaattaaatctttacaacaagatatcacatgattatattttgatgaaaaaaacatatgtttcaatccattaatattggttgtttcatatgtgatagcgatatgtttcaacgtgtatcttcatcatatttcataaactttttaaatgtttcagttactgattttttatttcacactaaataacttgatgtttcactcgttagttaattgaaacatttgactaactgatttcttttttttgcatgttggtggtgtgatgacgcgcagcgtccgatatttggtggaatatcggacgtccgatgcggagtcttctccaacttgttcagcagttatctattcctttcccggttcacctgtcttgattagagatcacctatgcaatattgccttgttcggtatttatctattcctttctccgttcatctacgtttcactagtgaccactgtgcgacatcgccattgttaccaggattccagctagttcttggagctcgatccgagcaattccctttgtctccacatggctagagatttgagagccgcggttgaagtcgccaatggacttaagcaggtaagcctattcacaattgttctattggacactattaaacatttttgaaagactttttgtaattaatgtgtaatattgaaagtcaaaaaatataataattatcataattggtttgtgtgtttgatgacattagtaaactttcttctttgattgagagggacttataaatttgtgaagaaaaaatatttgtaataataactaaaatcaataaattttctcaaaagaaaataggaagtgagcttttcaaaaactctatatgaatttaatgtaggctatgctataggagaaatgcctgactcacaattgaagttatcaccgtaagaatatccttcatcctcaacaatcatgttatgcattatgatgctttgcagcaatgactttaataagaaattctcatactaaaagatgagttgtatacgtacaataacaaactgagaacgtcgaacaacaaatgcacatgtgacatctttttcttgccccttctttgtcttgtgcagattacttgtccttcattcgtcggggctactctctctttttacatgaacacaattttcaagatggtgaacggtgtattcttaagaaacattttatttaaaattttctttaaaaatcaaataaatttacttgtaagtttgtcattgttaatacttgactaatcatgcgctaatgttttaattttttttccacattcagctacgccacttgagcagaaacgaatgggacctaagagtgtcacataagattaggtgatgagatagaggagagaaacatgagccacatctcttatgcaagggagaagctctatacaaacataaaaaaggtgtgaaaatattagtagtattggaatatgtgtattagagatgacatattggttcctagtcacactttgccatcactaaccgagaaaagttatcacactttgtctaaggtgggtgatcaactttctcatttaacaccggaggaattgcattacaggccaaacaagtgctcttcttgtagtcaaaatgtttcctgttcgaatccactgaaatgagtggattaaattttggattaaagtggcacgcttttcaaactgctaaacgatgtgtttcgtgcgaaaactttctatatgaaaattgttctaaaatatcagattaatccatttgtcaagtttgtaataattaaaactcaattaatcacacgttattactacctcgttatacataaaacacttaatctttatcttcatcatctttacatctttaggagattcaaaccccacctaaatcgggatcttttttatcttcctctctttggcatgtagcacagaagttgttactagatgccgaggtacgcttggtcctgcccttcaatactctggagacaagttgagctcaggctgagtcaaaacagcctgttcctctaacaatttctcaagctccagaatgtgttgtggctgttctttcaaggagagaatttgagcagtcagggaggagcattgtgttggtagtttgaactgaatggaagtctagagtaaccttggcctgcccaggcagcagactgcatagaaggaataagttcaccggaggtccctcaacttaacagcaagattttttaagatcccttaaccacgaaaccagaaatctccactcctaaactatacaaaaccgttcacttaaagcccctaggcagtatatatgggtggtttcgctgacgtgacatcttagacaacaaaaaaaaatttaaaaagtacgtggggcccatatgtcagcgggacatatttttttcatctcttttcttgtccttttcttctctcttctttcttctctcttctcttctttggtcagggaggccagcggccggcgatgggcgggcggcgggcgagaacggcagcagagcggcgacgggcgagcgcggcgggcggagcggcaccgggctgcggggcggacggtgggctctgcggccatgaccaccgcagttcctgcggcagcggcaaccatggcctttccgaatccct

SEQ ID NO: 27815 - DNA, 6929 bp, Oryza sativa
acgccgcgctcgcccgtcgccgctccgcccgccgtcgcgccgcccgtcgtcgctccgcacgccgccgcgctcgcccgtcgccgcttcgcccgccatcgcaccacccgggctcatgagtgtgcgtcgtcgcctcgtcgggtgcagcagagctcggccctcttcctcctctcccgccgtgcggccaccccctatcccgcaggcgcgggcagtcccgactcggcgcggatggtgacagagcgcggaggaggcgacgagccgacgacggtcgacggcttgggccagcgaggatgtgatgccgaataggggcggtgaggaggcggcattggcagctggggcggcgaggaagcggcctcggctagggcacgacggccttgggcgcctcgtcagggactgccggcgggaggagttcgtcaatccggtcttgtggttggagagctcgatcgggatggtcatgccgtggagcacctcgacgacggtggaggagggatccggagaagccatggtttccgccgcctcacgaattgccgcggtcgcggccgcagaccccaccgtccccaatttagcgccgcaggaaccaccgctctgcccgaagcccgccgccgcgcgctccgcccgccgacgctccgctgccgtgcgggcccgctgccgtgctcgcccatcgcagctccgctcgctggccgccggcctccctaaccaaagaagagaagagggaagagagaaaagagaagaggagaagaaaagagaagaaaaaaaaatatgtgccgctgacatgtgggtcccacataatttttttaattttttttgctgactaggatgccacgtcagcgaaaccactcactagggaccttgagtgaacagttttatatagtttaggggtggagatttctggttttgtggttaagggacctgaaaaaatctcgctgttaagttaagggacctccggtgaacttattccctgcatagaataaccttggcccaattaaattcatcgggagaaaggagcacagcagcagtgaagaaatcggcccatttatgtggtatataaactattgggccagaggaaccatctggcccagtcaacatgcttggcccacagatttgaactcaaatgccgggaagcttgtgcagcgtatctcatatttttcagataatggaataatatcaggcctttgcttccaagaaactacagccacttatattacagagtcagctaatcaaagagcaaataaaattcaggaattgaaagtgcaaagatgagcgcggatgataccggagaccaggatattatggtgggcatatgctctgtttccatggagaggtaattgggaacaatttgatctgtctgttctgctaacttgtcgtggtgatgagaacatgttgtgcgtgatgtgaaatactccctccgtcccattttaagtgtagccacgattttccatacccaattttgatcgtccgtcttatttgaaaaatttttgaaaaaaatattaaaaacataagtcgcgcataaagtattattcttattttattatttcataacagtaaaaatactaattataaaaaaattaataagacgtacaatcaaaattgggcacgaaaactcataattgcacttataataggacggagggtgtatgatgaaccatgggaaatctccacggttcagacactggttcagctaaggtaccaaattattcctgcaattgtggcatatcctggagagtggagacctgaactcctgaactgaattcgatcatggccatatgtagatctgcttaacttcagtgcaggtctaaaaatcttgcctttaggttcgtgagcgtaccagttgatttgatcctgcaatcaacaagaaataaagacaaagaaaccgcggttaaatccataaatgatagccgattggccagccaccgatgacatatcatttatcttggagccgatgtcatatgtaaatcgatcggcaatcatgaataaataagaatgaactaaatctacttgatcggttgtagatatcaacaatatataatccttatatcgatatatacttaaatcaagtgattgggatagattgatcgtcatgccgagacagtttaaatcacttagatcaaaatatatactaacaatgagattatagatgtttatagcatagccgatcaaatagatctagcatgtatcgactaatactccgataccactctatattaagatattaaagcaggaaaaatatattaaacaaaagcctaatatactctgttgtaataagatctttaacataaagggcagatctagcatatcaatcaagcacatagaatataaggctaaattaggtaagatcagctgaaaccccgatgctaccctagtcggcaaccaaaagcaggctagagattgagattctaatcacgacttataagatcaaactcaactgatgctactataagtataaaaagaaggataatatctagacaataaaacttgtttcatagagtggtagataccctgtataatctaggtcaacatggatatttaacctaatcggctgccttctaataatagatgttagccgattgaaggttagatagcgatattatcaaagattatacagaatatatgataactcgacgaattacataaataagattagagtatcataaagatgtaagcactaatcccgagaacgcaagccgccataacaagttttacctctagttgaagatcgaaaccgatgcagctcaacccgaaagcaagaactcgtcgaaacaaaacgaaagtaaaagggtggcgatgcgccgagattgtattgaacgtgtgttgttgtattacatggggctcggggtctatttatacccaagattacaaaatatatccgtgtcggacacgacacttatctctaacaaactctaagataccataagtctttgcggcagatttttgcccaaaatatctctaaggaaattacataaaataacctaattaatagatacaattgtcgtctcaggactcaatccatgcatggcaactctcatgcaatacattaactcaacccgacaatgtgtatcacgccacattgtcggtatcggctcaatcggccaaccttgcccgactcgaactctgccgatcctgatcgtagccgattcggacttttagccgattctcgctctgttcccggaacaacgtctatgtttggattctgcttcgatctatctctatctccgatacttggattactaaattttgttgttaacaccatacatgaaaggggatacctattctgaagatttactaattaagctacattgccattaattttgactacttcgtcgctgttgatctcttcctcctcttttttttatgacaggtattataatacctagctttcagaacgaaagccaaataggatacacataagtcgttttacagaaaaaaagcaatagaaaagaccagacaaaaggcatgaccagcatctgtaggatcgaaacacaacaactaagccaaccagaggggggtgaatggttggtataaccaaaaaccaaaacttttagcggaaataaaagttaccctcaaattcgatggagatcagtctgaccaagattgatctgccggtctgatcgtgcctatgccgtcggtctgaccggtgttgatctctcggtcggaccgccctggaatcgcctgtcgcccctgttgccaccgccggtctaaccgccttgcgcccgccggcctaacggccgcgatgccgccggtctgaccgccggtgtgtcgctggttagaccaccgaaacccggtgaaacacaaatcgaagaactcttgaagtggatgacgactttattgattctctctatgtttacaaagtgcaccaacagcagtcctcacaaaaatctcgaggaaactcgaaaccctgactcaactatcagctcaattgctcttaaaagcgataccgagaagtctcacgctccccctctatttataccctgaggtaggcagcctaaagccacaaaccaaactcatactagaaatcctaaacaccttaggaaactctctagtaaaagaaacaaactttgcatacccactcataccaaatttggactccttccaaattcgactccgcatcccatacgcacacaataactccatcgtatgccatatggaatcttcaccaaccacgtgtattgaactctagccttagtatcctgcatgatctccaaccaccacggatgtcgtcttatccgcaaaccgactcccggtccatcaccgcaaatactctcctgaggcatcgagtcacctacacatgaaataaacaaagaaaccatattccgagaccaagctatctccaacttgactcattgttagcaaacaacagtattacatacgcatagtatccatctagaagccataatcatgaaacaatcacggatatccaaacaaacaacccgaaaccgaaaccgacacagagtcggccggtcagaccgcgggctgcgccggtctgaccgtgcgatacacgccggtctgaccggcaaccgcagcccggtctgaccggtcacataaaataacagcacctgtaattcacctgtaaatccaatcatctccaaaaccacttcgtgaataaattccaaacatcaaaactgataatctccgatgccaattgtttatcacagaataataataaaaaacacctttaattttacagtctcccccttgatgaacactttggcaaacccataaaaaattttttggtgtttggaaaaaaacaaaagtggtaaaaaacacacttcgtacaaacgtacacatcatgctcaaaagtccaaaagaaaacttctctcacttttgaaaagaaagaagttcccaatcgaaccaaaaacaacatgctcacttttcaactcatttacttctccaaaaaatttcaccttgcgtctcccccttttgacaatgatttcatcaagcataggaattatgttcattaatgtagatgagcttagcctacatatagcatatcatgtcatgtgttgcaataaaaagaagatgaacccatctataatatagcaagcatgcatgaaagtataaccatgaaccaaagattttacaattaagcttgaatcaacaatcaaaattcatgatttcatacgatttataatgcaacaccttaacaaacacataggttgaagaataaaaactaaacacatatacctattgcattaatcactctttctcaaataacctttagcacaaaacaaccaagagaattttttactttttctttgtcttgagcctttttgctcaattttttctcttttattccgggtacgtccctgtcgtcgatactgttttcagggatgcggcacccattattttgctcacatcgaatacgtccttgtcgtcaagactgtttccaaggattcggtattcatttttttcatatttttattctcttttcacaatgagcaactaaagctatttgaggaataacaattcaataaagcatatatatagagagcatttagaaatcaaaccacatgctagcatcaacatttcatatttacttaattcaagtatagaatttaagtgtcatgcatcatcttccttaaaagcaaaatctaaatctcatgaaaagactagtatacatacaagctatgctagagacaaataaaccttcaaagtatcgctagcatgcacaagaaaataccatatgtataacacaaagctctcttttctcaatttttctcattatcatatttttgcttgataaaaccatgaggtgcaaaactccccctcaaatcatgccaaaaggatgaaatattcccaattcaccatgaagaaaaacaaagcaattagaatccaaaggtttagtgaaaatatcagcaagttgcaactttgtgtccaaaaactgcaattcaacatctcccttctcaatatgatccctcaaaaaatgaaagcgaatatcaatgtgctttgtgcgtgagtgttgaacaggattcttagcaatgttaatagcactattattatcacaaaagagaggtactttctcaaaagtaagacaataatctttcaaagtagataaaaaccaaataatctgtgaacaacaactagcagcagcaacatattcagatttagcagttgattgagcaacactagattgtttcctagaagaccatgcaatcaatgatgtaccaagaaaatgacatgttccactagtacttttcctatcaattctacaaccccaaaatcagtattggaatatccagttaagcatatagaagatgaagtagaataccaaattccaaactcaagtgtatgattcaaatacctcattattcgcttgaccgcttgacaatgtgaagcacgaggagaagcttgaaagcgcgcacacaaacacacagcaaattgtatgtctggtctagaagcagttagatacaacaaagatccaatcatacttctatactctttttgatcaacagctttaccatcttcatcaggatccaacatagccgtagaaccaattggtgttgaaattggcttgcaattctccatcttgaaccttctcaaaagatcctttgtgtacttcgtttgatgcacaaaagtaccttgaggtgtttgcttaatttgcaatcccaaaaagtacgataacttacccatcatgctcatctcaaattccctgcgcatagtctccgcaaactccacaaccaaagcgtgagttgaacaaccaaagatgatatcatccacataaatctgaataaaaagttgattatcaccatgcttaagaacaaaaagcgttttgtcaacctttcccattgtaaaacctttcgcaagcaaaaagttcttaagcctatcataccatggtctaggagcttgtttcaagccatacaaagctttagacaatttaaaaacatggttgggaaaatcaggattttcaaaacctggtggttgtttgacataaactttct

SEQ ID NO: 27816 - DNA, 4137 bp, Oryza sativa
  unsure (1)..(4137): unsure at all n locations
aattttcaagttcttcatgcatgacgttaatccacgattcatcagttaatgcatgtgacacatctttgggttcaaaagaagcaacaaatgcagaatttgcataaacatcatgagtcgttaccttagaccttgtagtccgctcacctaaattaccaataatttgttccggcggatgtcgtcattgaatgtgcaaaggagcagtgacttctgaagttgattcacgtcctgtatcagtactagtcgaagttgtaatctccggaggaccatctcgatcagcatcaacagtaccggaacccgacgactcaggtcgatctgaccgtacctcctgtgtcggtctgaccggcggcttgccggcggtctaaccggcctggcgcctggtctgatcggccgagccgacctcgtcgttgtcgtcgtcgctctcgtcttcaaaaatacgaccatcctccccctgaacctgtgacaatgtacctgcaatatcgggtctagtacctggactagcctcatcaaaaaaaacttcgcaagtctaaacgattttgttagtctccaaaataagtacacgatagccatgagaatgtgcggcgtaaccaagaaacaatgcatcggtagaacgtgctgcaaacttatccaaatttccagatttcaagacaaagcatttacaactaaaaacacgcaaatgtgaaactttgggttgacgtccaaatcaaagttcatcagaagtttttccaagttttgatctcaagaaaacccgatttgaaatataacatgtagtgtttatcgcctcagcccaaaattttctaggagttttatactcacccaacatcgttctagccatctcaaccaaaacacgaattttcctttcaacaacaccattttgttgcggaacacgaggagaagaaaattcatgttcaagacctcttttgttgcaaaattgttcaaaagaagcaattttaagctcaccaccattatcacttcgaattcttttcaaagaaccaggaaattcaagatccaatcgaagaaacaaaccacgaaagtgttgaaacgcttcgtccttagttgccataaagaaaacccaagaatatcgagaaaaattatcaacaataaccaacacataccactttcctccaatagattgcactctagctggaccaaccgtgtctatgtgtaatagctgtcccggtgcatccgtcatcacaaaaaacaataggagcatgtgaagaagcaaccatcttagcatgacgacacagtgaacaaaccgaatcaaaatctttcttaagtttaggcaaaccacgagcaagatccaaaccacttaacctagtgagatgatcaaaaccaacatgtccaagtctacgatgccaaaacatcacatttttatcaaatttagcaaccaaacatgttatcacaggtgaaacagaattatcaaaatcagctttaaacactcttccatagcgagaaatattcaacacagaatcaccacaagaatcgaaaactttacttccagttttcttaaagtgaacctcaaaatcttcatcaacaatttgtgaaactgaaagcaaattgtactttaagtcctcaaccaaagctacattcttcaattcaaatttctcatttaccttaaccaaacctgtagcgagaacgacacttgtaaaaacatcaccaaagataatcgattcagtcttggatgcctttgttagggaggagaaccaatttttattaccggtcatgtgccgcgaacaaccgaaatccacgatccacatgttctccttccgcgccatcaaagcctacacacaagcagaagtcgaagcctcagtactggggttagatgataacaaaaatttaggaatccagtactgagacacacgaccagaagatccaataggcatatatccatgtgcaattacagtttgagaattttcagaaaaatttctccgaggccggtctgaccgagggtttgcagctggtctgaccgggggccggtctgaccgccgcttcactgccagtctgactggtgtccggtctgaccgaggctctgcagccggtctgaccggtcgccggtctgaccgcgggaaccactgcggtctaaccgatttcctcgaaggaaacctagatttttgccactttgattttgcaaaagcaacctctctctcctttttctgtttatgagctaatctgaaacaaaaaccatcaatatatccatatttgccacaaaaagaacaagcatatttttcacgattattagacacattagtagaatcagaagacttagcaacacaagcaacaacaggaggttttgcatgcataacattggattttaaagaagatgcactcaatgtagacatgatacccacagatttaaatacagttttattagtatcaggtttaaccaaaatctcaccacctctagcaccaacacctaacacaacaggaggatgtctagtatgatgagcataaggattaaaacctaaaccacggttatgtgtgctaactttagattaatctaaaatcatgttgaggttctttttaccctcagaaaatctttgcaaagaatttttcaaatacaaaacctctttttccaaattagcacaattttcacaatctaccataacacctttgtttttacgacacttagagcaagaaagcacttcattgtttttcacaacatcttccatgtactcaacacgacctaaagcaacttttagtttcttcttatacaaagtacatgttgagcaatctaaaacatcatgtggttgttttaacttcttagcacaaatcatgttaaacatcaaactagcatgaaaaacaatttgatatttttgcaacaactttttagttaaaaacaactcatccaaagtgcgtgtgtgcaaagcaaaactaagagcaagagaggatttatttttcaaatcatgtgcaacattgacatctctaatttttgaaatctcattcattaaaacctcacaaattttgcaatcatcatcattaggaataagagattttaatctagcaatttcagaattaagagattcaatgataaactcctattttctatacatcttctcacacttcttattttttgcactcaaaatattaatagcttcctcaagagcacttacctcattgtcttcacactctgaatatgattcaccacgtgccatgaagcaaacaacggagatgttctttcccttatcttcatctccactatcaccatctacgtcgcttagtggctcaaacgcggcgtagacttgatcaaaagccttcttgagattctccttgatcttccttcctttgaatgtacccttcggcttgttgtcattgttcttctctctatcattgtcttcccttttgcctctcccaagcttaggacaatgcgaacgaagatgatcaatcaaaccacattcaaagcaatgatttggaccacctctcttcctgaacctgacattgttcatagctcgagcaattctgttagcaaccaaagccaaatcctcctccttgaactgttcgagttgatcatcggatgtggcattaaataaagcaagaatagaagactttgatgaagaagcatcaacatccaaagaagaagaagaagaaaccaaagcactcgacttagaatcaactctacgagaaagaatgttcatctcatgtgttttcagttttgtgtaaagcgaatctaaagtcaaagtagacatattaacggactcttgaacagatgtaactttcatctcccaaatagacatatcaagaccattcaaaaagtggcgagaaatctcaaattgtggataattagcatcataagaagaatcaacaaatctaagatcactcaaaattttgttaaacctagaaagatagtcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27817 - DNA, 549 bp, Oryza sativa
caggcggaaacaccagtcggcggcagcgaaggcaagccggtcggtgaagacgtagacgcccaacaacggcggcataataggccagccgtgcaggcggaaacaccagtcggcggcgggcgaggcggccggtcggtgaagacgtaaacgcccaacaacagcggcataataggccagccgtgcaggcggaaacaccagtcggcggcgggcgaggcggccggtcggtgaagacgtagacgcccaacaacggcggcataataggccagcgtgcaggtggaaacaccagtcggcggcagacgaggcggccggtcggtgaagacgtagacgcccaacaacggtggtataacaggccagccgtgcacgcggaaacaccagtcggcggcggacgaggcggccggtcggtgaagacgtagacgcccaacaacggcgacataataggccaaccgtgcaggcggaaacaccagtcggcggctgacgaggcggccggtcggtgaagacgtatacgcccaacaacggcggcataataggccagccgtgcatgcggaaacacca

SEQ ID NO: 27818 - DNA, 1006 bp, Oryza sativa
cgtcctcctcccgtcggccgtgccggcgaggccgccttcggcgcgccctcgcggctgccaagtgggcccggccgtcagccgcccgcgcccggccgcgtgcacccggtccaccgtggaccgtggggctgacgcgtgggccccactcccgtggacccggtccgcgcgccccctccctcggctgacgcaataaatgggtttttaattaaaatttaaatgaagaaattcgtaaatatccatttaaagagcatataaacttcaaatggctttatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggtgtttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgacattattattgctattgttattattaccttgttcaccctagaataaacaaaaccccaactagtggacactctatttatggttccactagtatgaatttaggtagatgcttcgctgattaataggacaacattaggtggttttacaactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaagattaagctcggcctctggtgcaaagcactaccgtacttccacatgtctaatgggtaaggcttagtttgtggctcagtct

SEQ ID NO: 27819 - DNA, 1287 bp, Oryza sativa
ttggtggcatacatgctgacaaaatactactatcttaggggatatttctttagccccttgacaattcaccgtgctaagaccaatttgctagagttatggtctaggggttttgatctccagaactcacgcttagtacatatgcaatctattctagcccctcacaagtaaagtatcaaggagttctacacaaccgcagcttgtttgggttttaaagttcaagatttgggaaaccatggggcatggcatgttgaacacaagagaccagaatcgtggaattgactaatttattgaactcaaagtaacatgtcattggaaattatccagcaaacataataccatttcagttttaatcgcaccaatttccctcgaacctatcacatgatgatataaacaatgcagaaagaaatccttagtaagaggagagcaagcaagggcacgaaacctctctcgtcgatcactgtagcttcatctccatgatgctcttggcctttggggcgtacagagagtacaccaccgcatgccgttttgccacatccagctgcttcttcccgtccgcgaacgccgtcgccaagggcacggttctcgcagaaggcatccgctgcacacggcagcgcgtgtactcgtggatgttgtagttggataactgccatgccatgcggaggaagggtcagagcctccgatctcgtcggtgttgccaccaccgccgctaccatggatgcgcttcctcgcggatgctttttgtacgctagagaacggagtagagaagagctctcctgaatccagaaagatgcttgggctaatgcctaatgggctaggcgcctaagcgcggagacgagctaaaacaatgcttttttgtcaatttaacacatccaccctcatggagaatcctattatgaattggacccttagagtgtctaatgtcaatgtgcatgtccattgtcaaagtgtcagtgccaaatcaaatcaagagtcattaatcagttcaaaatgccgttgtgatttgaccttttgtccgtagtaggtcagttcaaacgataatacttttctacacataagaaaatagtgaaaccatgaattggaagattatttactttgctccatataaagttaaatgatggacaacacagataaagataattaaaagttgtataaacacatatcaacatagatattataatcttccaaacacatatattattttttttgcttattaactacaacaaaaatttaaagtttgaaacttaaatttagaattgaaacttaaaccgaattacctctctaaactcc

SEQ ID NO: 27820 - DNA, 10158 bp, Oryza sativa
agaaagcacgattaattgaaactggtgagtaaccttgtgactgccagttttcttatatatatatataggagtatatggacaattacacctgaggcgtgtgagtgcgaaccctgtaccttgttgagtaccacaggaaatcactggcatcggctgtggtgtttatctgctccatcagtccaggtttcgtcaaggcgttctcctttgtaataccaacaggctctatggcataactccagccagctgtagcaagttccggtgtgattaatgaatcatcagtatcttggatacttgatcccaggcttctcatttctgaagttgttacctgagaattgatctgcaagggggcaaccacatccacatgcatcagaatcagttctcaccaatgttctttctcaaatgcagatcattgtctagcaaagtgagggcaaggaatgcacatacctgggctgtgttcaataccacatttttgcagtcaggaaggatgcttacagaccaggcagggagcttatacgtgtttccgttgaatttgacagttttatcagactgagcatccacgttggcaaggaatgctgcgcatattgaattgtcagcagtctgatatacggttgcctgaagccagaagagtacaaacacccatcatcatgtgtaccggaacagatcatcaaggtaaacaaatattttatctctgaacaagattagctatacatctctagctgctccagcaattttgattgactcatctttctttttcgttaattaatacacgggttagtcacttttcgaaagagaggatcacatacctcagtattttgacccaaagaactatatgatggctcagctgctatgagtgctggttcgcacagctttattgccttgtgcacatcccttaagtggccccactttggctgcctgaccatccctgaaccacaatattgcaaaagatagtgattcggttagtgagatgtgtggttgtaccggtacacccccaacacataggggagccgtttgggctcaatttttttggttcatatctttcttataaaagacacacggttcctcatggatattcatgttctttttttaactgtgactagtcaatactagtattcccagacggcaaacatacttcaatttaacatagctgccattgacaggcatacatgtggcagtaaataagtacagctagctgctgacagtacactcaccatactcatcaataggagcatcgtagtcgtagctcgtggcgatgaatggccctcccgtgcttcgtccgaagttggtccccccgtggtactgcaagccaacaaaaaaccagtgttagaatcgcagagcgcctctgtttacccaagcgaattggcaaaacggcggtaaaaaaggaaaacaaaaaagaaaacgtctcgtcttcgcgcgcgagctgcttaccatgtaatagttctggaacgtgccgccgcgctggtagaatcgcgcgacggcgaaggcgaggtcctcggccggccggtacggcacggcgccgccgaaggagaggaaccacccgctccagttctccgtccacatcttgggcttgctcttggagttcggcgtgaactggtcgcagtagaacccgttgcacgtgttgatctgcatgcgcaagcacggagaaacggtgccacgtcacttcagtgtcgccgtgtcggtggttcgttcacggcaccggtgatcgatggcgattggcgaagcagggggaagaaaactttacgagggggtcgggggcgtcgaactgctggcacatgacccacggcacgccggtgtcgaggaagacggccatcccggcggccccccgcatgtagcccttcccggcggcgccgtacgccgagtcgatgttgccgtactcgttctcgatctgcgacaggatgatcggcccgccctgcgacgcgtacagccccgcgccgttcatcgtgtccaccaccttctccgtgaaccgctgcatctccgccttgaacgcctcgttgtccgtccggaacttgatccccggcacgaagtgcagccataccggaaaccctctgcagtaatacttgcgtttcttaccaatctatcgatcaattcgcccagcgatagccagtgcgagagcatgagagagatgtgaatgcgaacccgtagttccactcggcgcagacgtacggcccgatcctgaggtgcacgtagaggccggcgtcggcgacggccttcacgaacctgacgaggtccttcctgccctcgaagtcgtactgttctttttttttcgttgcaaattcatttgagtcagtcagttagttgatcgttaaacgtccgtgtagcagaagcggagtagtgtgataatgccgctttagaatttccagataatgatattactaatactagtagcagtagcagttcacggggagaaaatggggagaaaattgtaatattgggattgcaaacatagaggcttcgctgttttgacactctgagtgaatgacaaatgggtccatctgtatctataaaatgtggatccaatgtcattatagtaaaggttaatgtttacaccgttgtaattgtaaatcaccagttcacgggaggcagaaagcctagaagtgagtgagagaataaagcatagggtgcagaggaagcaaacaccgccctttgacacatgacggccaggagggagaggagatgatgacggaaaaaaaaaggagagaaaagatatacacaggtcattaatttgataatttcattgtggtacactattaatggagaatactactactactagtagtggtactaagtagcagttgagagaggagtacgtgcctgtccccggacggcctcgtgaatgtcccagaagacgtacgtctcgatgacgtccaggccgccgtccttggacttctggatcagccccggccacatctgcaaccggcgaccgccaccgccgccgccgccatggcaacataatgtcagcttttgtaactagcaatctgtctgctcatcaagaacagaggaggccgaacgagcggtgcatggggcaaaagagagaaagggcaatagacggcgacgtacgtcgggggtgctccgcgggtagtggatggacccggagacgagcacgcgtcgcacgccgtcgatgaccaccgcgcggtggtcgtacgtcacgttcgccgcccgcgacgcgccgacgaggaggcttaccaccaccaccacggggaggagcagcagccgcagcagcacacccaccgtggctgccgccattactgccgccgccgccccgttcggtgtcgttctattatcaccggcgctagtgcggacgatgacgaggagcagcaggaggaaggaagaacagagttgctcggtgggagaggcaaaagaaaagaagaagaagaagaagaagaagaagaagaagaagaagaggagttgctggttggagtggcgcggcgggacggaaataaatggcacgcactcagcggcagcgacgaggctcgctagcggagcagcgggagcgaaagcggctgtgtctctttcccgcggatgcgggtggtggtgcatctgctgtgctgtgctgcctccctccgcggctaataaaaaagcgctgatcgttcgcccgcgcggcgagcgatggggtgggtgggtgtggagttgagttcgcggctgcttgcaagcaacggcaaaagccccggcgccgtgcgtctagcggtaggatcgaattgatggatggatcgagcaaaacataattactgctcggcttggctagttaatggaggcgtactacgtgatggttcggtggcgcacacggcgtgggtggggggggggggggggtgagcaaacgccacggccacgccatgccgcatctgatctctctcccgtccacccttttgcttccgctgctgcatgtgcccttggcattggccgcacgggctcacagctaggacggaccagtaaacaaaaggtgccggtgtgaccgaccgacagacacggcatggcaggggtcgtgcccgacccgacccgccgttcattgccgctcgatttctttatcagtgatgctagtactactagcactgcgtctgctcgggccaagagctaagcggcccttgtcgcttccggtctcgctcgcctatagtacctccgtcccaaaataagtgcagctgtggatatctgtgttcaatgtttgaccgtccgtcttatttgaaaattttatgaaaaaaataaaaatatttagtcacacataaagtactattcatattttatcatctaatagcaatagaaatgctaatcataagaaaatttcaaataagaagaacggtcaaacgttaaacgtgaatagtgtaaaactacacttattttagtacggagggaatagctacttcgaccgtgatggcgtatgatatgctgcactagcacacggttgccactaccaatctagcagtagatagtggtagtgtcatggactgtactccctccatcctataaaaaagtaaaacctgagttttcgtttccaattttgactgtacgttttatatgaaatttttttataattcgtattttcattgttgttaattgataaaacatgattaatattttatgtgtgacttgtctttttaatttttttcataatttttttaaataagacggacggtcaaacgttggacacggaaaccaaggtttatctttttttttttgaacggagggagtacgtctgtactgctcgtcttctttttgtttgggggaggtttgaaaaaaacggtggcggtggtcagaccgtgaaaaaaaggctaagcatttctccctctttctttcatcctttggggcggtggaaaatgatggtgcgcggcgacgacaaaaatcgtgcgaaagcgggagagcgagttgtctctgcagtctgcactgacctgtggcgtcggttcatggggaggggaaaggggctcgggtcggactcgtccacaggggagcaagtgaaaggacatggaaaattgtatgcaaagctttactgctgatgcaagagagtgacttttatatattgtgtttgtttgccatttttcgtgttacaagcttacaaggcttgtactacgaaagcttacaagctttcgtgtttgccattttatcttatcaagattcaataaggtaggggtaacaaactaaacggcctccgtatccaaccaaaatttagcatggttaaatttgatatcaaaccaaactgctctacatatggaatttgtaccaaagcattacgctcaactctacaaaatctaccaaagatacacgcgccctttttgtttgaagaaaaagctaatagagctaaccaagtttttgtggcatgagaaccacgtgaggcaactgctacactcaagtacttggatttctaagaggtagatatttcttttttggctactgaagaaactgactgcataatctttctctggatgctcgaatataatgtagttcaatgtgaaatcgacatggcacacgccattgttaacctagttgggtgacccacctgattgcattcacagcatatttgcccgggctatgcaattagtactcttcacaagtcacaagcatatataaagacctatggtagtgcagaagcctattgtttggactgtcataagctgggatgtttggaacgctgtaaaattcccgtacgaagaacggttttctagtaaaaacttttgctgaagataagccaaattaactgaagataagcaagcagtcactagcttgatattgtagagtcaaacctcaccatttatcgatcagtggcgcgtctaattgccgtctatcacattgactagcgtctgaaattagaacacatagtaaccacaaaaccgagaatggcgatgccgaatcgtgaacctaacccactacagaggctcctgaatcgaattgaacatctggttcttctccagagcaggtgctcggcttaggtgtggctcagctcaagtcaatcgtatttggtgctgatttgctacttacagtgggcaaaccacacatcttgcacgtcaatgtagaaggcgaccatttctcgattcacttttagtagtaacgaaattacctacgccaccttgacaatctttaaaccctttttttttgacacagatgtaccatagtgtcctgtcatctgttaacacaaggaaaatccagaagtgtcatccgaatgctgtgcaagaaaggaggcacatggattcaaaagaacaaatccatattttctgaaaattgttgactaccaaaaacaaaatcttgtgctgctccattcgccacctcaaccattccaatacataaaaaaccggataagaggggagcgaaaatgagaagtgaaacgggtgaagcagagcgtccagggcttcttcatcatcatcatcatcagagcgtccaggcctttaattgaactcgcagtcgggaggctgcaggtgcggcgtcactgttgccgcggttcgttgcggcatccttgtagcaatagcagcacatcggcgcgagatcgctctacgtctcgacgtgcgaatctgatgtaactctcctcgtcctttgcggcggattcgtccgggctctccgtgcgtaggtgtgctaccggcgcgcgcgtgcggcaccaccggcactgccactgccaccaatgcgcgagaacgtaacaaaacgggcaaacggcgccttccttctccactcgattccttgtcgtcatctcgcgtcggggtttttggagcagcgtgcgggagagccggccgggccggtcacgccgatgtggatgtgggcgatgtgcacgctgcgtttgtgtgccgaaacgagagaatttttcgccgatcgatgtgtccaagacttcccagtgtaatgggaactcatcggattattctttttgattcttggttaccttaactttccttttctttgctcggtggtgttcctctctcgttaataagatatatacttttcaaactataaaacggcgtgtttcttaaaaaacaatttatataaaagttgcattaaaatattaaataaacctatttttcaaatttatattaattaaaaaaataattaatcacatgttaataactttttcgttttgcgtaccctaccttcgtcttcatcttcactatattctaagatgtttttttttaaatctatctggtatggggtttggggcgtacaaggtgagccaagtgatgccattgatgaggagagttttgcttggaagagtcagcaaagaactgggagagttcaccggcttgaagcctccattttctgcacggatgcgattgcagcgtagatgatgccgcggcaagcaaggagaaagatgagctcggcgagggggagagtgacacgctgacagggatactacggagcagataagatgcacggagcaccgctgccgtgcaacacggcagcgtcgtcgaagagcggcacggcacggcacgtctcaggatactactagtaataacttcgaggcagcgcgacaggagcagactacgtgaaacgatcgccagcgcagcttctggcacgagagagtttctcagcgagatcgacaaggacaatgatgaattaatcgatgaaatctaccgtacaacacaaggcaaaaaaatgggagaggcaggcagccaggcagggcctgatccaaggtgcactggcactaaaaatctgaaacatgttctggaaatggaatgccgaaaggcgaaagggccaaaggctattatcgctggatgtcgtaacattatcttgtcaagatccatctgataggagaatggtcatagcagcaaaggacggggccaaatcattgaacgcgacagctttgatgaccatgtaatgtagcagaagggatcagtacggtatctgaagccaaaagaaccggagagaaataaaggagaaaaaaggattagatctgacgtcctgcgttttgcacgttcacgtactagctccccttgcgcaattatgcaagttacctgcagttatggagtgcacacaaccgcgcttcagatgtacagctagtataataacatcaagcatcaccagagaatcaatcaacctgatacaggtgaacaataataatatcacgcggttgcaggataagatttgtgtaagatgctaatctgtcatcgacgaagtgatggagatttgagaggacaatggcggcaacccacctagcggcgagtcaacccagaacaaaggactaaaacagaaaggaaaaaggaaccaacaattttgctaatttcatggaaaataaattagccaatggtttaaaacaaggcagacgagagttgagagttgtccatactctttgtacttttctaattacataaagagttgttcatacaccctttttttttaagatagtgaatagaaatcccgtctctatatctatcaacggatagatatataaccaaatatgtatcacgtacttttgtgtccgttttaacacacgcttaaggttacacccaccaagatttaaacaccattaattacactgccacaccaaatatcctttccaatcctcttctcttcttttcttttggataccttagtttgaccataattagtgggtaggtgagaaaagttgctgataactgataagcgtagccactatgcattagctactctatcctctagggtgctctcaaaagatatgtgaaggtttgaggccatccttccgtgtcagttgacgccttgccaaatccaccacaaaaggctagtgcatcaacatcatcaccattcatcacatgaggacatactacacatgcaacaagcctgcccgacacaggaaccctttagattattagcaattgtgaagcaatgtggagatcggatcaagtgatttactaatctactagcaaggcccccccaccaacaggaatgtcactaacctatcaatgtgatgactgttcctctgaattcttcctgccaatgcattgctggcttttgggtcacggattcacagctctggagtctggagctgcaacagctgacgacgaaacgacaaagcaggcacaacaactcagagctgccaagatctgatcagagcaggcataacaacctaagatactccttcagttccggtcttgcaagctcaatcattactgttgagaagccgcactccaggaaaatgattgaaataaaatccaaaaagacgattactggattgaacttagtctcacattttaatccacataaatgttacttcctccgtttcatattataagattttctagcattgcccacattcatatatatgtaaatgaatctagacagcatttatatgaatgtgggtaatgctagaaagtcttataacatgaaacggaggtagtatctcatattatctatctcaaaaccaactgtatttaatacagcattgagaatatctagaggaggtatcaaactctctcaagggccagggcaaaaaaatgttctacacctcacactacaaccttatattaactattagcaacccagcaaaggactacatttccacttctgaaaaaaactctgaaaaaaggaagatgccgatggattgtacaagctattataagtgggaatcattttgattgttgaaagactagtggctaacaagaaaatgacaacatggagatttcctacttcaggaaggccgatgatacaaaaaggagtgcataagtaacacatgcagtgctcacttccaagtttcttggaccaggcagtataggcggaattacagaaaccatcaagaatgtggcaaggaaccaggaagcaaagaaggatccgaacctgaaaaatcagacaaacttagcatcaggaattgaccacacctatgcatagccagagactatatccttttgcctattacacaaattatacatgaaaggttgacaacacattaaagtcacctaaatgataaacttcaaatcatccaatccttaataaatgaatcctatgaaagcaagtttaaagtgttactagtattgacatgtctattacacacaactgcagtatgccatcacaaaacaactactctctgatccatcacgaattcatgataggtgcctcaaaatatagaacttttgtagaataaacaagattcacacattttgcaccattcccatttgaagaaaagtctaaaaaagcaatgagattgacatgccataataggtggcgcctaggttgcacttgcacataataagaacaatgagattgatagaagaatgaataggcatagagtgaaat

SEQ ID NO: 27821 - DNA, 2328 bp, Oryza sativa
  unsure (1)..(2328): unsure at all n locations
nnnnnnnnnnnnnnnnnnnnnnnnnnnnnnnncttcttcagtagggaaaacaagggtaagcactccaagcaatacaaaagttattgctgtctgccaaatcactttactagaaggtgtttgaaatcttccctgaatagccttgactggacgtgactgagtaagttccctatactttttcttgagatccacttttggtttttttctatcagagaaactctgcatgatgattctgtcatgggcagactcaattgcatcaacacttggcttatgccctgcatacttgtttatcagaaaattcctggcagctcgaatttcttcttcagatgcttccctgctgattccaagtcgctgatagggatccttcacatggattctaggaaagatggctgaagaaattaagcggttaaaaagtgaggtgataattacaaaaaagaactaatccaaacaacaaaaccgacaggacaataaaaagtatatgtgatctcaaataaaacatgagaggaacagattgtgagaaaaagtatatgtgatctcaaataaaacattagaggaacagattgtgagactaaatggcgtgattttgatataatgtccaatgctttggccatggtatagttaggtatttatacttttacaatttaatatcaagcatgccttacagcaaactacacaatttgttacagaggtataccaagtggttcctagtaaaccatactgctcgttactataattcaacatgacaaatttggttggtaaaagtacatatatgtacttactatgttacatttttttcttacatagccctaggaagttaaatacttacgagttgacgagtcagctgtgtcaccaaatgatgcagtagcaagcggtgtgattctggtgtttcgcggtgcataacagaaaggagtactatactttgtgtatctgcatgaaggatcgcaataagatttcccactgcataaactaaagaaatctttggcagagagttgatgaggccagaagaagcacaagatacaatacctatccacattgatgaaaagtttaacactttccttacgtcccctgctgaaggccaacgaagagacaagtcccaagggtgcactcgacgccctcgaagtaaccggacatcgagcagcccttgaaggattgattgctagactatgtgccaacatctcaaggaatagttgaacagcctaaattgaggcctttcccctcctaagcacaacaacagtaaattcatcaatcacctagaacaaatttagcaaaggaaaaccaatgccatgcacaaagatacacaaccgaacgctagcagattacccacacccattaattaaaaaaagtacaatcatcacaatatacaacttaggaacctggataagaaagcaattaattcagacaaggaggaacatatcgagcgattagcagccaaccgaccgtcaccctcagaaatcaaggggtgtgtagcctgaaaaattcacaccattcaccacacagtgccaccggaaccctacatgccattaccaaccctacaacccacggaccctgcacctgcatcagcatccatcccggcgtctaacctaacctgtcctaacctaaccatcggtgcaccggcgccgcaccggaatcgagcggggtcaagaaggcgaagacgaggagccttaccgtgggaggtgacccgcgcgtccggcggaccaagagcggcggcgctgggcggaggaggaggccgcctccgtggataagggggggcggggtggtgtcgcgtcggtgagggtacaggagaacgctgcgcagggtggtggtggtacttccgtaatttccttccgatttcctcctcgtcctagatggccctatactctcagggcctaattgggcccagcccaaccgcgatcccaaaaaaggagtgggccccacctgggaacggaatgcaaatgcaatggccacggtcaaggtcgtcccccttctcctgcaggtgggccctgctctcccacgtcagcatcactccaagtgtactttaatgtgtgtctgaggaggagaatgggattgagtagattgagaagatacgtaaaataagatgagccattagctcatgattaattaagtattaactattttaaatttcaaaaatgaattaatatgattttttaaaacaattttcctatttaatttattttaaaaaaacgcaccgtttagtaatttgaaaagcgtgcgcgcggaaaacaagactcaatctcccctatcaccgaacagagcctaagtttattcacttggacagtgggggtggatacacgcacgcacgcgatccttcggcgttcgcttaccccgcgcggg

SEQ ID NO: 27822 - DNA, 2056 bp, Oryza sativa
ggtggatacacgcacgcacgcgatcctccgccgtccgtttcaccccgcgcgggcgatccttcgccgtccgctgggctccgcctcggagatccggcctcatccgcctcgtcgtctcctctcctcctcccccactcgcgtcgcgtctcctttctttaattgcttctctctcttctcccaattgcagtcctctcccccccactaatcccacccggtaatccctctcacgatgaacggccgcggcggcgattctccggcgacgaattgctgcaggggcggttcttcttcttcgtcttcgtcttggcgccggtcgatgtgggtctggtcgttgagtttgtatgcgatttgaccgctcccacgcacctgtggcgtagttggttgcggtgcaactgttcgagctattgactgtttggctggctctctcctcggcgttattctgtggccgtttgggggattgggagtattggaatcctactcttccaggtacccatgataataagttcttccctccaaaagaattcttttcttgaccatttcatcttgccttttggagttttgttgacctgggctaaagttcacttctgtctttgcttaatatgcgtgtgggagtagagtgttctgcatgctataaatggaaggtttcttttttgtcatcgtgcatggacagggctaagcgctcgaacagttttggagtgtttgaccgttttatgtgtgtgagaagtggatccctggggattatatgtgttatttctaggcttgcagcggaataaggtttattgttggaaactttctttctaagatcttgttaatttcattgatgggactagtgcacattcaacaatagtaagttttagaaaaggaacaacaaaggtgcactttcaatatgactaggatgtttgctctgcactttagcccctatagtttcctggacacgctaaaaaaacgcccttcacacttatcttaccttatactaaagccattaaacttaagggattttttagacaatttcttgttttatctcctagagctcacaactaggtgctttaacctccgaccagtgcaccgttcatctccatttttagggattaatcagccactttttgtttaatcatccgactaatcgtccgcatattgcacttgattatcatttaaatatcttttatgaacttcatcttcaagatgtttaagaatattcacaccacagagtacttctcttgatgctcataaattagcagttccagtttgatattaaagtttttagtcaccatatacctttaacttcccaatctaactttgttaagatccttaaattatgtactttatggaaaatcaataaataattcaggtaaatacgatctgttttttgtttttgcattatccaaatagttgttccagataccttttcggtatccatatgtccatatttacttactgcctgagtaactgagtactttttctcggtaatttcatatgtttttgctaagctaaggttttgggcttataactgtcgagtcattacagttttcctttacaagatatgatgatttttcccccaatatggcaatatctaatcattaccttcggattttggaccagttctcctaagttcttcacaggaacaagtctgcaatcaggatggtttctgaagtctttgctaactttgagcttagtgacttgatgggtaattgattctcttgggtgttgttgcatttgtgctgtaacgtggataggagtcatggaaggtgtggtaaccagttcagttggtgaaccaaatcaagacaatgagccaagggattcttcaatagaacttcccagagtcattactgacatggagacttcagccatgcatgatcctgaagctcaaaagctaattggacatgaagctgatactgaattaacgccttatgaaggaatggaatttgagtctgaagatgctgcgagggatttctacagcaaatatgcaagacatgcaggttttagaattcgaatcagcaggtacactcgttctagacgtgataattcaataatttctcgtcgtattgtctgctcaaaagagggg

SEQ ID NO: 27823 - DNA, 13825 bp, Oryza sativa
tccagactcaactcctggagttaaatttaggagttggagctataccaaacaggccctaatatacctagacgatttgtgtattctgtattggactagaaagatcttatgcgtagttctgaccgcggattccacttgtaatcaagccttacagggaaaggatgaaaggtttcatgtactttctaaagaaactacggttgctattcctgcgatacctctcacgctgtacatgcctataatgaagaatccaactggagattctgcaggtaatccatttccttctgctgtttacaggaaataagtgtaaaagtaatatttaaaattctagatagaaattacagatgcatcagtttagaaatctattagatatttatgcctgtcaattgttttcttcatcatatgtggcaagataagatagtaagtttacaacactaaaattttagaaatgacccaataattatatgtttagtaatgcctcttgacaccattttcttttgaaggaacaagaatattcgtgtgtggtctgttgtcctcatctgcaaaaatttaccaattgttttgcctactatagtagtttgcctgacaatttagttcgatagatcttgaaactcttcagtttggcatttctttgtttctttggaatgataggtggcttggagcattgtgtttatctgggttactttttttcttttttgcaatccaagaacataagtcatttaggatacttaataaagcttgtatagttgtgcaaatatggttataattcataccattgctggtagctttcaaaaagaggttatatcatttctagtgaatcactgtgagtatttactatcataaagcatttgcactgtacttgttaaaacatttactagtattatttgttttcaattccccagcgatcacatgagtgcttactcatcatcataaagcttttcatcatttagtcgatttccctacttgataactatctaccagtggatcttgattgattgctacctgccgttagaatgctctcctgacatcttcccattttcctggaatgcagatggccaatacaggttgttggccgctcctattgaagcagttccaatttcataccgtcctgcagaacccatccaacaaccacacggaagttttcctaattcagggccactacccggttttctacctaaactgtacaaacgaggaaaaggtccaaactcgctggtgcatgctactgctcttgcttgtggtgctcgtgtcgtgcctcctgaggaggctgcctcgctgatcaaggctattgagtccaagatcagatctggaggagccacaatagcaaaattgccttcaagcagcttgacacctctaattcctgaggtcgcctctatgtcatcttctagtgaagatgatgaggaaaatgaccacagtgagccactgatggcgagtgttgaacacaactgccatgatcagagctctgaggaaatgaagttggaggctgatccaccatcagagttggaaactgaagctgagaattgttctgcgcagccagaaaatgaaaacaacggtcctactcattgctgacaactgagaagtgagaactgaagtattgaagctttctgaaatcaaagccccacaaggtagtgattatatatatactgtaaattttgagcatttacataagattggatttaggattctaacagcttgtctcacttgaattatagattctaattgtgataactcaaataatttacttcaataaaggacttgtaaagagggtcgccttgctgttacaatatttgtggataatgtatacatgcacttttatagaaagaaaactaatgtcacagtatcttatattgaaattgggtccatatgtctggagaaaacatttagccatgttatatgaccacatttcacggtttaagaatttcacagacgaaggtccaattcgtgtgcaataattagggaaaaatcgcttgtttttttttgacaattcctaatatcacttttgctttcatttgaatggtctcaccaaaactcctgcaagctgaaatatagacaatagatatggttgcaaatggttccttccatgctaacatctccattcttgaaagctagaattttctcaaataaattttctcaatttttttctcaagctagtttagtttcttgaagctgaagctcaattttgatactgcaatataaagcgtgcgggatgatgtcgagcaccacaacgtttacctggtgtcgttcatttctttgaaaaacagcccccttcttcattactcttttatgcggttatgcctgaataatcctaatcaaagagaaaatgtcaggaagaagccatggtagtttgccactcgtgcacgatccggcactatgttgaaaaggttatcactcgtttaatcaacattatcgctgacctttcgacaacgaattggcagagcaaatattgcactaatccatggcgtcgccatgaaaaggaaatcacccctatgtcaaacggctgtcgtaccagagcagcagtgctgtaccagtgtacggtgggtgaacaagattctcgtttacttttttctcgggagagaggttcaaaagtcatagttctgactaacaacatttcttggaaatcttttaagtgattcccttaatgctgacacgatcaatttctctgggatatttgtatgccgtgcagttctgatcttctcagtttaacgaagggaacgaacctccttatcgtaagttgtacttgtattatcgtaaaaaaatatgtgtattccttttgtgttgaatgtgtgagaataatttttttgaaggtacaaacaaatgaataattattataaagttagaaaatgaatatagaacagtattgtaagaaattcatatgtaattagttttttttcctataaaaaatcatactgtataacagttcaagaagcatactcattaatccattcatcaaaatggaacaagcagggcagaatggaggtgtctgatggtatagtaacagaggagcaagcactggacatatgatcaaatcaagatgctttcaaattccaattcagaaaatagagatgtgtacaggggaagggggaatggagcatactgcatacacaccgtcaagctagacaaactgacagaacctaacagacacgcatgaaacttataggaagctagctaaactctaccggtagctgcacatcgatccaacattttcgtcatcatcattggcaaacacgcatagacccacttctttattgtaaccaactgactagcttcatcgcgttctttatctgcatattttttattcttcagtaactcaaaagtttggtccagcagcgaggatcttgtctgtcaggctgctgtctcccccgatcttgtagttggcgaacacctcgaagttcttcttgaacaggccagccagcttcaggagcgtctccttgtacgcgcccttgtccgtccactgcacagaggccacatttccgacgaagaacaactcagactctgcattttttacatgtatagcagaaatggcatgaactgatgcgtgatgctacggagcttacggtgttgatcgggtcgaggatttcagacgggatgccgtcgatttcagtggggatctccaggccaaacacctccgtcttcttgtagttggcggtgaggagctcaccggagtggatggcgtcgatgatcttcctggtatacggcagcctgatccgcttgccaactccgtacctgaacagtgaattcagagttagttcatgccacaggtaaatgtgcaatggtgtggacgctgttacagtggacagtagcagataccttccaccggaccaaccggtgttgacgagccacccggtggcgccatacttctgcatcttctcggcgagcatggcggcgtacttggtcgggtggagcatgatgaacgctgcaccgaagcaagcagagaacgtagcctgcggctccttgatgccatcctccgtgccggcaacctgttgaaatggcaatgcaataacgaagattcaggctaaattcctttgttgatcatcaaggtgataggaaggtaaggcaggtgactctgcttctgaacaaaaattgtttaccagagcagtgtagccactgatgaagtggtacatggtctgtggaaggtttagcttgctgacaggagggaggacgccgaaagcgtcgcatgccaggagaatgacgttcttcgggtgtggcccgacgcacggtatcttggcgttggggatgtactcgatagggtaagcagcgcgcgtgttctctgcagaaaagttcagagttgtgagatttccattttttgttttttgctgtaacttttgtgactgactgaaaccggattgcgctttggagataacttaccggtgacagatttgtcggtgtaatcaacttcacgggtgtgctcatcaaagacgacattctccaacactgcagacgccaaacattttcgatcaatgaaatggcaagcgggagaaactagaatgatcgactaaattaaactgaaggttcaggcaactaccggtcccaaacttgatggcattccaaatatcaggctctttctcctgtgacaagtctatgcacttggcatagcaaccaccctcgatgttggacacgccagtgtcactccagcagtgctcatcgtcgccgatcagcagcctgttgtggtcagttgacagagtagtctttccagtacctgccgattaaaataacacatacacaaaatcagccaaaaagatgacagtaaacaacaagggcactaacaacacaaattcttcagtgaaacaggcatcatgcacacagcaacaaagatctcaaacagatatgatgtattcagttattatatatatggtgatcaaggggaacgcgtcagatgagactgagcaggtgacggcaccacgggtgttttttcatttcatccaccgtggagagccatcttattacctgacagtccaaagaagagggcgacgtcgccctgcttgcccatgttgcagccggagtgcagggagaggatgcccctcctgggcatgaggtagtgcatcaccccgaagagccccttcttcatctccccggcgtactgcgtgccgaggatcaccatctccctcctagcgaggttgatgtctacgctcgtcgacgacgtcatgtagtgcgtgtaccggttgcaggggaactgcccggcgttgtatatggtgaagtccggcgtgccgaactcctccagctcctcctccgtcggccggatgcacctgccaagcccatttcccccacatatccattccggttactactgcaattctactacttagtacgccgctgatgtgagatgatcccccatgtcttggtaggcatgcaataggattccagcacacacacacaacatatagtcacatatatctcataatcatggagcagtatacgtcaaggtgaacttatctggtggcgacacgaacgagcgacctaaagatagtgcaaagtgacggcttcacttacatgttgtgcatgaagagcgagtggtacgccctggccgagatgatacggactttgatccggttctccgtgtcccagttcaggaactggtcgttcacaaacacctacagaaatacagaacaaaatatagtttgttatcaactgctgatgtaaaaattactgacacggtcactgaacttgagagtcgtatatcaccttgtcaagggagttgaggtagtcgacggccctctccctgttggtgaggaaagtgtgctcgtccatctcgatgttgggcgaacccctgcagtaggagagacacaggcaaaacagagtgatcagtcagctgcaaatcagcaagcagagcctgcagaaacagagctttgacatgcacaagtagagtaggcggtgaactcacttgccccaccaaagctcctgcgcggaggcctcatccttgacgatgcgcttgtccctcggcgaccggccggtcttggcgccggacagcgtcgccagcgcgccggtggacgtgatgaacgaccccttctcgtacttgatcgcctgctcgtacagctctgctcgcccacatcccaccagaaaacacgtcacttacacatgtcacgagttataatccctgaacaaaaattacagccgttctggcgtcgcgtcgcgtaccagcaggcgagaggttgtagagcacatgggtgaacttaagggagctgtcgctgacggcgatggtcggggtgacgtgcgggtggtggtggtgcaccggctgcgggtgcgaaaaccgcgcgcccttcgccgcggcctcgcccttcctcgccggatctcccctgacgaccttcggcccggtctcacgcgtcagcgacgccaacgacgcgctgcatcagacgtcatcgtgacagggatcgttccatcagttaattaccactttatcaggtcaaaataataataataagaacatccaaagaaaatcagcacttgctcagttgcttgctaccactgctaaacttactcctaaataaaagtaagaccatgtctcaatgaactcattgtgtctagttagtccgaatagaatactgtgtcgagcggcttgtgtagaacgatacgaggtttcctctaatttcttgggggaaattcaggcgcaagttacgcgacggcaacagctaccgacgccgccgcgtcaggctgatgaggagattatcgggtatccccgcggcgcaagttgccgccccaaattgcgctcgcgttcgttacgtctgagacaccgcatcggcggctggtgcgtgtcgtatcgtatcccccaacaagccctatcgcgataccgtcgacgttgccgatcgacacaaacggcagcgtgcatgacggaagcatgtattgctctcccaaaaatacagctaaaatcaacgcctctgttgtctctaccgcccaatcgaattctgtcacgccaaggttcttcgctcgctccccagcatgactgcgaaatcgtattgggatttttgggggtttgcgtggattcggtgcgatgcgagggggaatgcgaacttgtgcggtgcgtgcaagcgggtggatgttctgggcaattttgtgatgcggtgcggtgcggtgcacgggggatgtcacgtgaaaggctgcggcctgcgggcagcgggcgtgcatggcacggtgcggacatcttgtgatgattgtcctttctgctggaaaacgacctgggattgtaatccggacctacttttttttttgtccaactttttgtgcgtattagccgattaacccacggtaatcctagtcccaacattacttctttttttttttagaaacacattacttggtttggccccgtgagttacttttggtttatctttattcgtttcatttacgctctgaactctacgtgtctgttacgaatttaggttgctggatatggttgacacgcccgtcctccaatgtccacgtggcagaacaggtgcacaactaccattaccatggtccatcctttcgttctcttccatgtgggagtaaaattatccagcaacaacgtcattttatttttttttactttcgtcctatctaaaaggggattgttcgattcctcctcttcattttccatttccatttctcccggctaaaatttcccattttcatttgtcattcccttgttagttttcttaacaaatgcattggccagtggccatttccaattcagattgctcgttaggaagcaaaaggcaaagcctattattatacgagcgttctcaaaaaaaaagagagagagagagagagagccgaggagtcacctgatggactggagctgctggcgctggcgctcctcctcggagagggcggcggcgaagggcgaggaggcgccgtccttgatgggcgtggtgggcgccgaccgcttccgctgcagcgagtggagctcgtcgatggtctgcgcccgcaccggcgccgagctgtcgtcgtggcatatcccgttctcgtgcttcttcgtcttcgccccgtgcgtctcgatccgcgccagcccgttcggcgtgctcgccatggccgtctccggtcgcgcgaaaccttcaaaaaaaaaagtaaacagtcacgttaattagcaacgccaacataacagcgctagttacgatttacgacccggttctgccattgatgcttgcagcatccaaatgccggtgcaaaaaccacggagaaattaaaagagatgatgaacacgtacgaggcagtcgaggaggagatcagcaacgcgatagtgtacaagatgacaggacaggagtggagaggtgtggggcgtattgggcggagtccgggtgcgcttttaaaggggcagcgagttaaccatggttaggtgctctaaccatgagtaggtgttccaacctgagttacgaggcccaaataccgacgtcgtcgatcaggattgagaaatgggaaaatatacggtgaaaactatgtatacggtgaaaacttaaaacctaccattaaatcgaaaaataaacgtctaagattcatctacgttatcacgggtaaaaattttactcgtaagtttacttatgagtaaaaattttattgagacttatattgacatggacgattctcgtacatttaattttcaatttaatggtaatttttgagtttctaatatatatgatttgcaccgtatatttgtcggactttctgtcccacgggaggttgtggttaacgtcggaggctcggagcgagaggaatcaccaccaaattcgctgcatgcacactttgcacggttgcaccaggtttgggacttggataaatgaattcagacggcggttaactggaaattggttggattagctaagctacgaaatggatttgtcacacgcttttccttttgtatagatgctcagagtaaattatagtttacagtagttatccatcgaaacgttccacatatacacttataatttttttcctttgaaatcaacaaaaacaaattcgtggtaacttgttttcctaattagcaaatttggctcagtagattcagtgattcacagtagtcaccaccgttgtttccttctcaaaagagtatatctatatatttatattaattaatttttacaaaacttatcttttacaccaactggtactatgctcctgcttttcaacaggactaaaagaaatactaacaattagtttgatggggttgaattttatctatccacttttttatgggttgattctcgtgcagaaacactcttttattttgtcttttaggcaatatggttttttcatgtggcggatgaagatgtgcgagaagatgtagacgactatctgattttaatagattttgcagtattagtagagatacgtagaagcagaaagaaaaggaccatcactaatctcaattgcaaatagaacaatgtgattaacattattcatgtggttagcttttataaacggagcaggagatgacgagatgtagctgtaaattcattgataggaataggattaacacccgtagcagtgagaactggattgcctaagatatataagtaaacaaattggccaagtatgtggaaaaggcattagtactacaaagtagagtaatttacaaataggattattatgcatgcttatcatctgcaccgccaatcatccagctagatcactggtgcgattatgcaagtcctttgtggtcgccattatcattcgcagataatctgaccatcctgggtcggcgcaggtcggccttcacctgttcatctatctagccgttatccaacctctcaagataaatccaacaaaaaataatctctcacaaagataatccaacaaaaaagggtgtgcacagctgagcagcccgacgtgccctctaaaaaatacgtaataagaacagagagcagtgttgacatttgatccagtcccaaccaggggcaacacagtacggtcattttacggttatcacgtatggtgatcttcttaatttttaaaaccacaataaatctcatgatgatttgtgtgataacagtcttatcattgtaaacttacctaaaatgatttggtgaacctgatcctaactcccaggctcccagctaatgtgtctgtgtgcgtcgcaaacatgcaattgcagatttgcagtcatgcagatgtgtacgtgagatggattggatagggacgacaacttattgctcctacgctgcttaagttgaaacacccttttcaacatttgttctgtgaataagtattccatctcaaataaaaaagtagtactagtacaagtcttcaaacacttgcactatactagtctaaaagcaacgaatttgctgtgcataattcaactcaagcgagtctacttcaccagtcgattaatgacagacattaactacttagcctagtcatttttttcctacttttctgatgtgtatctgtccttttcattatcgctcccccaatttactactcaccgctaactcctcaaccatgagatttctcgagattttggtgaatgaaggggatactgccgggaagctgagggagtaattaattaatggttaatccattcacgttagggtgcatgtaaccaagttggttccgtgaacccagttaagcgtagtggatcagatgccatgaaatcggggaaatattaattttcctgatcattttagtagtagtgcattttgcactcagaagcgaaatggaattgtgaaaagtatggtgaattttcttgtaagcttttatttttcttccgtcaattaatgactcttgataatgcttggaagtagtagtagtggtgactatgcatccctgttgtataggaggtgacatgaggaacagagggaaacgtggagcttgatgcgtgtactacatccctccgtaatgcaagtgtaagcgtttgactcgttttattattgattattctaccttcttcctgtgtgtatacatgagtttgtctttgctgtccatgtgcagatacatttctggttatcttcataaaaaaggaagtcaattgccacggtgtatatccgacgcgaatccgggtcacactcctcaatcctcatctacatggcattggctatgcacaacattatcctctggatttttcttcgtgtatttagacgtgttcctactttttttttttgaaactcaacgtgttcctagttggatgccctcggcggcttcaagctccaggacttgaacgagtctccaactctccaagcacgagcgtgatggcctagtagcagcagcgtgcccttgccccttgctcttggggcagtaacgggaggacgatgtttcgccgaagttattgatcgagccgactaacgactgcacgcacgagtggacaatgtctttgatcattcatcactgggtcagtttgctcctttttttataaaaaaaaaatcactgggtcagttagttagtcagaccttctttgtttaggcttagacttattggcctagattttttaagtcaacttattgacttatatgatttataagccagtggatttaatgtcctaagtttagtggtggagttatacatctatctcatataagaaaaaaaagcttctctaacctaacttttggcttaatagtattagagtggcttatggctttaaaaaagtcaaataaaaaactgcttgtttgttttggcttagacttttcgacttataaattggcttataagcctaagcaaaagagggcctcaaaacaatcgccgtcgaccaaccaaacaggaaacaagatttgagaaatagtacgagttagtagttcatatgctacggcgcctacaccaggttgtgcacaatgcaccgctaggctaattctgaaagtagacgtgcctgttgagcttggacgacgtagcacgaaacgcgatcgaaagaagacatcgtattgttcatgggacgcgcgttaatgcgttatagatggggctaaaaccaaatggcgatgggaacacctatatatttatcgataaattttctcctaaaaatttgacagatgtaattatagtataatcgtagtgtaattacactgtaatttgtatgtaattacactgtaatttgcatataactacagtgtaacttgtatataagtttcacgtaattttgaatcgttagatctattacaagatttgttttggtgaggaagaaaaaacaatcacagcacacatatatgtgaaagaatttgttcccacaacctccattttaccgaaataacatgttacggagagatttttgaaagttacatacaagttacattatagttacagtgtaattacactacgattgtgtaattacatgcaagttacagtgtaattacactacgattgtactgtaattacatctgtcaaatttttcggggaaatttgtcaacaaatatatagcaaaattgaatggggattcaccccctccatccggccatcccatgagatcggtgcacacacgcgtcggtgacaggcgccgcgcgcaatggggaaatgggaaacgggaggcaggcggcagtgacaaggttgcgccacacgcgcggcggggagcggttgcgtacgtcgattgttgcgtacgcctactcgcgctggcggggttttatggccgcgcgcgtcgggcgaatcgaaggcttcgcgatctcgcaaacacatgaaccgtggcccttgcgcgctcgacgtcatgcacgtaatctgggcagttatacacaccaaccgcccggcgtctggctcgtcgtcacgtcgtcccccgctatcctcttcacgcgcgcatatctatctatctatctccgcttttgcgtggcgtggctgcgcgtgacggcgtgaggctgttaaatgcggacttgtggcacgtgcctaggcaagcgcggtgagcctctctgttttcaaacgcccggggcaggttgtaacgctccgcttttcgtgagtcgttaaaaaaaaactaactcggcaaaatcctaattgcgaaaattttcgttctttgtgtgagagtctaagttgtgccaaggatctcaatttaatcccgttgttccctctcatcgaaatcagaatcctccacctcgaaaattcctcttccgattcgagtctccaaaatcaaattccgaaagtcaatcccttcctttgaatccttgccgaatattcgctccgactaaaaaaaaaaaataaatatccaagtttccgttttgaatctcttccttgacttctcctcgagtctcccttgattcctccctaaaccatcgagttcgaatgtcaaatttgaattcgaatccaaaaccccaattcgaatccactccaaatcagtcttctctacaaaagtctattttacctccctcgtgatgatttgggccgaaacctgccgctggcccatctcttctcagctccctccaactccacgtgcgccgcacgtgaccaccgagagagagagagagagcgctgtctctctctcccttccctctctcggacgttctctcgctctctcgtcctcttcctctctttcgctgtctctctctctctctctcgttttctctctctcgcgccgacgccgctttccgccgtcgccgcccaaaacccgccaccgccttcgctctttcccgcgctcgcgcgtggccgaccggccggtcgttgccgccgtcagccctgccgcgcctgcgccgcgcagccgcccggttgccgccgcgtcaagccctggcgccgcctgcgtcgtgccctgccgcgctgccgccccgccgctccacgccgctagcttccaaggccgagagaggcatcccctgtctcactcccctctccctcctccttttcccgtttcggcaagggtcaagccctcctttccctcttcctttcccctttttcccgaccaccgccgatgtcatccatggtcccagccgcttgcggccaaagcgcggacgctggtcgtgcgactgcaccagct

SEQ ID NO: 27824 - DNA, 37915 bp, Oryza sativa
  unsure (1)..(37915): unsure at all n locations
gtcactgcgcccgtctcggcttggtagtgccaccctccgttcccctttttcgctggtcctctccttccttagctcgcgtggtagctcggctagcccccccgaacacgcatggacgctgccccaggtctcgccgccgcccgccataggcttgctgccgttgccgcccgctcccggaggccgccgccgtcgccagccctcctcggcagtcctccgccccatccggtgccggaaatgagttccccgcgccccggagatgctccctcctccttgaatcgacctctcgtcgccccgccgcgatttccccttttgatcgccgccggccgccaccgtcgaaatccgtcgccgtcgaatccccccggcgaatccgagccggaggctcactccctcttatcctagccatcgttccggtgtgctccccttggccctagacctccgcatcaaactccggtgaactcggccaccgtccgccgtccatctcggcatcccccttcttcctcctctcgccgcccacgtggcctggcataggtgccacgtcggcttgacccggtcaagccggtcagccgctcgccctcgccccttcatccccgtgcgcgcagaccccggtgagccatgaggctgcacgtgggcccgccgcctccttgtcgaccagcgcaccgcatccgcacccaatccaccggtccgtctcgctcgtccccgcgtgcgccctccccaccatacacccgaccgcccccatgtgggcccatctcgggaccccgcgcggaggaccgcgcccaccccgtcgggcctccccctctccccgcgcgccctaatgggccgcttccccgtggccgcgctcggcccaatggccggccaagccttgagaatccctcgggccgcgcctaagtcgcccgaggaagtctaaatccgatccctccttccttttcttttccaagggaattaataattccttttccttgtccaggaaatccatttagacctccaaaattcatatccctcgatccgtagctccgatcgcctccgttccacttccagtaattccgtaaaattgagatctatttaatggcactactaataggtctaaataggatatttcttttggtcttttgtttaggttttcgattgtttgcgtatagttgcggttatcggttttcgttgatcgcgggttctctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccatggctaagtaactagtcggttcagggaaacctcgcatgccaatagttgggaacaccggggcggggtcggttggagccaaaccgggttcctggtaatgcaagaacgagaagcttgttgaattaccgatcgaggtggttggagttggatttgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtgtaagcggattgttgtgctgccgggcagcaggactctgggagtccgagaaaatgaaaaaggctctgggagccgattaatcaagtggaatggctctgggagccgagaagtaatgatctgacccgggaggtcggtacattactgatcgagctgttgaaaaacatctcttaaagacgaatcgagacgcaagtctcttttcggcccaaacttaaaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgccctgaagagaagacaaagtgaagtgaagattagggtttcgtcctggttcccagccgtcgcctgtggtgttgggtgttagaccgttggttccgctgctgctgttggtgttcgcctcgtccgtgtcgtcggttgtattctcgggctgtctgagctacaacctaagttaaggtaaataagtcctctatttattttaaggattgctatgattcatatttgtcaccgtgggtaccagcactatgtcctgggactggtaccgagatcgcggtttcgtaggaagcggttcacgccgttttccctacgacacgctcctgtcaggtgccgttgtacggcggtatcagattggggtgtgacacaggttcaaccggggaagttgctcgcgctcacgctacctgttttttttttatttttttatttttggaaaccctcgcgctacctgttaaactcggcgtaacgacgcttgtacgtacgtgcagcttcagtcctagtccgtcagttactttgttggtatgtttttcgacgggccataaaaggggcagctttttatggggggaaatgcgtttttggctgtgtttagttcaacgcaaagtttaaattttagttaaaattggagatgatgtgactaaagaattatgtgtgtatgaaaggttgatgtgatgaaaaagaattgaagtttggatccaaacttttatctaaacacagccctcgtggactcgccgtttcgctgccaaatcggggattaatttactaaaaagtagtgtagagatattgctagagaagtactatgcgcgatcttcttgttttttccccctccacaaggctcgctgtctcaggtaaggggtggatcaggtgctagtgcggggtgcctttgggacggctgacggcaactgtggcctcgtggttttcgttggagcatcgagtgattgcacgtctccgaacgatgccatgctaaacaatctcaaatagtagctgttcagacttcagattttttttttaaaaaaatcaccggtagaagttctaattctagagcgaatggaattttttttttggcattttaaccgagtaagagcagtacagtaaatcgaccagacgagtaacgacagccgcttgattaaagtgcaaaaggggcaaacatattttccctgcaagagcgtgttggctacttgtcttgagtcgacttttgcaggggcacatcaagcagtggtgaactgcagagacgccaggattaggccagctttcttttctatagccggtctggtccggtggtgcctcccccgggcaggacctttgagcctgccactcacaagttattcaggccgaatcaattcgttcacattgatcaaattcaatggacgcaaggtgcttgcaccaaccaggcaggggtcagtgagtgagtcagtgatctcgatgaaagctacgtgtgcatgctgacttgaagatgcaggagggcgtaaccgagtgaggacggataatagacaacgattccagaggaaaagggagaataataacgctcacgctgagaaaaaaatggctggaacttgtaacctgaccattcagcactaaagtaaagcacacggacatggtttattttcccggatttaccaaaagcaagatatactctccatgttttttctctgttatgatttttaagccttttttttaatcttgttatggtttttagccttgcaaggtgtggttcttcgtagaaatgacagctaactttcgatccgcacaacgaggattacttctagtaccgttctagtcttcaataacttcgaaaaagaaattctacagtagaagtcaacagtaagtactaacaccagtccggtcaaaaaacagtaagtaacatcagaaaaaacctgtaatctctcgatgataaaaaaatatgtggactcgcgcttcaactccagtgttctcactgctgacggcttattcggtttgaaggaattttagcccataaaaatagaaaaaaaaatgatggaatagaaaggtatgcacacatcaattcataagattttttctaagatatttgagtgtatggaaattatcctatgatttctcaaaaacaacttgaagaaaaagaaaatttcctttgatttttctataccttatacctacaaaccgaatgacactcgtagaaattaatccttaagaatccaaatcatttatttttcttcaagccgaataagtcctgacattgttgcaaggtcacaagggtaaggggatctaaaccttttatgaacaaaatttcaaatatttgtatctacctatttcctttatcttaaaatatggagtatcaacttatgcaaagattagatatatcttaggataatgaatatgtatagatagaggatctatccaacttcattgtcttaagatatgtctaatctatgtctaagttactgtttttgaaacagatggagtaataagatagtttagggttgtctttcatatcgttattaatgatgttaggatggctaggagtcaattctatttttttactacctccgttcctgaattgatgtcatctgaaaacatgtacagtcaaaccttaaaacattaaatgattaatttatgaaacaaatatcagaatttgtgagaaaataatattattaaatttgtcatgaaaataaattttacgttgttatattgtaatagctttaataaatatatttactaaaagtaacgatgaaatatgtgcattgcagactgtgttggtgttctatgtaacaagtaataatagtatgtaacaacatttatcgattaatataatgtcttattgcattaaaaaaagggaaaacctatatttgttgtaacttgaatcaatcaatcatttgatgatatagtgcaattgtatcgtaacttgttatatttacaatgtaagttgcatgcaactttcaaaaaaacatatggtaacacaatattttcgcaaaatggaggttgcgggaccgaatcccctcaccgccactggtgcgcacactatgaattttttacttttttcgtttgcacgaatctttaagtaaatatgacagttcaaaattatgtaaagttgcatacaaattatattgtagttatatgtaagttacaatatatttaaatttgtcaaatttcaaggaaaaaattatcgataaatatatatcaaaactaaaaaaatagatatgacctacacccgctgtccaaaaaaataagcatatgaatctcgataaatgcatatcagtatatctaaattcatccttagaagctgttttttttttccttgaatggaaggtgcacaacgcaacgtgccaatagagcaactcgaacaccggcaccctgcgctgaacatgttaaaaaaactttgaacaagctagccgcctagccgcttgtatccggaagaggaagagaggaaaaacgctcgaaacaaaagccggaggctcgccggcgttgcgtagcagaggcgtaccggggggaggtgaaatgcgtaactgctttgctgacttgctcgctggtctgcgtcgagcttagcgtaaatgaatattcttcggttcccatcaaatccagatgatgctgcctaattgccaaacgccgagatactaaagcgaggtttgctctgtatttatcgtctttttttgacggcttgtggtgctgctacagaataacaaaaactagggccctgcctggataatgtatgagaaccgtgggggcagtgggcatctatccttgtggatatttgagttgagtactagcgtgtcaccgcctcaccggcctcacgcgagctcattgtcgtgtttggtttcgtgtgattaattcatcgctgtttgggctggactctgcagcggagaaggcgttgcccgggggaggccgtgtttctccgacagaacttcactgtttcacacgggttctcacgtttgccctgtctcactgttcgcacctcgcagtctccactccatgaccgaaatgagcagctatatattgctggtcaagcttgcctccccagtcgccgtgaaacaaacaggccctccgcaagtttgtggtttagatggactaaaatttagttcgtatcataagatgtttaaatattaatttagagtattaaatatgaattaattataaaacataatctataaccttggactaattcgctagacaaatctattgagtctaattaatccatgattagtctatgtgatgctacattaaacatttgctaattatgaattaattaggcttaaaaaattcgtctcacggattagctctcatttatgaaattattattttttattaatctatatttaatactccaaattagtgtctacacatctgatgtgacacagactaaaaaaaatttagccccatccaaacaccccgcaccaactgttgagcttggattgggatgccatcagttaactatgcaggcctaccacctacgatggaacgatggttactccaaatcaacacctgccgagtggttgtcatccagatcagctgtagtaactgactctatctcaaaataaattaatctagaattgggacttggtttagtttctaactttttcttcaaacttctaacttttccatcacatcaaaactttcctacacacaaaaactttcaacttttccatcacattattctaatttcaatcaaacttccaattttggtgtgaactaaacacaccttaaacacaccttggatatgacacattctatactaggaatctaaacagatgtatatcgaaatttatagtaatagaaatatatcacatccagtactaggctgattttgtatgggacagaagaagtaggtagtatcagctctcgctatcggatgcaaataaaactgtccagactagcacagttcacagtttgttatactgtagcaatgtgatgtagtgtgggggtactccacaatattactatagcgataaatctgaacatcgtgaagtacccccacactacaaaaattgttgagaaaattacatacagattttatagttgtaattgcacctgattttaacctagagctccatcggttgccctgataagtcaaagacaaaagataaattttgaaatttcaatttgaagttgattttaatatatttttaatgtagttctatttttattgtcaccttttaagtcgctaggaacacatatataaaaattttacctatacattaagagaaaatttcacgaaactacatatactttgatcaatctatcacaaaactacagatttaaaaaagtgtatcataaaactacaaatttatcatcgtatttttttcctaaaactacatatttaaggtataatataaaaaaaataaatttatcatatttatcacaaaacaataacttttgcaattcaatagtgctacggatataaactctaaagtttgtagtttttttataattttatcactaaatctgtagttttgtgatatgatgttctatatctgttgctttgtgataagtttagcgctgaatctgtagtttgtgatataaatttttaaatatatagttttgcgatagttcgatcaaaatattcgtagttttgtaaaatttacttataagttaatttttatttttaataagttaaaatgacttattaggaaatatgggcaactaatgactttcctagttgtctgctatcgtgcattgcagacgtatgggattttcttggacagttgggccaacaaattaccatcgggtctttcaacatgaaaatctgaacaagggcccgctgagtgcggacgagtccgacgactttgggacgagtcgtgacggtcctgctggagtccctctgcaccatagcggttgcatccaacccatcccattgcaacacggcccaacgtccaaaaggaataagttaatttttccttcttcaactaacgcccaagatgattttcacccctcagccagcctcatccattaaaactggctcattttacgtccctgagcggttttgtccaactacataacactcacatggcacattgatagtctgtcactctgtcctacgttgagttttttttttttaacagccggtcagaattgattggcgttatattgatagaaggagaaaaagtacagatagccaaagggctaagaaagagaaaaactatatatgacaacatgcaaacaagcttgcacgtagacttcctagctcctcgtgacaacattctcccaatgtgtttagcgccggccatactccaccaacctaattcctcttaaatgcgactaatcatctggtgtacggtcgcctcctttgctctaaagattcttgcatttcgttccttccagatttcccaagcaatgagcaagaagagagttctgagtcctttctgttttgttgctttcgggtcgcatgttccttgtgtccaaaattaaacaattcctacgttgagtttaaacgggtggttacgtggcaatatggtcagccagataaataaaaaataatggaaaaaaaattgagctccatatgtcaatcagcaaaatagacccacgtgaccccacctctttctctctctcctcttgccctctcagcacactgctcgagccgacgacagcgctcctcaaagtctagctgccccagacgcgaccacatggtccttccttcacctgcgtggccttctctgccgggactgccgggagtatgtgtcgtaattataaatctgaaaagatgtgcacttttttaatcacgtttcgtaacaaatattaccagttttgctgtttgtcacttgatattttcacctgacttgtcttctttgctttgaatccttctgttttcctccattttcctctatcctttatcctttttctattcctgaataaatcgtggaatccaccgagtactttgaataaatcgtggaatccctaatttgtcatcgagtctgatcttcatcctcggtccaaaaaactggatagaacgtatctcctaacttacaaaaccatgcaaacgaggtccctcgatagtattgatctcgggtttagctgacgtggcgtttatatggatcgtttaactaagtcttcgttccacgtggcattgctgtgacgcttacatgtcaattcaatcttgagaaataatacaacccgtagggcccacatgttagttacacacaaaaaaaaatgatggggcccatgtggctcgcatgccatcctccctacccctcctctcaatctcctctctctccctacaacgaaaacacaggagcgctcgggcggcggagtgggaagggcgacgggccgattggagtggcgacggccagctgagtggagcgagcgacgggcgtagcggagtggcggcggctggagcaggccgccggcggaggaaaggggcaacagagggcaagctctcgcttccccacctgcttccctatcatagctgccgccgaagacaacaacaacgagttcgaggaggaggaggacgcgcacctcaccatcaccatcgcggccctcgccgccacattcgccatcctccgagctgctctctgaccttgacagcgtccttgccgtgggcgacaacgggtgagctcccgcttcccacctgcttccccgccattgtggccgttgaagatgacgaagacgatggcgatgggttcgagaaggaggaagaggaggacacaaacttccattgtggagatcggcgccgacagtggattgctgctgcttcgctcgccgccgccctgcttcgccccttcggcttcgcgcgccgtcgttgctccggctgccgtcaccccactctgcctgccgccgccccgtcgacttcctgcaccaccgctccgcctgctcccatgggacttccatggtgggagagaggggataggatacagagggggaagaagtggggcccactgacatgtgggtcccattatttttcaatattaatatttgactgacatgtgggcacgcatattttgttttatttttttaaattgttaaattttgcttcatgtgccacgtcatatgaagatcaagtcaaattacccacgtaggcaccacgtcagttgaaaaagctgtccaaactgccttgggactcattttgtatcggttttgacagttgaggtacctgttgtatctggtcgtcgagtcgtcggttcgtcgccctccagatccatgccgccattgtcgagtcatcaccctctcgcgctcaccgtcgtcccccgttcgcgcaccgaggagctcatcaagttgtcgccctctcgcactttgaggagctcatcgtcgtcgattcgctcggcctcctcgaccgccactgtgtccccatgtgggttgggcttgagcggtgtcgggagtggagaagcgccgatggggagggaggagaggccgacggcggcagagttcgtcgcctcggcgcggggagtggggagaggccgaaggcagcggcagcgccggtgaagtagagagggttgtgacccggtggtggtggttggtgggttagatttgtattttttttctccattgtaaggtgttcactgtaaaatttggccttcgttataaattgagaaaaatatgagggttggaatcaaaagtggtagtggctgaatcgaaaaattgaagtcaccgatgagaccatttgcactgtaggtaaccaaattttttgtcagttgatattttcagctggtttgttttctcttgtttgaatcccttatatttttctccattttcctcttaaccatttttccatttccctctaaccttttatccttttcttttcgtgaataaatcgtgcaatgaaaagtactcgtgctgacgtgcatattcacgtgccgcagcccgcaaggtcagtgtaaccatgtcatgtggagttttttttttattcttttttctttttttaaaaaactactgtactgttggttacctctttcataatttggagccctggcccatcctgccagccgagacgctgagttcattgcagttggcccaggagcacaggatattggcttttctcaaacaggctctcccggttgtaaacttgtaatttgcacaggaacgggaatcgagggacgagagacatcaattcatccaatttgccaaccatctccatcaagtaagcacaggagcgttcacgaatcgtcgattagtgagagagaaaatcgcaacaggctaatgaaggaatcagtggtggtgcgccgtgcgcgcggtttcttcagctgttgtggccgcagcagatcgcctgggcgattttcgcgcggcgctccgggcggaggctgatggtgaaccagaggaaggcgaggacggcgacccagacgaggatgtccagcgacaggtgcgtcctgggctgcgacacgatgaacgtgagcaccagcgtggagtacgccaccgcgaacgaccaccggacgttgcgcgagtccacgggcatccgcaccagcaggctcagcgtcatcaccatcgagctcgcgaaccccattcagctcgcccccatgaacacccagtacctgaccattacacagccgcgtgccgttcaattcgatcgttgtcgtcgagcccttccgatgcatgtacgtagctgtggacagtacgtgtacctgggacggtgcaggtcgcgcatgatggggtcgccggcgcggtggtcgtccttggtgtcctgccagtagccgccggggatgttggtgccgagctggtacgtgagcgtggtgatcagcgtggccacaaccagcagcgtgttggcgtcgttgcccacccagtggttggggcctcccccgccgagccgctcctggtccatggcctgctcgttcgggttcggcagcggcgggtacacggccgggacgcccatctccacgccgcccgggtcccggtgcgcgcacggatgttgctgtgccatggcgccacacggcctttgcttagcttctcaaccaggtcagctcacaattcacaagtgaacattgattggcagatggctctgacccgttgggtgcgtgttgcgagggatggagcttgtgattaccgtggaagtggaggagatgctggcgcctggcggagccggttatatagattggatcgctcgggtatcccgtccgggtcaagtcaactgtcatgccgttctcccccagcattgcctgtgtctgctgccaagtctaaaccgcgttttaccacgagcaatttgctctatgattatgtaggcccagacagtacactgcaaatgtgcgttccgttgaaacgttcaacggagtacgtacaaactacaggtccacaaacctgtacttctcaacctgggattcagaaaaccggttgctaaatacggagtaagtaagatctcaacatcactacagtttctgatgtgacacctgcaaattccaatcttgcttttgttgagctaacatatgttcaatgcaacgccatagttccttcgctgccacacatactctctctttgctttcctcctgttgcctgttggacgagatggcaggatcataggattttgttcatcaataccatatgttttagaaatattattttagtagatcatattattggtagaagttggggctttgttccatctcgtccattttatgcttttttctgttcacttctaaatttttttttagctgtgtacctacggacagaggctgaagatataatccatttccaatatataaaaaatgctataagtttagttcgacttaagaattaagctaaggtcgtaagatctatgttcatcaatcgtgaaaaattcattagtgtctcattaccttattgcaattagcttagtcaacttgttacttgcacggggatctgagccagacatcttcttttttgggctacacatggctacctacaattgcaatcaagatgctgacagctgatacaagatgaagaactatactacacacgaataatgaatccatctccttcgatcccaaaactattctgatggcctgatcaagtccaccgccggtaatcgacccaagttggggattgttaattacactaaacaaccagccttgtgcagctagctgagtatgaggcggcaatacgaggaaggaagtgcgtcgtctgagccgtgaggcagagatgagagatggcagaagggtgtggaaggcagaggtggtgtggaaacactctttgggtggtcttatataaaaaatggcaccaataagatcatcggtaatccgtaatcaaacgcgaataaacaatagatctaaatttaatcaggggacatctagagtcgatatttaaaaatgcaggctcaaccgaagtgtatattacatatcaatgttatcaataatcctcaactagctaggccgatgggtgtgcctctatatttaagagtgtgtccagaatagaatccgacactaattttactttgcactatgcatattataagtttactgagacgccactcaataaagattattaattgattgagataatcagtagcacggaaaacacaatagtgattagcacatgattaattaaatattaacaaatataaacgtgaaaattgagatattcgattcttaaaagaaaacaacgtagaaagtgtttgaaaaaccgtaccatttaatagtttgaaaagcgtgtgcccacgataaacgagagaagctcccctcaacagcacaaacaaacgaaacctaaggctgtgtttagtttccttcaaacttccacaaattccgtcacatcaaatgtttggacatatgtatggagcaattaatatggacgaaaaaaaaccatttgcacagtttgcatgtaaagtgcgagatgaatcttttgagctaaattacgccatgatttgacaatgtggtgctacagtaaacatttgctaataacggattaattaggtttaataaattcgtctcgcagtttctaaacagaatctgtaatttgttttattattagtctacgtttaatactttaaatgtgcgtccgtatacatcaaaaaaagatttggaggaggaactaaacacggcctaagtcctactcccttcgtcccatttgagtgaagcctgcccaacttttatcttctgtcttatttgaattttttttgaaaaaattaaaaacataagtcacacataaagtactattcgcgttttatcatctcatagcaacaaaaatactaattataaaaattttcaaataaaacggacgacttaagttgggcatggaaactcatggttgtatttaaaatgggacggagggagtactttataactaactttgtatacatatatttgacaagaactctaatggatggagctagtccggtctagtttttccggactaccttatatataaattattgtttttaatattcgcacgtaatgttggttccacaatattaatacaagtgatatccgatggacgatagtttcttaacatgcatctgcccgttgacagtgggcgcggatagccaacctcatgtggatcctgcatatttctattcacaaatatgtatttaaaaccttattattaaaaaaaatcaaaatccagaaactatatatatttttacttagatttttggctttcaattcacatgtaagttcatccacataattttgagactcacatatatgttttaaacaaaaatttatacatataaatataactataactgtatatataggattttatacataaaagcatcctatgtataaacatttaaatccgaaacctgaatcaaaattgtgtatataaactttacatgtataaaagtttgggtatataaacttttaaaatagaaactacgtagtagtaaaaaaaatggaaatgatcaggacgttcgtgcggggtgaacgctcacccgtaatttttttcgattgataatgccctagtatagagatagaaagagatgacacgataggtaaacacgaacaagcgtagccgtctcatttgtatatgtacaacggtcacaatagtttatttgtcgaaggaacattatgttctttattggactatgttccgccgatgttctgatgtacgtacatattaacatatggagtgggcacaagtcttttatggagtattatctttggggattcccatgtcctattttaagtaacatttaaaggtagagctcggtataaactattagacgatacatattcatttataaggtattctaaccattagtccaaaagataatttttattgctactcttttcattttttcataggctaagagtcgttattaagtcattgtgttaaccgaagtaatgatatttctcttctttttttttttcatgtcaacaaatatttctaattagcatagctatgagttctattattgaccattgtttattttcgtatgttttcatgtaccggaaaagtttgactcaatatcccgatgcttcattcgttctctacaacttgtaataagggatgactagttgaaaaaacatttttctaaaaatgtgacgcccatgttttttttttactgcaatcactatttttttcaccatgcatgtgattgctaaatattctttagaggcgtctaaatttcgtatgactaaaattttagtcattttcctcatccaatggatgtcattccaatggttttcatcgctcctactattaattaataaatacaaaatccttttttcatagaaacaaagtggaaaatgatactatccgggcgaccggcgccgggggagccggatcgggcgctccccacacgcagccctccccccgaggcgcctgcatgcatgctgctgggccccaccatagtgcctgccccacctgcaattgcaacaaattaaccacatattttggaaacctttattaagggtatttggtttatttttttgttccaccaaaaatgtttcacctagtgtactcacaatgtttcactatgtatagatctaatattgcagtgaactgaaatattccattgcaaccaaaaatccgcatattttggaaaccccctattaagggaattcgttttatttttttgttccactgaaaaatgtttcacctagtgtacttataatgtttttctatgtatggatcaaatgttgcagtgaactgaaacattctttcgctatttgttgaaaattgtttttatataaggtgaaacaacacccgatttaaatgagtgaaacattttttatctacttagtgaaacaattccgatatacctggtgaaacatcgtgcaatatttaaaaataattcagtaataagctaaaaaaaacttccgtcggaatatatccatgtgtggtcttgttttaaagatttaattgcaacgaatttaatggtgcaatcggatcatgatttgaataagtaatttaagagaaaaattagtttaaagtaattttgcacgtaaatcgggcgctgacgtaatgctgatgtcagcgcccgatttccccggccccggatcgggtgaccgatccgtaggcgcgtccgaacaaagttgcagtgcatagccctacaatataattgtaggcttcaagtgcatgaaatgatatttagaaaatccaatttctatatttaagtatattgcgtctctcatatgtatctcctacttattgacattatttcttatttttcttgtgtgttaaataaatgcatgatatttattgtacaagatatatagtttaccgtgtaaatacatgccggaaatttaattaatttttataagaattttgacacaatataaatatagatagtcccactcttaactaataaatagggacttaatatattctctctttcactttcgaaggccaaaagaatatatacgatcgaaaactggacgcacatacttaatttatattcttataatcatattttgcacctgcacatacctaatatatattctcttaactaaacagggagtaccaatcacgtgaacgctggggcgctcgcctcttctactgctatacgcatatctatatacatctctaccaaaccatttaaagtttggagataaactaccgtacttggtgataagctctcatctcatcttggaaaccatatactactaagagcaccgtacatggttatacctcttcttatttattaaaggagatctacatccgacttcatatattatatatacgaatctgctatatatatatccgcctgcactgcatgcgcaagatcgatacccgcaacaacaatggcgcaggtcgaggacgacggcgcgaggagcttcaacctgcacgtccgcatcgagcgtccgaagtacgagcgcccgatctacgaaggctctgaaatccgtgtttctagcgacgtctggccgtcgcgctgcgtgctgcacgcgtacgtcggcggcgagcacctgggatggtgcaggcttcccgagggccgcgaccaccctctccgcgtagaaggctggagcttcgccttcgagctcccgttgcagcgggagcactgggggcgcctgtccctggacctcgaggtggagcgccgcgacgtctactacgacgaggacgacggcgtggtcagggtgttccacagggaggacccgcagacgtccagccggaccgcggtgatcggcagggcgcgggtggcgctggtcgacgcgctgctgcgcgacggcgacgaggacgaggacgaggaccgcgggaggaagaggagggagaaggacggcctgccggccctggtcaaggggacccgggagttcggtgaatgggtgaagctgcagggctggaggttcccggcgcgggggccgccggccaacgtcgtgcgcggccggttggccgtgcacatgtcattggaggcgcggagaggaagaggtgcgttcgtggtttgaagatgaagaggaagaacgtaggagtattttgattggtgacagcgtagcaagaattaaggatttgtcattgttctctctgaaaacgaattacttcgacttattttcttttactgctttgcaattcaaatcaattactatgacacaatataatatattaattagagatcatatatatattcgggatgatggtgaacaaatagtcactgctacagaaaactacataggatcatgtgactgcaagtagtttgtaagcaagtcatggaattatactgtcgactcttgcgtcgctctcccctggggcggcatgggaggcgacgaacccggccgcccctcccttcctccccctccgtctcgccaccgcccgaacgcaaagccggccagccgcaaggacggcggtggcggggcgtctcaccgacctcgcttcaggcggacaagggagcgtccacgacggggcggtggtgaccgccagttccgggctgctccggccggatctggcggggtgacggctgcgaaggcagtggtggttgaaggccgcggggatggcgtcggccaagggcgtgaaagcgacagcggtggtccctgcgcgatgacggctcggtgctcggcggcgacggtggcggtgtcccctagatctgtgcctctcggccggatcttgagggtggcccgcggtggtggtcgacttgcgacggcttgcgacgncggcggcagtggtagtcgcggcagttgacggcggcggcgtcggctgacgatgccggtggagaacttggcggcggcgcggcggagggcgacagcgaagtggccgttggcagtggcggcggttcgcagaggcggtggctggcatcggtgacagcgacgacggcgtccgacttgcggtggccgtgactgtggagacggtggcgacgtcggtggaagcgggtcgctggcggaagcaagtggaggcggggaaggagtcgggtgcgaggtgaggatgacgacggcgaggtggctgggcgttcaacagcagcggctgcggtggtggtggccgcgactgtggtcaccggaggcatggcggcctcggacggctagccgagggtgtgggagacggctgcatttggccggcgcggcatcgtttggtggagggatcggagaccggctttggcgcagagaggcgtagccgatggcagcggaggccggctcggcgcgagaggcgcgggcggcagagatggaggccggcttggcgcgagaggcgtggccaatggtggaggaggcgacctaggtgtgaggaggagctgccggtggttttggtgcggtcttcggcgcacgaaggttggccggcgggggacgccggtgcaggggtcccacatgtcggcaaaacttgtgtggtggtagagcattggtgcgtcagccgtggatttgcaggtggtgagcggcgggtgaaaactcagtccggccttggccggaccgacaacgatggttcattccccctcctgagggcgttgtcgtgctgtctcacccctcaagggtatgtatatagacaatttttggtagagtttgatttccgagttatgtgatttcttttctttggtgtgaaactgtcctcatatgtatcgatgttgaagaaacattgaagtaatgaaaaatttatatttttttatgaagtagtgtgaccaatgccaacaaaaatatctaattatgcgacacaatttttttatagccgttgatgaaatattcccatgtataaacaatataattttagtattatgcccaagatctcaagaatataagtgcctatattttcatcaataaccaaatgtatatcttttagccgctgcatctagttttgcatcaaatctattgttcgctcttttttccatagagtaattccacatatacacaatacttggaacatcttagattttttttcttgttacattgtggttctaataaacgaaataagaagggaatggcgtaaaacacctataaataatatgaaaatgcatgcttagggagaattctgtagaaagaatagtagcagaggtggtggcatggcaggagattcaccactaccaccactattattttaaatttatttctgtccctataattcataactccaactataaatttctcttatttaaatggaagaatatttttacaagaagtatagttatgttttcctactagcacaagaagattagagcttcccccaatttattcaaagcatatcatctttcattccaaaagtagaataaacaaactaattaagaaagaaacgggctataggtgtcaagtatcaaccccaaaaccttgtgcatgtaacacttaaacatgtaaatgaaagacaagggaaaaaatgtttttaccactaataacttgtggcatgcatcgtattttgcattcatcttcttattcacacatgccaccgaattatctcacatacatgtggacccaaatactatttgagagattgaacaaatggcaacacccattaggctattactcttgaatatagaaaaatttagcaaaatatgttccccgacactacaccatgccccaagtttgcttactacatatctgtcaggaaaggacctatatgctgtcaaattatttgtcagcataacttttcccgacagatagggtctgtcaggccaagtgctgccggcaaaggtcttttccaacagataaatgtttgctgacagataactcgacagtcctacaaatgaattaccgacagacggaagttaccgacagatggtcctttaccgacagttaacggattactgacagatacgcagtttgcatatatcagtttttctgacagatattctgttagtgtgccctgcattgggttaaaaaaaatatagttcatggaatcaaatcctactgatctagaattgaatataccaccaacagttctcatgcatccacattccactagtactgaatataccaatttcatttaattacaaatgccatgtacataggttagttgtacaaaaagagaaattctcctatacaattctacaaatgagacaaaccgatggcaatctccaccagcaaggcaatttcctttgaaaagaaagcccctccaaaatatcttgtgaccgccatgataagttgagcatctaaaaacttgaatcagattatcagaaagacaaaagtattaagggtcagatatatagattataataatactccattcaatgataagtaatctatgcaacacctactatttcaatacagaattgaagatcagtgtcaaatgtgcaggataagtgtcaataacataactgatgtagttccatttaattcaatctgtagcatagcttcgatattctcacaatccaccaatattaaattaccagttccattttatgagaaatttatgttgaagcagtataattgcaatcgtaacagattcaattacaatttacaagcagcaaggattgcaatttatctcacaaactatgggaacaaactgattttagcttacatgatgtatgagcctttaagttagtgttgatcttctgttccttcaggtacccttctctgacacttcagcaagaagttgattgctcacccacaggtcgcaaatcatagctagtaaataaataaaaagaagataagtgctgaagtacagtttaattggctcccacttgcaaatgttaacttatattagaattgagatgtatgtaggtgacattttcataattaatgtagatggaaaatctgaagcccgaagactgtttcaaatttgtactacgacaactcactgcaaggacagctagccacctaatttgcagagatcaactaagggagttttatttaaaataattatactaggatggtacattctacaagtaaaaactcagtaaacacacaatgtacatgcatatttctaataaatggattgatataagttggaaatggcttcactagtaaatagaacttggcttgagtagttgctgtactatgtggtgcatgcaaagttctcaattagcatttcaattattccaactggtcctgatagctgatgcatgtctgtgtgaaatcaataatagatcaaatcttaaaaaaaatgttcaccactctttctagtacatatataataatgtctgccatgaaatgaaaaggaaatggagcaaacataatctccaatttattgaatagtgcatcatatagaagattagcacttaattgttaataccattgaagttcttgtaatggaaaagtaagcggaaatctaaaaatatgaacaattatccgtttttcaatttgatacattagatcagacagaaaatgtccataatgtggtacactacatgagaaatagtgcattttcttagtactaccacatttctgtaaacattacagctaacttcatgagaaatataaagcagaacctggagcatttagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactaaccgaatgtgcgctctttctcttttggcaaccatgattggacaatcaataaatgagaattctataaaagctcctaatcaacaccactcccgaatacggtatgctcgatcctaacagaagacacgagagtagccactgctcgattaaccgctcgtgagggggaatcgagtgcccctcgcaggcaattcgtcgaacaggagccgtgcaggctgtaatgagagagagagagggggggggggaccttgggtgcccagaggcggtcgtcggcggcgacccagcgccaggtgctgcgtgcgtccaggagctccatcacccgccccatcacctcctccccgagcacatccacggggtcctctcgtctctgccgcctcctcctcctcctccccctcttccgcctctcccactcctccgcctcccgcttccgccgccgccgccgcccgcgccttggttgccgatgacgtcgcctgcaccttgctcgccgccgccgccgtcgcccgcaccttgctcgccgccgccgcccgcgccttggccgccgatgccgtcgccttgccgccgccggaggaagcgtgagtgcgtgacggctgggtagggaagaaaaggataaggttgtggggaaattagggtttggtttatatatgataggctagatgggctttttgggcttgcaatatagtattattaatagtctaatatacaccctctaagttttgctgacatataattagctcgtactcttacaattactgacagatattttgaccaaaaatatatttagaattactgacatataccatgtctcattatgcactattgctgacatatagtttgccaaaaacctttaccgacagatatgttatcactaattgtttatttttgccaacagatgtctgttggtaattccatgtcatggtgtagtgcgagttatgtggtttttttttagtgtgaattgtgaaaccatgctcatatgtatcgatgttgaatagacattgaggtttatgaaaataaaatattactccctccgttttatattataagactttctagcattgtccacatttatatagatgttaatgaatttacacacacatatatgtcttgttttggttgatggtccactggagtcaaaccccggtcgcccagactgtcctttcccttttgaaagaatgggatttcatatccggggactctttatctttattttttaataaagtcttcagtcttaaaaaaagagagaaatgtgtgctatgcggttggtctactaatattgatacatgcaattttacattatgtactgtacattaactttttttactgcatgaagtactcatattggacagtaggggaggctgagcaaggagatggtacggaagcagaggctcggctggcgtggccacccgcaccgggtgctgcaccctgtacatcgtcctcacgcagccggtgatgagcgggtgggtacgaggggcgccaggccgggcgacggttatccttccccgaacctcagcgacgagatggtcggctggggctgcctgcccgtcaaggcgccgcgcagcgtaccggagtggacagcgcgcgcgccgttgggtgggactggccgcggctgagctgacgacgacgccgatgccgccggcgacgggacggcggtggtggtgttccgcgaggaggacccgcacacgtacgtcccgccacagcgcggtgatccgcacggcccgggcgcggctggtcgacgcgctggtgcacggggacgacagcgacgatgatgacgatgacggcagcggcggctcgggggagtgggatattgcataaaacatcgtaagcaagaattccgatcgcccgtttcatactctcttcgaaacgaattgcctctaaaagttctggtttagctcaaactttactacagtcagcaagaaacttcaaattttactattgttagcaggaaacttttgagactcaagttctttcaccaaatttcccaactcacctccttcgttttccgcgcgcacgcttttcaaactgctaaacggtttttttttgcaaaaaattctatacaaaagttgctttaaaaaatcatataaatccatttttcaaaaaagtaaatatttaattaatcataagaaaatacgtctctccgttttgcgtgtgcgggaggtgaggcctctcgaacacagcctaagagcaagtataatagagggctataaaaaggctgaatgctgaggtggatgagagaggagaggagagataaaaagcgggttgtaagtttacagctggcttagacacatgaaccaagaaaatctgtaaaacagataggtagaccatatatttatagtgaagagttaaccactgtacaagtgaattgagagataggctataaaaatctatacaaagcagctagctgtattattatccttggtcaggtcctgatagactggttgttctgatttaattatgtttctttattgtggcccttggcactgccagtattttcaaaggctcgtgcaaattccacattgtggactactggttaaaggttggggttctcgagcgttttccttttcagatcattcaccggattattgaaatggatcatttcgtccactttgcttcgtcacacaatattgatgttaccagactatcttgtcaatatttgcagtaaaccaaacagaatccaaatttgtttgcatgagtagcaactaattgggactgaattagtttttctagctttgtctgatataagaaaagacaaaaagtaatatacaggcagaaaaaaaatcaaacagaagatttcaaacaatttattacgaaattgcatttccaatccatggcctatgaattaccatcttattcccaaaatagaacacacaactgttacaaagccctgatttattttcccaatagatcaaaggatttccatcctacactctgacctccacgccagcatctaccagatgctctttcactgctgaaatcggaacctgtgataaagcagaagcgctcagttacgtccaacaaccctaaataatcttactatacaggtactatggaacgtgaacaaagattctaacataacgtgggcaagtattattaactgagcacgtagctctgttgatcatatagaacagactaacactgctgagcaaatgcaaataacgtaagctaggtcaaagttttccagaacttgcaagaaaaggaataaaggattatcatgtagagctccaggcatagcatgctgaataaaaagtacaaggcgggacaatacctctttccgatggaaaatgccagcagcaagggcagcagaagcatttgttttctcaaagacctcagaaaaatgttcgacagtaccagcaccactgcttgcaatgacagggatagtcacagcatctgacaccatttttaccagatctatgtcaaatccgcagccctggcctgaaaaataaaacaacatcatggcatattggcattcgtcttgtctttattcacctgttttttatactccctctatcccataatataagacgtgcacatattccaagattcaactttaaaaacatttgaccaacaattattataatataaattaaattttatttgttaaaattaatatcattggattgacatttaaatttactttaagatggttataatgttgctgcaataaatgttatagcatatgataaattataagtcaaagattagttttgaagactgtgccaagtttgaccatgccttatattatgggatggagggagtacctcttaacatgagtaatggagacagtgaaaattaaagtcaactggcaaaaaccaccctaaccgaaacttttaaggtgttacatacatggtcaaactgctaccaatagtcaataatgcatgtgtgattaccactggtctattaatgacgacaaagtttactgtgattgtacgcctcaaaggaaaacttggattcttgaaagaaaaacataactagaatgttctggttattgttagtgggttccactttgctattacttagcagaaaatctacaaatattgcgtaaataaaaatcaggcaaagcataatattgaactgttcaaaaccatgaacataccatcacaatcaatgcaattaagaagtatttctccagcacccaattcttcaactgctttggctagttcatatgctcctataggacggctgtcacgcccaccacttacctggaaaagacataaacaacacttgttggaacaaaagagcaatcttattaaaggacagcatgccacagtagattatgccagcataaagtcatttaatgttgcctaaaaggtagtacaccaaatatctgaagaaagcacatgttttaatcagtctgaaatttggtatgggcgttttgggtaataatattcctgcgtactgggaaaaacttttcatatgaatatacaaaaataccccttatgtgcatggataagagagtaacgcgaaattagcagtaaatggaaaacaaatggcttactgtgcactggtaccatgcatattcttctcctaatggacctgaaaaaagtacatgagatcttaatgcttgaaatgcaaatggagattcaggatgagtggttgaattgcacctttattggacacctttacagttttgaattgcacctcttccggattcttgacatatactcttcgagggtcaatacttacaacaactgcctaataagagaaatatcatcactgcaattagtgattgacaggttaataactataatagtaggacatgaatagatatatggtataccaatgactaaggtgaatgctatataacaaggttgaacataagtaatcacaccaagtatcttgagcaaatgcagaagatacattatatgtttttattcaaaaaacttatcagtcaccaattcaatataaatagcagagttcccaacaatggatacacctctgaaattagtggcacatggatggaagaacaaaaacttttttgtgatattttttaggaagaaaaaaaggaggaatgttttccatatattatgaagattagctgctaacatgaatactaaaaataatgttttggttgtatacggtaataaacaaattgtaactggatttctcgtggaaaacctggttgccatatactctagagatttgctccaagctgctttttcctgtctttacctgatacacaaaaagaactgtataattgggaaatagatgaagattgtatggaaaaataaaatacatacaccagtctgcaaataggcttcagcagcaaaaacggcatcactaccaattgaaatcttgtcagcaccagacctgaagtactctgacgctacttccaaacttgagtagtatctgacaagggaagaatacataattactctgtctgtccttttccttctcagtattgactattgacaaacaacaaataacacctcaaaaagatgggggagaggcacttaaggttgtaagattgaacatcagaacataaatatgcagagttgcagggaaaaaaacgaaaaagaaataaaataacaggctatcttaattcctaagaaagatcgaatacaaaaaaaaaaaagtctgcctagagaaggaaaaggtactttgggaatcatttgcagaaaaaactatctcatcaagtcagtaagagaagggattgcttggcagaaaaacatttcgatccatggtactcatgaacataaatggaactgacctcccatttgcatctgtgaagtctcttatacctccaccaactgtaagtggcacaaatactttctcagatgcacaacgtaatacctagaaataaatatcaacatgtcacctcgctggataagggaaatgatgaaaacatttggaggttttacgtcttgaacaaacctctagcattggcaaatctcccaacggaaagtcacggaaaccagttatattcaagaagctaacctaaaggagaatttttttcacaacatcagatcataagttcacatacagaaaacaataaagcattatgtagagaaatacctcatcagcaccatctatgtagtactggcttgctaaatccactggcttcccgaggtttcttacctacagatatagaacgcaaagatattcaagcaccaggcaaataacgtttctacacaactagtcagtcataccaagcatttataatataaaactattacattggctcatcagattcttgggagatgaattatccctaaagtaccacaaactactcaagatcacgaacttagatctaacccttaagtgtaaaaagttgaacaattcttaggggaaatgaatagagcttggtacctctttgctactactatggtctcttacatcatactggtcaccttttgttaccacaagatccccactatcatttgaccgaacatcaagacatgcaatgacctggaaattttaaggcaataagaagggcgagaatggaagttgcattgacgctaaaacatttggcgatacaaagcttactctctttgcaaggttcgatgctttcctacgagatgggacctgtgttataaatgcaagtatgaacttttacatcgaagaagttaatgaaaaggaactagcaacaataagcatacatatagcagctacctttgatcctgaagtgtttggactgagaaaatttttcaaaattgaaagcccagtagctgcagtaaaacaataatgggtatgcttagaaaaatctgaagtatctatatattctgcattattaagtattaacagaccttggtgatcaagaccagtcaagttatcagaactcaagaatctacatgtttcaatcctgtcttaaaatacattgtacatacttggctatggcatatcataacacattcaatatcaaactgcattttacctccgctcttttctgggtgaaactgaactgcctgaatgttgcccattgagatggatgatatgaaactctcgccatagttgcacacagaagaaatccactctttgttttcatctgactaagcatgtgaaaagaaagaaataactcacattccataagtccactaacgaaagagcatctaaaaaagagctgttccttacaggcagagcatgataggagtgaacaaagtacacatggtggccttcagctcccttgagcagctgcgtgtctttggtgatctccaaagcattccagccaatgtgaggcacaatgagacccttcgaagagtcaaatcgcctgacaactccaggtatcacaccaaggccgcttactgcattggacaataaataccatcaattccggttcattcaatcacaggttagcaatggaacagattagtaatccagcaaacgatgaggccatcgttcattcgcaggctagcaatggaacaaatagcaatcaagcaaacgatgaggcgagagcgagaaggagctttactcgggccattctcctcgctagagtcgaagagaagctggaggccgaggcagatgccgaggaaggggcggtccctgcggatgtactcgcggagcgcgtcggccatcccggagcgggtgaggacgtccatggctgagccgaaggcgccgacccccgggaagacgaggcggtcggcggcgaggatgtcctccgggctgcgcacgtcgcggatgccgaagccgaggtggcggatggcattgcgcacgctgcgcacgttgcccgcgccgtagtccagcagcgtcacggctgtcgcgtcgaaccgacggcgaagcgaagcgaagcaaaagcaaagcgaacgcggcggtgaggccatgggtgaagtgaaacgccttcgagctccggaattgaaggggagagtggtccgagtggggcttactgctagcgtcgccggacgcgcgcacggcgaccgtagaggcgccgcggcgctggctcctccgcttcggccgaccagcggagcaggggacggcgttgatggaggtggcggcggccatcgctcccggcggcggcggcggcccttgtggcagtatggggggtgtgtgtctgcgctctccctactctgctacaggaagggaggacggggaaaggcagattcgagtcaaccaaaaaggcccaattcagcccacagataaaccgtgtcatcctctattgtgggccatgcggcccaaacttttcgtgaccgcgaaagtatactttgactcccttaactatggcacgagtatgattcatgacctccaaccacaaaaccgggtatatcgacacctccaactatcaaaaccggtacaaaatatatcccaggtggttttggaagcggttttggcttacgtagcgcttacgtggtagtgttgacccggtctccgtcctacgtgtcgttgacgtgtcacttatgtggcattttagaataaaaacaaaaacaaaaatacgtgggaccaacatgtaattcacacataaaaatagtggggccccacatgtcatcatcttcatcctttctccttcctctcccctctcctctctccttttccccttcctcttcctctttctgcgtcctcctcgctcccctcgctctcctttctctcggcccaagcgccgccgcccacctgctgcgtcgcaccggtttatgcctgaccgccgagctccggagctgcccgcctcaccttctatccgcgacgccgccgaaaaccacttcggtcttaacgccgccgcctgtcctggagcaccgccgcgcacagggttcgacttcccactgtcgtcgcatccgggaccccgccggtaacgacccctcccagatttcagcttgaggaagatgcttgtcacgcccagaaatttagcccaaatttccagactattttgtgtattaaatccctgtccaggaccagccagggtacacaaaacgacaagtaataaacagttccgaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaaccgttgagtaattaaagtaacattaaatctccactgatcaacgctacaccacgttgaacaggcccaaccaacccacctaaactacagtgtattaggtcgatttattgaggtgggactaatcacggtgaatctggtcgaccgcccataaccgtgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatattgtaattatcccatcaactgagctagtggtaattaagcatggctaagcatatagttctagctaggtcacataagtaacatgagctagtcgattcattacccaaggttgacaaaggatagatatcaagtaaacatggcacaagcgagcagataggtaaaaccctgatcccatgtaattagcaaaacatgcatatttgtttgcaaacggtaaaacatttgtaaattaggatcaacatgctcaaggggaatgtgtgacttgccttgcttcttcacattgatcttccgaactcttttcctcgcgaccgcggacttccgaaacgacggaaactacacgctggcacgcaaaacaaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttctagaattaaactcgatttattgcgcaatttaaatcaattatgacgtcatccgacggggagagatggcgccggcaagcgggccccacctgtcggtgactcacgggtggcgggcgcaccgtggaccgagtccacgcacgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaagggggatcgggcggccacgggcgagcgggagccggctcaccggtcggccggccgggagcgacggcgcacggcccgatggtcgccggcgacgaccaccggcgcgacggcacgcgcgggaggcgacgaaaagaggggaaagggagaggagatggagggggtcctcaccgaggggcgccggcgacggagggagcggcggcgcatgcaagggaggcgcggtaaaggggaccgatcggcccgggcgagcagggcagcggcagccggccggtcgagcacacggcacggcggcgacgcacgcacggaagcggcagcgcacggcgccaggagggagaggaagaggaaaccggggtgctcaccatggggcgacgccggagagaggcggccgacggagggaggcgagatggcggcagcgcgagagaggtggtgcgcgaggcggcgattttccggaggcggagaggggagatggagtaggggccggggtagagcttggcacgacgttgccgacggcgcaagcggtgaggtgcggcgacgactaacgcggcggcagcggccggctgaagacggtgtgtggcggtaggggctcggcctcgcgatgggaaggtggttccggcggtggaggagggagatggagtggatgccggggtgcggcggggtgccgtgatgctataggtggcggcggcgcagcgcggcagcgacgggagcggcggtggcgggcggctggagatcgctggcgagcggcggcgaaggggatcggcgtggagagctcggtagagggcgcggcggcttggggaaaattggggaaatggatgaggggaggccggggattgtttttataggggagggaaggcgggatcgagcccgggagaggcggagtcggggcggcaaccgccggtggcgtgggcggcatcgtggggtgtgggtggcggttttggaggggaaaggtgggggaaaacggcgcggacgtgggtggcgaggtcccacggacgagcgcgcgcgcgcggggtgtagaaggtgggcggaaacggcggcgtcagggggcggctcgggcgaccatggcagttgccggcccgggctggaggttggggatgacaggtggggtccacgggtcccacctgtcggcctgagtgagaggggaggccgggagggaggaaaaacagacttgcgctataaggggaggcaagccgggccgcgggaggggaaggagggagggttttgggccgagcccgaaagggaggaaggggaaatttaatttgttttctttttatttaaattagtttaatgaactttgtgactttaaaactatttctcgagctccgaaaattcacggaaaattccggagagtacattagggcacaaagaatattacaaaatattcccggccaatgatttttaaaggaaaattttaattctcccatttatttcacttgattaaattgatttaacttttatttaatttctaggaaatgcattattaaatgatttttaatcccgaacgaaaatcggggcgttacaatgctaaccgtccaaccaccttaagaccaaacgattaaacaaaaacatattaatttagagccttgtgatgatgtgcaagcaaatggtaaaaaaaattcacagggatgagaaaattcccaggagccgaatcagaaggggagggaagaacaagaactgaacagatggaagaacctgtatacttggcagggtaaaccaatgaaactaatctcaaagaaaaaaagcaacatatgcgcccagaaagccaataaaagagagagaaacacatttttaataaaaggaagaaggacacaccaagatcagcatgaaaagaaggggaggggaccaccgttgcccccgagaccgtcgtgtccgccccagccgccgttgtccgccgcctccttctagagccggccgccgccgagcttctcactcgccaccgcctcagccatggccatggccatcaaggccaacacagccggcgtcgtctctttctcgctcgtcctcaagccatcgcgggacgacttcgccgtgcgcaagtggtttgactccgtcggcggcagagacgacgtgtgaccgatatcggagcgccatcccgacactggaggcagcgacaagcattgccatggcgcaagaggaggaaggaggaagaggaaggagagagaagaggggagaggaaggaggaggaaggggatgacatgtggggcccacatgtcggtgggtcccactattttttatgtgaatgacaggtcagtcccacatatttttgtttttttgtttttattataaaatgacacataagcgacacatcaacgccacgtgggatgaagaccgggtcaacaatgccacgtaggtgccacatcagccaaaaccgcttccaaaaccactcagggatatattttgcactggtttcgatagttggaggagttgatatatccggttttatggttgaaggttatgaatcatactcgggtcatagttaagggagtcaaagtatactttttccactcttgagtaaaagcccttgcacgttgcattccaaatgtcaattgcaagcttgagcattgggtgaaaaaggtaaggacaattacactgaaaagtttgtggtatttactgagacatgagacacagaaagagcacgtatcttttcgtggacaccacaaaaacttggtattgctggacacccgatgaattattttattatattcagtcaagaaggtgagagaaacttaaataaaaggcaagtttgcccttggggctatctttgtttaatctgattgggaccggttcgaactagacccattccactctcaatctcccgagaatggtgcagtgacaagcggtcaatgatggtgaggacggtgcatcagcaagttgcggtgatggcagattcaagcagtggggagtggcggttgattcaaaagagatatagtgcttgccattttcttcaccgccaccttcttcaccttgggtgaccccttcccgggtgactttcgttggggggccacattaattccagccatcgtcgtatgtgatctgagctcatagctccatcgatgccaacaccgtgttgcttcaatcggccaccgctctcaccagagctcaccgttgtcgacgcaactcgccgccgcaccatcatcattgccccaaaacttagggttcgaggagaggggatcgaatttggtctgattcgagatagtcacaatcaccttcagaagccgatcgacccgagggggaaaatggtacttccaacactcttttcgctctccatcttgaccggatataataaaatataatatgttgggtgtccaacagctaattaccatgtttttacggtgtccataaaaagatacgcgtgctttgaatgtctcatagcaaagaccataaacttttagtgtcctttagcaaattttgccaaaggtaaatcagataccgaaaaatgatcttgaaaaagttctacagattgtttggtaaaagatcataataaaaagctaagaactttttcacttttctggaaaccaccaaggcaaacatgaaaatgtctaaaagttgaattgagattatcatgatacaccgaagcaacgaagtgagtgtaactcaactggttaatttttttagtggaatggactttgaagatgcacttaaaccccctagtgggttttggtgattaatgacaaggtggttaaagcggactaacgtgtttatcaagtttattcacaggagtttagtcccaaagctagttgtgatggctaagaatgcaaggagaccccccaatttgaatgttcctaagtgcaaaaaacaacgaaggtgattagactaggtttttcacttttgaaattgagtttagaaaaaaccgtactattaagaggggtttcaagtgtggttctagggtatacaaagtgctcttagtcatatccatgagtcaaaatatttttggaatcatttttgaaaaatgattttctcctcgggacagagagggctacccggaggttctggccgaaacttccgggcgccgtttatttgcaaaaaatttcctaagtactgcccagaagttcctggcacttttgcccggaacctcctggcaggtttccagttcaaacttgtgagtaacggctagatgacgtcacctagtcgttatatatatggatttcatccccaggtcaccctttggccattccacttctgttcattcttgttctagggttttctagccactcccaagcttcctttacttcctccactcaaatctagagcctatcttgtgagattgagagattagatgagagagtaggagtgttttggagatggcttgaagattaggtctgattgagcactttggataccttgtgggttgtcacttgggcttattactcttggagatcttctcctagacggttaggtgtcgcccgtgagcttctaaagatcttgtggatnnnnnnnnnnnnnnnnnnnnnnnnnnnnnnnnnnnnnnnnnnnnnnnnnnnnnnn

SEQ ID NO: 27825 - DNA, 3214 bp, Oryza sativa
  unsure (1)..(3214): unsure at all n locations
ctcttctgggatctttgcataagtaagccaagggtttattcaagaccgcggctctttggagcacctcacaagagagtaggattcatgtgatccgaacttcgggaaaaaaatcgtctttgtctctcttgtgcatgatctttgtgtgaatctgctgatattctgcaatcttcatcttgttcctctgtgtgcctaaacttctcttgctaggacctgtttttcatctctgttttaatttatctctgctgcccggaagttcctggctcaagaactccggaagttccaggctactcatcctgcccggaagttccggtgttcatcaccaggaggttccgggccctgtcaatttaaccgctacgattgttgagaaaatttcaggaaagcctattcaccccccctctaggctacatctctgatcattcaattggtatcagagcaaggtgctcttgattcaagcttcaccgctttgagtgatccacgatgtcagacttagggggaaagaacggggaaaatggaaatgaagatgaagcaagcagcaagggaactccaccacccaagggagctactataccttttgattacagcaaacttactattccctctcacaacttcgtctccatgccttctaggcgtgctcctcaatttgatgggacatattatgccgcttggaagcacaagatgaagttgcatctaatctctttgcatccaagtatttggaaaattgtttgtacaggtattgtataccccatgatgacatggagctcacttcggagcaagaacaactcatctaccgcaatgctcaagcttccaatgcaattctctccgccttgaatccggaggagttcaacaaggttgatggactagaggaggccaaggagatatgggatactttgcaattggctcatgagggatgtcccgccgttcgtgaggccaagattgaattattggaaggaaggcttggaagatttgtaatggatgacaaggagacagcacaagagatgtatgataggatgatgattcttgtcaacaagattaaaggacttgggagtgaggacatgacaaatcactttgtggtcaagagacttctccgtgcatttggtccatgaaatcccactcttgtatcaatgatacgggaaaggaaagacttcaagagactcaccccaagtgacattcttggaagaatagtgtctcatgagatgcaagaagaggaagctcgtgaagtgagacaaatgatgaagaatgccgccatgatcaaaaatcaagaagttgctttgaaggcaaaacaagaagaagagtcaagttgtgaagaaagtgaagatgaagaaatggcttttattgtcaagaggttcaagcactttctttacaagagtggctatggcaaagggaggaaggacgatgacaagggaaagaggcaatcaaagagagcgtgcttcaattgtggcgaatatggccacttcattgccgattgtcccaagtcaaatgaagctaacgctaagggaggcaagaagaagccggagcgtgctcatgtggcggaggcacacatggcggaagtgtggtacttcggagatgaagaagatcccgaggtcaagcccaagcccaagtcaaaagacaaggttgaaggagaaggtggtgttgctaccgtcgccttcaaatcatcctcttcaagcaaggagcgtctcttcaacaacttgagtgatgacgacgacgactcctaccactactcttgcttcatggcccaaggccgcaaggtgatgactcaaaagccctctcaaacttctcttgatgttgattctagtgatgaggaaagtgataatgaattagatgatgtgcttaagagctttagcaaacccgctatgcaacatttggttaagttaatgagagctttggatagtaaagaacaatcactcgaaaggcaagaagaattgcttattcttgagaagaaaagaaaccttgtcttagaggagagcttagctaaagaatgtgctaaaaataaacaacttgctaatgagcttaatttggctaatggttctttagctagccttagggatgttaatgaaactcttcaagaaaaatttgctaatttagacaaaagtcataaagatcttgaagttcaatttgacactctttggaatagcacctctcaaccaaatgtggtttctaattcttctaacccttctactagcaatggtgtgctaggtgttacaatattgatttgaactcttatgctactaatattgatgctatgcaagctcttaagaaagagaatgaaaagttgtgcactttggtgaaatatggatgcatcaagacataccattcaaaagatgccctttacaagaccatcaccgctcatcctaacaaggatggacacgggttcgggttttcgggtagaagtcctgtgtctaagcgtgtgatggtaaatgggaaagaatgcttgatgtttgtgcgagaaggtaaagctccacaagcaagtgaggtgactggtcttgtgagctgccagggacccggaacatccggacaaaccgggcgaaacctccgggtgggagtctctgtctctcaaaaattcccaccagaaagttccggccggtttgccaagaagttccgggccaatggccgtgcacaagacatgaccggaagttccgggcataatgccaggaggttccggccagatggtctttactatgattcatatgtaatttccaaaaatttagagggaaaagtgggtgcttattttaatgggaattacaatgatgagtaccgcacttgtgtgtgggtgccaaaggctttggtaactaacatcaagggacccaaacttagacaagtttgggttcctaaatcccaagcttgatttcttttgtaggcatactcctccggtggttcaagttgggttgtggacagtggttgcaccaatcatatgactggagagaggagtatgtttacaagtcttgatgaggagaacggaactcgtgagaatattgtatttggagatgatggtaaaggaaaggtaattggtctaggtaaaattgccatctccaataatcaatctctctctaatgttcttcttgtcaattcattaagctacaatttattatccgtttctcaattatgtaagttgggttacaattgcttgtttaccgatgaggatgtgaccgtcttttgaagggatgactcctctgtagcatnnnnnnnnnnnnnnnnnnnnnnnnnnnnnnnnnnnnnn

SEQ ID NO: 27826 - DNA, 3229 bp, Oryza sativa
gtctaggtaaaattgccatctccaataatcaatctctctctaatgttcttcttgtcaattcattaagctacaatttattatccgtttctcaattatgtaagttgggttacaattgcttgtttaccgatgaggatgtgaccgtcttttgaagggatgactcctctgtagcattcaaaggcaagttaaagggtgatctctatcttgtcgatttcgatgtggatagagtgaatccagaagcttgtttgattgctaaatcctccatgggttggctatggcatcatagactagcccatgttggaatgcagaatttggcaactcttctaaagggggaacacatcctcgggctcactaatgtcacatttgagaaagatcgtgtgtgtagtgcttgccaagcagggaaacaagttgggaatccacatcctatcaagaacatcatgactacaacacgccctcttgagcttctacatatggatttatttgggcccgtggcttacataagtattggaggtaacaagtatgtttttgtcattgttgatgatttttcacgcttcacttgggtgtactttctccatgacaaaagcaaagctcaagatgtcttcaagcgctttgcaaagcaagcccaaaacctctatgatctcactatcaagagggtgcgaagcgacaatggaggagaattcaagaacactcaagtggaggaatttcttgatgaagaaggaatcaagcacgagttctccgccccctatgatcctccccaaaatggcattgttgagaggaagaaccgaaccctcattgaagccgcaagggcaatgcttgatgagtacaagacttcggatgtcttttgggcggaggccgtgagtaccgcatgtcatgccatcaaccgcttgtacctccacaagatcctaaagaaaacttcatatgaactcttgagtggtaagaagcctaatgtttcatattttcgtgtctttgggagcaaatgttttattttaagtaagaggccttgctcatctaaattctcacctaaggtggatgagggattcttacttggctatgaatcaaatgcacatgcctatcgtgtcttcaacaaaacctccggtattgttgaagtcactagggatgtgatatttgatgaatctaatggctcccaaggagagcaagttgttgtacatgttgtaggtgatgtggatccaagtcaagctataggcactaaggctattggagacatacgaccagtcgagacgcaggatgaccaagaggatagggatcaacctccgtcatcgacatccaatagccctacaagtgttgtgtctgctgagccagaagttccgggtcctattgaccggaacctccggacatctccaggcccggaagttccgggttctacagtccggaacctccggaccagtggcagtgaagacgtgccaacggcacaagtggatgggatcgatgctgcgggcactttagagtatactgatcaggcttaggtccccccagtgcaccatccaagaatatatcacactgtccaaagagatcatcccgtcgacaacatacttggtgacataagaaagggggtaactactcgttcttgtgtcgctaacttttgtcaacactattcgtttgtctcttctttggaaccaaccagggttgaagatgaacttggtgatccggattgggtgatggctatgcaagaggagttgaataacttcattcgcaaccaagtatggacgttggtggagagacccgaccaaaatgtcatcggcaccaagtggatcttccgcaacaagcaagatgaacatggagtggttgtaaggaacaaagcccggttagttgcgcaagggttcacccaagtcgagggtctcgattttggtgaaaccttcgcacttgttgctcgtcttgagtcaatctgaatgcttttagcctatgccgctcaccatgatttcaggttatatcaaatggatgtcaaaagcgcctttctcaatggacccatctcggagttagtctttgtggagcaaccaccggggttcgaggatccaaagttgccaaaccatgtgtacaagctccacaaggcgctctacgggctcaaacaagcccctagagcttggtatgaatgtctccgagattttcttttgaaaaatggttttgaaattgggaaggcggacactactctcttcactaaaaagtttgaaaataatttattcatttgccaaatttatgtcgatgacataatatttggttctactaatgcctctttttgtgaagaatttagtagtatcatgactaaaaggttcgagatgtctatgatgggtgagctaaccttctttctcgggctgcaagtcaagcaagcacaagaaggtaccttcatctctcaaaccaagtacgtgaaggacattgttaagaagtttgggatggaagatgccaaacccatcaagactcccatgcctaccaatggtcaccttgatcttgatgaaaatggtaaatgtgtggaccaaaaggtatatcgctccataataggatccttgctttacttatgtgcatctcgtcccgatatcatgcttagtgtttgcatgtgtgctcgctttcaagcggagcctaaagagtgccatttgattgccgtcaagagaattctaagatatttagttcatactcctaatcttggcttgtggtatcctaagggttgtgactttgagcttttgggctattccgattcggattacgccgggtgtaaggttgatagaaaaagcacaaccgggacttgccaatttcttgggcggtcccttgtttcctggtcctccaagaagtaaaattccattgcattatccaccgccgaagccgaatatgtcgccgccggttcttgttgtgcccaactcctttggatgaaacaaaccctaaaagactttggctacaacttcacgaagatcccactcctatgtgataataagagtgccatcaaaatagccaacaatctcgttcaacactcaagaaccaagcgcatagatattcgccaccacttcttgagagatcatgaaaccaaaggagacatatgccttacccatgtgagaaccgagagtcaattagccgacattttcaccaagcctttagatgagaaaagattttgcgagcttaggagtgagctcaatatcttagattctcacaacattaagtgatgggtagttggctaattcatagccaaagtgtcactaaaatgtaaattaaaaaacaatgagcttttatg

SEQ ID NO: 27827 - DNA, 1684 bp, Oryza sativa
ttccgggcctccctgtccggaacctccgggtgtcggggaatatatatactcaaggggagttagaagccctattctctctcctcatttcttctctctccccgacgccagccctagccgccgccacagtgcttctagtggcgattttcactttcatccaatcaaattcgtttcttcttcgtggattcatccacattggtggctgggaggttctttctgtgatcgattcgcagtttcttctctcaaggtagcacttcttgattccctctctcggttcattgtgtttttatcccgatctctaaatctgtgaacctagggagaaaaccacttggatagtcttgtttctgctaccttgtagatcaccgatctataggatttgttcacatgcactggcttttttttgagtcctctgttcttcttttttgccggccggaagttccggtgttcttgcacccggaacctctgggcgctgtccagccagcctgtcattcttacttctcttaatttttgcctaactactgcactccaaattgttgattcctgttgcagtaagcactatgactcgtgagaaaagacagaaagcctctcaagatgtgtccggtgatgagagtcctcctattcggttccctcgtggtcgtttgggtaaagagaaagttgttgagggcggcagtggcagtggcactcgtacttctcccaggtttacaaggcaatcaagcaacctaactgttcagattagggatgttgacagtagtcaaggaagtgatgcacctaatacaagaggacgggggagaggtggtggtcgcagttctggggctggaagggcatctcatgatttccctgtaggatctcgtgagaatcccgttcggctctacaagactcttggttttgacaccactcctttgcaccacattagaagacccaagtccaactaccttcatcaacttgccaagtgtagaagagattgtttgattgatccagagacacagcctgaggagtcacagaatcctcgcttcaggactttcactcaattggattggtataactcggtgattatggctagagaaaatccagtggttgagatgaagtggattgatgtcgcgtcccaaaacgactctaaaatctatcctcgaaatagtgcaaagaataattaaaattcatgagaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaataaacaaagtggaaaaaggttttataaaaagaaaatcctaaaagaagttcttttttcccccctttttccttcttgggccggctcggcccacttctccctccctctctctctctcctcccccgcggcccatcggcctccccgcgcgcgcgcgccgctgacaggcgggcccgcccgccgctctcgctgacgggtggggcccacctgtcatcgccttcctcccgccgcgcccgccgccgcgcccgtgccctagcgccgccgccgccgcggattgcgccgcatcccgccttccccgcgcgccttaatgaggggggaatcactccccgtgattccctctcccgtttcccccgttttcccctctctctctccctcggattcgtccgatttcctt

SEQ ID NO: 27828 - DNA, 1637 bp, Oryza sativa
cctgttaatgaatttcgacatgtagaactcaagaaaaattccacatgtcaattcagattattatttgcattaccttcttagggttttctcctgatttcctctgcattttcttggggtcatttggaatttacaattttgaccagggagagaaaacttcggggtgtgacagctaaggggggaaaacggcccacaacacccgagggacgtaaaatagacttttgcagggaaagctgatttggagagaattggagtttgtatttggattcaaattcgatattcgaactcgaggtttcagggaggaatcaaggaagactcaaggtagggtttgatatttttcggaattgggagcgagtatctgccgaggatcaaagaacgccattgaatttccgaatttgatttggagatttgagtcgaaggaggaattacgaggtggaggattttgatttcgatgagagggaacaacgggattgaattgagatcctggcacgacttagactctcacacaaagaacgaaaattttcgcaattaggattttgccgaattagtttttaacgtctcacgaaaagcggagagttacaaaacagggccggccaaaatatcgcagtatggttgcttctaagatttagataaagatgtaaaaaagttaaaatattagcacattcattcgatgtgtattgactttttttgaactccatcatgtatgttactattccaaatcgttgatcgaattaaagatcatgtattatcgagtgcataaaataatcaattatataaagcatgttccatgatgatccacagttaagtcgtttgctttatggctgataaggtgtaaaaaaacaaaactttgtatatatgttcttagcaaattaaaaaggaaaaaaagtacgatttaccccctgaactatcgtggtcgaccgaattacacccttctactcgaaaaccaaacattctacaccctcaacttttgaaaccggacaaataagcccccgaatattgttttgagtggttttgacttgaccttgcacacgtgacgccaacgttgcaatccaatcagccaaaaaaaaaaaatccctggcccacatgtcatacctcttctcaacccattccatctctctcacgctggggctaggtggcggacgaccattggtgggcggctgaggcggagcgggcggccggcggtggaggcagagctccccgtgcggcgggcagctgaggctgaggcggaggcggaggtggagcttcccgggcggtgggcggctgaggctgaggtggaggcggagcgggcgaccgacgatgccgtggaggagggcggcatcggcagcgatgagggagcaggcctccgtgccgtcgcgcgcgccacctccgtgccccgcacgtgccgcccctctgcgtcccacgccgcagcccattgcccgcttgctgttgcgcgcaagagagaggaagaggagaaagagatagagtgatagtaggacaaaaccgctctagattgggtcgaggggggtaatttgtccggtattgaaagtttaaggtgaacgatgtctggtttttgagtttacagacgtacatcggtttaagtttcaattctaaatttaagtttcaaactttaaatttttgttgtagttaataagcaaaaaaaa

SEQ ID NO: 27829 - DNA, 1486 bp, Oryza sativa
ttcaataaattagtcaattccacgattctggtctcttgtgttcaacatgccatgccccatggtttcccaaatcttgaactttaaaacccaaacaagctgcggttgtgtagaactccttgatactttacttgtgaggggctagaatagattgcatatgtactaagcgtgagttctggagatcaaaacccctagaccataactctagcaaattggtcttagcacggtgaattgtcaaggggctaaagaaatatcccctaagatagtagtattttgtcagcatgtatgccaccaagtaattgcactactgcaaaaatcatgcttccttggtacaatagatatgagtacagaatagtgggttgcccttgattgaaagaaaccatgttattcttgtagcatcacatctccaaatatttgcttcgccttcttctgtggcttttagtcctatgctattgtgcctttgtaggttgccaccagtgaaaattcataaaaaaatccgcatttagtttgactaccaaacatcttatgataagtcggaacctctagctaaattagactattagggcaatttcatccccccattaatgggaactaggcgagcaccatataaaatttctacaaagatagttcaaaggttcttagtcaaaaaaaaaaaagttcagaggttcatcctacagatatttttcagagatcgtttaaatcttcaatatatactgtggtgcaaacttgataagtcactaagtcactttggaccaatttctctttttcaagaataaaagtttgcacaatttgaagggaaaataaaagaggcattgtacaactgccacaagaaatctgcgtgtgcactgtttgatttgttagtaatttacactttttcacatgtacaatcatagttagttgttacaatttgagatggtctcagagcaagtttatcttctcgtgagcaccgttgcttccccaccctaagtttcaatgaccagtaataagatattaatcagagacagaaacacggtcgtcgtcttgagtactatgatcttccgtccaagctgttcttgcatgatgtgttgtgctcaagctccccatggcatcagtcttctccatccttgaccgcatcttggagttcagagaagtccactacaatgttgttctccatggcgatctctttggtcaccttcttcttcagctccatgctgttcaattgccagaaaacctccacaccaactgcaagatccaactttgttagctctctattcttccatctttacaactgcaaaattgacttgtgaaatgactggacaatatatgctatctagtaccattggatcaacaatgccggtgccgtcctttgccgcctcagcgaagtcactgccaaacttgtccgcgaggatggtgcgcgcgaacggcaactccggcaattcgccgcaccaaccggcgacaagcatgactgccgctgccgcctcacggatctcctcggtgcactcactgtaca

SEQ ID NO: 27830 - DNA, 4954 bp, Oryza sativa
  unsure (1)..(4954): unsure at all n locations
nnnnnnnnnnnnnnnnnnnnnnnnnnnnnnnnnnnnnnnnnnnnnnnnnnnnnnnnactacaatgttgttctccatggcgatctctttggtcaccttcttcttcagctccatgctgttcaattgccagaaaacctccacaccaactgcaagatccaactttgttagctctctattcttccatctttacaactgcaaaattgacttgtgaaatgactggacaatatatgctatctagtaccattggatcaacaatgccggtgccgtcctttgccgcctcagcgaagtcactgccaaacttgtccgcgaggatggtgcgcgcgaacggcaactccggcaattcgccgcaccaaccggcgacaagcatgactgccgctgccgcctcacgtatctcctcggtgcactcactgtacacaccaaatacaattgtcatgtgaccggaaaagagatagaggacgcgataaagtctggtgtgaggaaatgaaatgtatgtacccaggcttgtccagctttgcagcattctcgatgagtcgcttgtagtacatctctatcatttcgaacgcctctaacatgttgccctcccctatgacttgttctgcctgtgaggagagagcaagacattgctggcattagcatggcttgcattggagcaacctctcttcatcagaacaggtcgtagatacttacccggtggatggcgcgatcgaggtggccgagggtgagaagctggcgaacgtcatcggtggcaatggacttgcgagctaggcgaggccggcgcacagcagcgatgcgtgagatggcgagccctaggagggtcttgagcttgcccgtctgcttggaggtcttccgatggaggaaccccattgttaagtcggttctcgtcggtgttcttgtactaggttagtaggttgttggcttcgacgtttggctacgaactccaaccttggcaactgtgtatgggcagttcctttgcgtgatggaaaggaaggaggaggagtatgcgagttgcttgtgtgagctgatgaggaagtctgcgttgaggggcaaagattttgtagggccattctgcttctattttggggagtctaatttttgtgctcgttgcttcacttcggtgtacatgaactgctgaactcctttcttgcatatggaaaatggggggtgggcatcacgtgcggcattcctagataatgacaatgagcaaagcatgcacaatgctatgagaaaactgcaagccaaacgtgcaaaaaatttcaccagagataaacacgaagaacatgcattacccagggaaaacacgatgcctgatattggaggatgcagaacttgtgctggatgagaacgatttttgagatggcatagcgaagacgaacgcagtcatgctgtcatgcatgctcacaacctcggctgctaaacggcgggcttagtatccagctcttggcaaataagcaagccattgtagtcttcgggagctcagacaagtgcattcttcttagcgattaaccagggttgttaagtattttatgcccatcatggaggccctcatgtaaggaggccgacacaactgcggagtccaggcgacgccctacacttcctcgtcgctctcatcgaacacgacacccatctccccttgtgtaaccaagccgtgtagagcttgagcaacttgctactttccttgcaaggaggctagaatagatcgtgtatgtactatatactaagtgcaacttttggaaataaaaaccccttgacattactctagcatggtgaattgtctaggagctgaagaaagatcccctgagatagtagtattttgttgagaaaaactccgaattaattaccttgttgaattattgcgacggttcaatttacacctctaaactataaaaccaaaaattctacccactcaactcttcaaatcggaccaataaccccctatcccaatacaaattggatttgatcttatgtggcatcagacgcggcgattaattttttttttaatctacatgacagttggcccacttgacatcgatttttttttatttttttgaacatttttattttttaattttaaaataaacccttcaaaatattattttcaaaatctgaatcttttggccatgccagcccgcttagagtggcaaaacaacactgacatgccacacgcaacaagcgtgacagttttgtaccgtcgtgaccaaataacactgccacgccatctagaccggcatgacaatgttgttttaccacgccagtctggctggcttggctgaaaggttcatatcttataaataagttttgaaagggtttatttttaaaattaaaaagttcaaaaaaaattccttgatagctctatcttctctatttttttcttcacagcccaagagagaaaatgggagggcagggaggtagtgggtcatgggtgtccacggcgaagtcccgcgagtgacgacgctagcgagcagcggcgcggtagcaggagtctaacaccgaggctcgaggaggggcgcctagcggacagagctagagaagggggcgccgtcgtgctcactggccaggaaggcaggtacacaactagatctgaccacgggtcgtcagtgccttctggttgcagatgtgcaggtacatcgttcccgtcattgtgctgccgcacgtgtagctgcatccagcattgccatctagtgagctagctaagctcaaatactcaatcgtgaaggaggaagaagcttattaattagttggctcaccggagaggcagagacgatgttggccgtagctgcaagtgacatggttgcacccgctgcttatatacttgttgccaaggccttctactcctgccttgttggctttgttgccttgctcttgctgcttctgtttcaggacaccaggcggtgtcctccttgccgttttcagatacgaagaagaggaattggctccgcggaaaccaaaagattggttgacatgctagtacattgctactgcttcttgctctttgttgacatgctagtacattgcaaaagatagtgaattgggcgattttgccgcagcggcgcttggactcaacgcatggaagcggcgctggtgaggtttagatcgaaaagttgtcgtcgagttacttcccttccttcatcgctacatctgaggtcgagagagagatagagggagagatatgacatgtgggcccactgttgctttctttattttttcagttggaatgccacgtgtgtactagtttgtgcagaaaacaactcaaaatagtttttagtatttgtccggtttgaagaattcggtacacaaaatgtctggtttgtagttcgcgggtgtaaatcggaccgatgcaataatttaggggtgtaattcagactttttcatattctgtcaaaatgcatgacaccaagtactacagaatcatgcttgtttagtaccatagatatgagtgtagaatagtgggtggccccttctttatgcagagaaaccatgttattctcgtagcaccatatttccacatctttgcttaaccttcttatgtggttttatccctatgcttctgtgcctttgtagaaagccagctgcgatactgcactacctctttttcatactttaattcgttttattttttttaagtcaaaattctctaattttgactaagtttataaaaaaatagcaatatattcaacacaaaacaaaaaaactaccagaatatgttcaatgttggatataatgaaactaatttggtgctataagtgttgttatatttttctataaacttggtcaaacttttaaagcgtttgatttaaaaaatcaaaagctacttataatattaaatggaaggagtaattcataaagaaatccacattattttgacgaccaaacgtcggaacctctggctaaactgtagagcacattcatcctccactaattggagctaaggaacaccatatgtaattgttacaagtatcgtttaaatgttcatcatacatatattatagcagacatcatttaaatcttcagtatatactctgcacaaactaaaagtttgcacaatttgaagggtaaaaaagaggcactgtaactgcaacgataaatacgtgtgtactttgtctgatctgtatttgcaatttacacagggagatggattctaatctctcgggtggacgtccacccgtttcttgcatgtcacctaaatgattatgaaaaaatttcaaaaaaaaaattgtaacataggttaatatgtaatatatcatttcacaaacatgcaagttcaaatttgactcctacaagctataacaaaaataacaaattaaactttaactagtatatgtatatttacagtcaaatttgttgtttttgttacaacttgtggaaatcgaattttgaacttgcatgtttgtgagatgatatattacatattaacctatcatgttattttttttaaaaaaatatcataaccattcagatgacatgtaaaaaacgggtggacatccacatgtatattcacagcttggtaatcttggagtgcacacacagcactgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgannnnnnnnnnnnnnnnnnnnnnnnnnnnnnnnn

SEQ ID NO: 27831 - DNA, 22962 bp, Oryza sativa
ggagatggattctaatctctcgggtggacgtccacccgtttcttgcatgtcacctaaatgattatgaaaaaatttcaaaaaaaaaattgtaacataggttaatatgtaatatatcatttcacaaacatgcaagttcaaatttgactcctacaagctataacaaaaataacaaattaaactttaactagtatatgtatatttacagtcaaatttgttgtttttgttacaacttgtggaaatcgaatttgaacttgcatgtttgtgagatgatatattacatattaacctatcatgttattttttttaaaaaaaatatcataaccattcagatgacatgtaaaaaacgggtggacatccacatgtatattcacagcttggtaatcttggagtgcacacacagcacctagtttttttttacatttttgagctggtatcaaaggaagtatagcttcctgtgagcaccggtgcttccccacctgacttgtgatatacactaataagatccatcagagttagaaacagggttgtcgtcttgagtactctgagctcccatagttgttctagcatgatgtgttgtgctcaagctcccgatggtatcagtcttcttcatccttgatcgcatcttggagctcagagaagtccactatgatgttgttctccatggctatctctttcgtcaccttcctctttagctccatgcttttcgcatcactggacaacttccacaccaactgcaagacccaactttgttaactctccattcctccatctttccaaatacaaatcattgactcgtgaaatgaatggatagtatatgctatctagtaccatgggatcgacgattccggtgccgtccttggccgcctcggtgaagtcgctgccaaacttatccgcaaggatggtgcgcgcgaacagcaactccggcaattcgctgcaccaaccggcggcgaacatgaccgacgcggcagcctctcgtatctcatcggtgcactccctggacacaccaaatagaattgtcatgtgaccggaaaagagacaaggacgcgatcaagtcaagtgtgaagaaatgaaatgtatgtacccaggcttgtccagcttcgcagcatgctcgatgagtcgcttgcaatacatctctatcatttcgaacgcctccaacatgttgtcctccgctatgacctgctctgcctgtgaggagaaaatcaagacattgctggcattagcacgcctcgccttggagcaatgtggatccctctcttcatcagagaaggtcgtagacacttacccggtggatggcgcgatcgaggtggtcgagggtgagaagctggcgaacatcatcggtggcaatggatttgcgagcgaggtggggccggcgagcggtggcgatgcgcaagacggcgagccccaggagggtcttgagcttgctcgtctgcttggaggtcttccgatggaggaaccccattgttaagttatcggttctcggcggcgttcctgtcctaggctgttggttatatgaactccgaccttatcagttgtatggtcagttcctttgcgtgggggaaaggaaggaggaggagaatgcgagttgcttgtgtgagctgatggaggaagtctgcatgaaggggcaagggttttgtagggccatgttgcttctgttctgggtagtttaacttttgtgtttgttgcttcactttggtgtacatgaactgtcgtactcctttcttgcatatggaaaatattgggtgggggagcaattgagcatcacctagagaatgacaatgagcaaagcatgcagaatgcaatgagaagacagcgagccaaacgtgcttacgtgcaaagaaatttaccggatgtaaaacgcaaacaacatgcagaaacaccaaagccagggtaatgtgctgctctgcttcaagcagttacgaaaggaagcacaatttgtgcgtggtgaattttattttaagatggtacagtgaagacgagcaccgcatgcacggctgagatagcaactagttcagtagttttactcgcagataacaaagccattacacatctaggcacttatgcagagtgccatttttcaggtgtagcgcagcagcagcagcagccgtgcatcgatccaaactttgtgcaaatagcgtgcagagttgtgcaattcatcgatcaccccgtaaagactcagttaacccgtctcctttcgcaaaacggtgattacaactcctttgtacaggacaacaaaaaaaaaagggaatatatcacctctgtaatttgtacattctctttcgtttctagcgcaatccattttaattatacacatttgatttcccagaggcagaatatcatatctgtatctcgaaagcagatcctctaatttaactgcacatgcagttgagtcactgacatgactcaactgcacagctgttaagccaggggatccctttccctgtatctccagggatcccgcgcgacgaacctccggtttgccagcaaaaaagcaacggcccccagttcttcctgcaccggaattcaacagctgagctgactgaccaatgcgctgccccgcgccaaaccaacgaacggaagacaccacatcatcttcgggtgcgcaccgagttgagcctcccctgctcctggttcagcggcgcgcgacccggcgcgccgccggcgccgtacaccctgggctggagcacccgctcgccggtgccgatcctgcgcacctcctcgtgccgcgcgatgtgctcgttgctgcgttccagcgccgacacgatccgagcgtacggcgggtggacgtggtccgagctctcgtacggtctcgcgccggcgccgtccggctgccgccgttgcgccgcgccggcgttgatgtctctgtaggccgcggggtccctcctgtagggcgggtccctgtactggccgcgttggggcgccagggacaccaggggctcgcggggcgcgccggcgccggcgccgagctcggaggcgtgcctcctgtgcggcgggcgcgggtgttgcgagttgttgtacacgccgtcctggaacggctgcgggtcggcgccgaccctgccggcctccccgttccacgcgccgccgcagatgccaatagtgaaggccctcctgtaggaaggccggcgcagctgcggagtccaggcgacgtcgtccacttcctcgtcgctcccgtcgaacacgacgcctttccccttatgcgtcccctccgaccataccgacgtcgccgtgctcctgtcgctccacgacggcgacgtcgatggcgacggaggcttgtgcggcttccaggagggcggcgcctccttctcgcccgcaaccgaattctgcaccggatgcaccttctcgtagccgccgccgccgccgcctctcgatcccttcccctgcgactccgaccgcgagagctcgacggccgccctcgcggccatcgcggcgaacgatgccgacttgaaggccgcctccgccgccatcctggcgtcggcgtactgttcttgcacgctcagccgagcaagtatcgggttcacttcttcgtcaacaaacctctgcctcccctgaacctgttacaatttgaatcctcgacattagccattagatactacagaaaaagaaaaaactgctatgatcttgtacaagtgctagtacctcgtgatgctccctcttgacctcattctgttcgacaaattgttcagctcggacgttcctggcttgttcattctgcttgccctgcattgcacagtacagcaaccatacgattccgtaacttcgtaagataaaaccaacgaaaaatctcaacaaacagggatattacatcgcgaggtagcgcagattgcaaccaacctgatcggtatctccggtgttctcgggaaattccagtaagatatcgttctcggcggcgatcaccttagtcagcctctgcttctgctccgtgctcgccggcgcgccggacaacttccgcaccaactgcagcggcagagcaaccgtgtcctcattaactccagttcgttccggtccatgtctcgcgcagttggcgagcgacatgacacggcatgtgttgggtggtagtagatgggtttagttggagggatcaatgatcaatctaaacctaccgtgggatcgacgacgccgtgggcgccgtccttggccgccgcggcgaagtcccggccgaacttgtccgccaggatggcccgcgcgtcgagcagctccggcaggtcgccgcaccgcgccgacgcgaacatgagccccgccgccgcctccttgatctcctcgccgcactctctgtatacaccaacccaaagatgacaaaagcttgctgatgagaggcgatgaaaacgaagaaacaaggcaaggaattaatcaaccgaggagtcaagaacacggctgtgtgctcttgcatacatacttgggcttatctagctgcgtggcctgctcgatgaggattttgcagtagagctctacgatgtccagcacctccagcatgttgtcctcgtcgatgacttgctctgcctgcagaaacagaacacggcggctactgttagcggaggagtctctgcgcgtgtcaggcaaggcaaaagcatggcatggacatacacggaggagagcgcggtcgaggtggccgatggagaggagctgcgcgacatcgccgcgggcaatggagcggcgcccgaggcggggccggcgggcgacggcgacgcgcgcggcagcgagcttgatcagggacttgagcttggcggtctgcttcgaagaggcgctcttgccgccgaagaggcccatcgcccccgccgcgacgcgctgtgacggcggtgttcgatcgggtggtgagtgtggaggcggcgggggtgtagcctcctacccctctcttataccgcccgctctggaatcttggattggtgctctgtggcgagcagcggcgcgtggcgagagcgcgaaggagaagaagattgaaggccaagttgcttgcttgttttggtctccgtccattcgatggaaaaacgttgggccgattttggtctttttaccgtgccaacacatcaagataaattggtaaggatggaattggccgttgttttgtttgctatgattttttctttaagcaaccactacgagttagtgcgatgtttcgtattaatggatcagttaaaaaattacaattctacatcttataaaggctataacgaacaaaaagagagaaaaaaacactaccccaggcggtttgcttcgattatatcttggtaacatactctgtacatttgttggtgacgcgtgctaaacaggcagctaacagtcttgttgacgaaaaatgcttgccatgatcccaaggagaaaaatagcagcggtttgaaacccggcaatgtgtacctgcattgttctactcaattgaaagctctgatgttcctgcttaaaggagaacactttagcacatgtatttattccgtatgacttttcgaagaaaatgagtattaagttcctgtcctataatatttctccggcaaatcatctactaggtgtcattatctttcaaccgtaaggtacaagtacaaccaactagccctgttacagtaaacgaaagctcaaattctacggcgaacgccttcatccgcagtctgcaggtgccgtgccgatgtcttgcctgttgttcctcaaatctttgtctactgctctgcagttggaccgccaatcacgtttggtgatttggtccatctgacaggtgtaaagcggggattcatagcatgtcgccgtatgcaaagacacgacacaaaccacgcgatcccggggcaaatcactccgggctgctcacggaagctttgcatttgcagaggcgggtcagccggcttgctagatcgatcgacacggagcagaagcgactgctgtaagaaaaaccctctcgcgtcgctctcccgaggggcggacccggccgtccctctcccccacccccacccccttctccgcctcgccgtcacccgagcggccgccggtgaagccgcgcggccgcaaggacggtggcggtggggcgctccttgtctcctcgcgctcgggtggcctggggagccgcccggagtggcgacggcggtgtccgccagatccgcgccgttccggccggatctggcgggatgggctggcggcggggacgggcgacggtggcggttgaggtgagttgcgccgggtggtgttgtgggtgatggcggcgggaatggcgacggcgttggggtagcaatggtggaggccgcggatccggcggtggtgcacccggatccggcggcggccggtggtggccagagcacgcaggcaccccgtggctgccactggcgtcctccggcgcccctctaggcgtcggccggcgttggtggagaggaagacggccggatctggctccttgcccagatccggcgcgtcctcgggtgggaaccgagtctggtcgtcgtgcaggtggtgtgaatatcgcaagtatcctcggtgtgcaggtgacatttggtggctcccgtcgtggatgctatggttgatgggtgctccaaggcgaaagtcttgctccgctctcggtgctagcaacggcgacgtccttgggcgccgttcaccttcttgaaggcgttgctactggagccctcgttcaacttcacttcaagagttttctccgggtgaaaacctagattcgttaggatcggacgatgtcgccgttgtcggcataaccttcttgaaggcttcgttttaggagtttatctcatgttggacggctgtacttaggttcagtttgtcaatgtcggggtttttgccggttttcctttaattaaccgtgctgttgtaaagtttttgggtccggtttcccttataaattgaatcaactctcttcttctatagtgaattgcaggagctccctgcctgtcccctcgaaaaaaaaacacggagcagaagcaccggctgatcaatggccactccactcgatgcaattgcaaggtgaaaaaaaaaaagaaatggttggtagtagttacagttgtgctacattgaccagttaaaactttgtgagattaaagtcgttcgaatcgtcttccatgatattcctcccaaaataaaaggctaccatattcagtgcagaatatttggttgttctcgaccactttgagcatggatcgattcaggctggcgttcatccgacgcagctctagtcagcttgagactcaagttaatccctagtgatacaataccattttatacctccagaaaggaagaagggagagcccctttacagctagaaattttaatcagtgaccggtgactaggcagctgcatggtgtcgaaacatggattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgatgatcaggttatgtcatctgccccctagagggcctcctgcccaccttatataggatggggggcatgattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccacaatatccacacatggtaatatatattagaggatataagggcccctttgaatcgtaggattgaaaaaacggaggaataggaaaaatataggattctgataagaatgcaagtataaaacagaggattgcaaaacacaggaaaaacacaggaatggccgtttgattggaccacaggaaaaacgcaggattcagatgagagagatagactcaagagaagttttccaagaaattggagtggatgttaaatttcctacgtttttcctctagaatcgtaggaaaaggaaagtttcctacgtttttccttttctcattcctacaaatcaaaggtatgaatagtgtaggatttcaattcctttgtttttcctccatttatcctccaattcaaatggggcctaaaaatctgaggtgctcttcgatgattcgagggattctgatgggtggcagttagctaggcaaaagtgaagcatcatggcccatgaagggcggccatgggcgttaacagtcattagtccacttagtttagtcctttgccgttcctttcaccgttgcttctcacaagcgcctacttggctcgaccgatcgttcgatcatccacgacgtaattgtgattagttttggctgtttgacgtgttgttgctgtggtcatggagtgtactgcagcaaagcaaggacagggggcgttgcaaaagttgtactgaagttgattttcaggaatcctgcgtttggactttggaaccggtccctctcatggtaatcactaaaaccagaagttcagcactcaaccgtgtcaatgggactctagaaaaaaaacaggtgcagaaaataagtatgtatcatgaactcatgaattctagtactctagaaaaaggtgtagaaaatactgaaagtggaacgtctttacggcatggtcgtggttaggtcgatgcagcaaagtattgataatgaattattgcaccttagtttttacatcacacaccacaaaagtccatatagaccaagataataactgtagaaaactattacaggcagacggtaatccgtataaaacatggcagatcgttctcgcaagtccaaatcgccaataaaccgatccaaatcagacaagaaacacataaataagcgtcaaataaaccggcggttaatcagaccgctccatccatccagaagatgacacacgcatcaacacaaaacgaatccaggacggccggatgcacgctatcattcgtgggagcaaggttagcaaacagaacaaattaagcgtgatctcaaccaatcattattatttgcacagaagaaaagaagcacggatgagccggtaggattaggaaatggttgcttttgatggcgagacgaaaagcaacgcagcgggagtagtattctccaacgcaacgaatacctgtgaataacctgtcactggagtccactgacgaacacagacagaaacggcataataattgaaaagccatatgccagttctttactgaatttttttccctcttgcggtttctgaaggttcttctatgtggaagatagcgatggcgtcgagcccacacgcgcccattctgatcctcatccagagtggtgggcggaggcgatcgggacagggtttaatttgcagtttcttcttatgatcttatcccgtcgtggagtgagcaatcagctcgagttgtgtgcttgtgtccgtgattctgtcgccgatgggatttgggttcgtttcttgtggaaactatcctgattctgacctgtttttgacatgatcaggcaggacgtctcggcactacgtgcaggctagctccagccaggcgtcagctaccgcaaaaccatcagaatccgatgcgcgtacgtgttcaaacgcaactgatgttcagtatcatatcgaattcggcgggatgtctagtgcagtggacacctctgacttggctctgctgcaaccttgatccgtaagaaaacacatgcacctgcagtcattttagtagcagacagtagtatctgcttttaaccttggtaagttagtgttaagtcaaataaccatgcatcaagaaacgcttttcttttttcaccaaacacattgagtgtagtacggaaacacgcggcctcctacggcgatgccatccggcattttacaagggtaggttggtgccaaaagcgtcgagcttggctggatgctatcgtcagttggtctccttaccaacttgattagtagtagtactagtttgattttgtcctggtttggtcgttgatggtgaacgaattggaattatccgccttacaaaagagctgtaaggatctcgtgcgatttggtgaagctacgagcaattccagaatctccaatcatcaggtcccatgtgaagaaccgaaaaccactacagtgacacgaagaaacattccttatttcatcaggaggtacataatcattatactaccataattcatgaatggctacgtgtcagatatatgagttatattaatctgtgtaggtctaactacgccgagcattcactccaaaaaactcctatctctaacctgaacaattcagagaaacatcttttctgattcagtggtgatcctggcagcgactctgtacctgtctactggtctcaactctcatctatgctgcttcatgagaactttggccattttcaacagttcagcaaaacttgcttggtgaagaggagaggggagaaaacccatataggctgatggtacacggcctgttgggccaaatgaattgggcctttttgggccgaccaagtttagcccatttgccacttcctctccctcgcccaccaacgaacaggggaaaacacagcgagaccttccccgtcaatgtccgcgtccccttccaaggagggagttagggtttaactccgactgaacgatcccccccgccggccaccgccctcgccggcgtcgatccgatacggcgtgcgcctggtcgctgcaccatggggtacctgcaggaggccagggagaatcacgtcaagaagaaggtcgaggaaggtgagcccccgcatcctttgcctgttcaagcttccgaattcgttgatttggggggtcttgaggtctgcaaaatcgcctgatagttgcgtaacgggtgaggtactgacgaaaaattgcgctccgctggtgttgcttgttgaaatggaaacacaatcctgtgtaaaatgagtcgtcaaacgaggaggttaaggaggttggctgccgtttgggctggccgaaccttgtagactttagttgagaagttatgtgatctagtgcttgccggtatggaagctgaatcattagttgattaagcatgccattcagatttcatagttcatgtacatctctcccaactggttaacactatctgatgatggtaaccggtatatgctgtagttaatttgtttacagaatgttggatcttgtgtgatgttatttattcgtgtatcattatatagctcggtttactaaatattatattatgagcactcaagtacattcaaacttgtgagacagccctgtaaagaatttgttgcactgagcatcagtcctttgatttttttgaatctttaggagaactttcttgtgaaagacaaactatatgcacagactgattgactgaacgaactttccttataatgttaggagctgctgaagactgctgtacagaataataaaggaagaacattcagaaaatttgaacatgtgccttttgtatttcaaaagagttttctcaattagttgttctctagtgttaggttagaatattgtacttaaggggaaattttgtgctttgcttgacaatatccaagtttcttgtacttcacatcagagagttaatttagcccattctatttcacttttcagctttgcggagcaaaatgaagcagaaggcccttaaggagtgtgatttctactgctcaaaatatgctgagtgtgctcgaggtagaactttttcggtggtatggcaatgccgcaaacaagcaaaagagttgaatgattgccttcatcaattgtaagttgatcattatatgccagtatcctaatagtaattcaagcggtattccggttcgtgtttgaacattgttgatttttgtacaaaccagagctccagagagttccataacatgctataagaatatataaggaaaattgtgcatggagcctaatcacagaaactgattagctactttgtactgttcattcagtagatacttattgttaaaaacatccacgcactaatatgagcagggaagtctgcaagatatttgtcaacatctttactctctaatctgtacatatatgaggggcgaggatttccattgctatcaaaaatatcttccactatatgtttaatcattgtatgctgtagtctggctgttatttcaagttaggatctaacttattgaccaatgaatacatcagtatttcctgcaatattacactgacagtaggaaccaggcttattttgatttttatttggtcagtctttattttgctatgtagtacattgttagggatttgatggagtcaagttcagtgaattctttgttttagaatcccagtctaaagctacctgtaactgtactagcatcatcctttaggagcgtagtgctgaaagttatttctttcaatgcatttgggaaatctctctgtcaagcatttactgttacatttttttttctgaagatttcctgatgctttgcttgtagactggtattggccagtgcatgataaatacaccgcggttcttttagatgtaataaccatgctatatgtgtgtatgcttgcagcacaaatgatgcagtcctggaagaaatgaagaaggcttacatggttgagcaagagagcaaggaaaagaaccaataagcattatgcaatggccaatggccaatgggtttctccatgcttgtacgtacattgctccttttggaatttgttagttgcttattagtcatcttaattgatttgatgccgagttcctggagacttgaaaacattgattttgttccacatgcataatctggtataacatcaaggtccctatgcgaataaccttgtgttcccgttctagctaccatatgttgtaatattcgcccaaatagatagcatatgaatgcagagaatgtggtaagccttcctatatcatgttctttagggttagtcatgtttgccatgatagtatattatcatgccatagcccatagagtggtcagcttgttattatattaaaggcattaagacttataagtacaaacttgttagataaacatacagaaaactaacaagcaatggtaaaccacaagtcctcatcatcttcctcctgaaagatcagacccagggccaactgttgttgccaatgaggatgcttccagcatggcgtatgactcaaccctttcattctgcagaaacattagtgtatcatagtccaagtctgtcggcaacatctctggtgccagcacagtgccattagggtactgcaggacttgccgcatgctcggccgtgcactaggcaacggctgcaagcagaggagccccagcttcagcaccaagttcgcctcctcggcaacatactcactgctgagcctgggatccaccacgtcaagaatttgtcctctgttccagttctcaagcacccaatccagtagcacgacctggttgtcctggaggtcatgttccagaggccttcggccacaggccacctccaaaagaaacatcccaaaggcaaaaacatcagtagctggtgatgccttccctgtgcggagaagctaaggggataggtaacccattgtgcctacaatatgtgtagtccttgggttggtgccatggtcgtacaaccttgcaaggccgaagtcgcccaagcatccattcatctcattgttgagaagcacgttatttgccttgatgtctcgatgtacaacgacttgttcccattcctcatggaggtacaataagccagatgcaatccctttgatgatgtgaaaccttaggttccagtctagaacaggattgttcttgtcatgtaagtgcttgtcgaggctaccatttgacatgtattcatagaccaagagaagttcacccttgcgtcggcaatagccaagtagctgaactagattcttgtgccgaaggcgccccatgctgacaacctctgcaatgaattccttcaccccttgcctagagtcatgtgacactctcttcaccgcaatctctgagttagagttggatacagagagaactcctctgtacactctcccgaatcctccaattccaagcaaacgcttgctcccaaacccttgtgtggcatcgaacagatctttgtaagaaaacctttgtggtccaaactcaaccttccaatcttctctcagctcggcatgcctaaaccatctcttgacaatcatgaaccccacaagaagcaatccaatgacaagagcagccgtggctatcggcagcacaaccaccaaaatttcagatcgatggtgcctctgctctagttttggcaacacaggcagcttagatgggttgagagcaggggcagctccattcaagctgaaactccagccaagaacataatggtaggcaatggagaggcctgtcgccgacgagaatccgatgtaggcaatatcctccactaccctcgataggtcgaggccggttgggagcagaggtttcttgggcttggacacacccaatggagctagcgtcacattcagaaccatggcctgcccattgtagtccacccacacctgcatggccttgcggcttatcagtgtcaagttcatgaacgcgccggtgctgtcatcatagtagccggcggtgtgggactgtatgaattgcaggctgttcacgtcaatgccgacatggttgctgtctatgtcgtggagctccgggctgaggacggtgtcgagctcgacggcaaagacgtggttgctcgccttgccattgtcgctgatgttcatgagacccaagtgctgcgcccctgtggtggccgagaggttcttgctgggcgcgaccaggaacgcgaggccgtggtcgcttagctccgcatgctcggagacgatggcgaacacgaaggtggcagagaaggatgcagtagcgctgctgttcggcgtcaagtggaaactgacaggagtaggatagaaggcgtggcctttgatgtgcttgtcgttggtgagcttgagcaggccactcggcgtcacggcggcggcgccatcgaggctgaggtttgctccggcgaagccttcgaaggcgaactggttttcgctagcagatggcgccaccagcttgatgcagtggaagacagtgagtacaaggaagctggagatgggcctgatgatcaccatggctaccgtgacgcatgagccagggcagagctctcaaattttgtcacttccgtcttcagtggttgggtgaagtttctgaacaagcagctttgtggcttggtcttcatccaagtcaattcaatactaatgcatcatcatcagaaacagtaccctgctagaaaggacagagggagaaacaaggatgccgtagtagtgagatagtcagactactgggtaccaaatttctaggggataggtttactagtggagtagtggtctaattgctttgccggccggccacgatccgtcaacatttgactcgttcgacaaccttgcgtggtgagaaggaggtgtttgtttactagtctgtgcatctgtggtcactcaagttccttggtttcaactcaaaacacattgtatattatgcttgtcattcatagagatatacactgtacactaagaatcagactccggatgtttcccatgcgaaagcaaagtcttgatttgtactcctataaaacttccatgtctaccacgaatccagtctaccaggaattttgctgtccattacagatttacagtacaattttccattagcgccactagtactactacaatcatactcctacatcatttgtagtaaatatcatctgtcaacacaaaaccatattatcaccttcctcccgagagagtactagacatagtaccgatgcttgatgacgatgtcattgcgtatgacatagcatctgggttaagccccttgttcttcagcagagtcgccatgctgaagcccatttgcgctgccctcagttccgggaaatcgctgtcgccgttgaggtactgcacaacctgacgcatgctcggccttgcactagccagtggatgcgagcaaagcaggccaagcttgagcacaagctcaacctcctcctcggcatagccatttctgagccttggatcaactgtttccatgattgaaccgctgcgccaatagtcgagcacccaatcgacaagcaccataggagcttcctgctcaacaggcctacgcccacatgtaacctcgagaaggaatgcgccaaatgcgaatacatctgtatatggtgtagctttggcgcggtgtccaagctcaggagctaggtaacccattgtgccaactacatgagtggtgtttggttcagtaccatggtcatataatcttgcaagtccaaaatcgcccaaccgaccgttcatctcagcatcgagcagtacgttgctggctttgatgtctcggtggatgactactttctcccaatcttcgtggaggtacaacaaacctgatgcgacgcctttgattatctgaagccttcgagcccattctagagtaggtttgtcttgatcatataaatacttgtcgagactacccatcggcatgtaatcataaaccagaaggagctctccctttcttcgacaataatcgagcaattgcacgacattgcgatgccttaggcgaccaaggctcacaacctcagcaacaaactctttcatcccttgccttgactcatgtgaaatccgcttcaccgcaaccatcatcttagactttggaagcatgcccatgtacaccttcccaaatcctcccatcccaagcaactggctctctttaaaaccctcggtagcatagaacaaatccttgtatgaaaagcgatgtgtcccgaagggaacatcccaatcctcacgcaactcagcaaacttagcccgctgttttgctacggcaatagccattgcggctgatgctagaacaagcaccagagatacaatgggcagaacaatcactaggacctgtgatcggcgctcgctgatcataagtggcaaagccggcagaatggaaatgttgagaggtggggctgtgccattcatcttgaagctccatccaagcacataatggtgtgagaagattatccctgtcgacgacgagaaaccaacatatgccggttcagtgaccactgctgagagattgacaatggtggagatcagaggtttcttgggcttggttatctcaacgggagccatggtcacgttgagctccatggtcaggccatcgtagtctatccacacttgcatcgccttgcgactaatcaagcttaagttgcggaacaatcccatgtcctcgtcgtcgtagtacccggcggttccggcttcgatgaaggtaaagctgttgatgtcgacaccgacatggttgtcgtcgatgtcctggaactccccgttcagtacggtgtcgagctcgacggcgaagaggtggttgctcgcgttgccattgtctccggcgttgacgaggcccaggaagtgaccaggcagggccgtggataagttcttgctcggggagatgaagaacgccatgccctggctgctcacgtcggcgtactggccaacgatggcgaagacgaacgccgtggagaaggacatcacggcggcgctcctcccgtcacgcgagccgtggaagcgcagaggagtcgggtaggacgcgtgccctttcatcaccatggagccgttggtcagcatgagcaggccgcccggcgcgaccgcggccatgccgtcgagggagaggttcgcggcggagaagccattgaaggtgaaccccgcgccgtcggccaaggcggccacgatggctaggtgactgagtttgagaagcagcagaagtgagcttgcagaattcagacgcatggcttgagattgatgttcagaaatggatgggagatttcagagagttcagattgatggtgaatatattgctcgccgctctacttgtgcagtctcctactcttcagtcttcaccagaccaggcacaggagcgacacatctgcactggcgtattacttctgcagcttccaccaactcgtctagtcttcgtgcccagggatggtgatttggatgattcccttcaagcgacggatagtaacattccttggctagaaggtcatcatttccaatcggttgttgtagatttccaatctgttgctggacacacactagtactatttcgaaatagttacactttgtaaattttgaccaagaattagccagattataagtatatttagtgcataaaaaagttacaccaatagattcatccttcaaagagctttcatgaaacattggttttgtagatattatgaataaattttatgcacagtcagtaatcaaagtcttgtcttaaagacttcattttttaaaaataaaatacgtcctataattttctatggtgggagtacactgtatttttacgcgacgtgagagattgaatttatcggcttcagtaagatcaagaggactatcattgatcagccgcagatattgcaccaattatttcctttagacatatactacgtccatgcagttatggtattccgtgtccaatatttgatcgtccatcttatttgaaaaaattatattttttttaaaaaagccacacataaagtactatttatattttgtcatgtaattacaataaaaatgctaataatattcttttcaaataagacggacggttaaacgttagacacggaaacccacaactgcatttatattgggacataggtatactccatccatcccattatagctgcagctataattccatgtataacgtttgaccgtttgtcttatttaaaaaatttatgaaaatatttgaaaagttaagtcacgtataaagtattattcatattttatcatctaataacaataaaaataccaatcataaaaatatttcaaataaaacggatggttaaagttagacactaaaacccacaattgcatttattatggaacggagggagtacttcagtacttcaatgtcagaagttgggtttttatacttcaatgtcaggagttgggtttttatagtaaagatgatataccaccctgcttgatcagaacatagacgttggagtgacccaacgagctaataggaaagtatatcctgtcaaatttattatgcggaatgagaagtgcagataaaagcctccaagaatcagaattcgcaagaaaccgtttctgccgttgttgttttttgattggaactactgccgttgcacacgaacaagacccttgttactccagttctttgttgaccaggccaggccaggccagatcttacctgggtcgaatgcaattcgagatgttaaggcatataacggcctattggaaggcccacatagccctatgccccgagcaagcaaaggagcaaccgtgtaatattcaggggaataagttcactttgggtctctctatttgtcgcccagtttgattttcgtcccttgatagcaaaaccgggtacaacaggtcccccaacttacgaaaccgtttaaataaggtccatcggcagtatttgaccccgtttttggctgaggtggcgcttacgtggctaatttgactcggtcttcatctgacgtggcattgacgtggaaattcgatccgaaaaatattaaaacatatggggcccacatatcagttcacacacacaataatagaaaaaatggtggggcccacgtggaccccacctatcatcctcactatcccttctctttatcccatctctctccctcttctctcaacggagcgacggggaggaatggccgcgaccggagtggggcggggaaagagcgccggcggcctaattgtgcgggcaaggagcggacgcccccagagtggggcggtgaggagcgggccgggcacccggcggcgaccgcccccccacccgcgaccttcctcgccggcacggggatccatgggtcccccgccgccgcgtcgcagagccagagcacgacggagccagagcacggcggcgcgtcggggagccagagcaccgcggtgtgtcggggagccagagcacggcaacgcatcggggagccagagcacggcgacgcgtcggggacaaaggggcgcgtgatggtgccgtccgggtggaaaaaggggaagctcctcgctccggcgggcggccgctgacgagcttggtgtcagtgaagaagagaggggcgacagcgaggtatattctcctctctcccctccctctttctccagatccgcgcaccgctccgctgctgccggcagtgtcgacgagcgtaaggaggcgacggtggtggaggctggttgcggcgaagggcgtgcgcctctccctctcctgtcggcgccgccgcgtgccgcctctctccatcgcgcctgagagaggaaaggggagagagatgaagaaaggggagagaggaggaagaagggaaggtgtgaggatgacatgtggggcccacgtgggtcccaccattttctttattaatttatgtgtgaaactgacatgtgggtcccacagggtttattatttttctttgatcaaattgccacgtaagcaccacgtcagatgaagaccgagtcaaattagccacgtagggactcgtttgcccggttttcgtaagttgggggatgggtcgtacctggttttgcggttcagggacaaaaatcagacttcacgacaaatacagagacctaaagtgaactatattcaggtcaccgacctgcacagtctctagtctacactctggccactgatggcccatgtctaccgtatggaagaggatcatctgacgttactgttcaccgtgactggcatatagttccccaccactctcgaacccacatatcagtcaccaagtcagtatgaagttacgtcagaggatctcaatccgtatcgctcgccggggaatgcggctccacagccggcaaagacaacctaacatgccgcttggctccatgttctttggagattttgatacgggctagccgaagtgccgagcagtgggaggcatatagggtagagtagttgagtagggagatggttctcgtcgtcgtcgggcgacaagccgggcaggcagggttggtgactcccgtggacaacatcaatggcgccaatgattttccaaaattgttaattgccgcaagtggaaggtcgaggtcgacacactcaaatcaggatttttttcttttgcccgcccagcgacgaagctagtcgaccatagcgtaggctttaattgcttcttttgtcgttgcttcttttgtgcctcatcctcctcttatcttagtgagagttgcctaatccttttcactctcccaacagatttagcatggcacactatgccaggaaactgcaaaagaaaaggagtggtcgtgaccaatcagacagacagttaccagtagccctcaacagtttttttggctggaaatgaaggaaattcagagagtttgtgaccagtcactcagtcagttattacactactacccacaagttccttttgggatggaactgcgacaaattcggagtctatcatcgatggccagtcaggtactatactactctggtcgacagatttctcatggctggaactgcaagtctacaacaaattctgggtgtctgtgactcagccacagaaagcagataaccacggcctgggccaaaaggcagttagcactgtagtacgctgtagctcaagggggtccgatgaaagctgcctgtccggctgtccccaagccgctttggctcccggttggtgaacccaaccacgaggccatcagcccatcactcatcagatcaagagaagccgcccgcccgcccgtccgtccgtcccgatgacacatctaaccacaaaagccttttcgtgtcacctatgcttagctcctcgcctttctgacgcgacggggaactaaagagcttttaaaggcgaggacggcgagatacacacacaggagaagaaagcgagctaagctaagattagctctcgtgtatggtgtgcgtgtgacccccgcgcgtgtgtgcagtgtgcggggccggtgtatgtcgccgtcgatcgatggatgtgccggcggcaaatgatcatccgttcccgtgccgtcgtgtacgttccttttcgagatgagcttggggatgaaggaagggtaaatggaaagggctacggcgaagatcaaggaaacttgattggactttggaggggcgtcaactcagagttaggccggttcctagttcctaccaccccttgaggccttgagaatagtttaacctaggagaatttaaaagtacatgggttgagatgggtacagcttagtttatcaacagggtgggaggaccgtcgttagggagggtctcattaaggtagtgtgtttcttatgatgatttgtttgggcatgtgataaataaataaagaggaaaaaacatggtgttggagaaagtgttttttctttcaattggttagattggttgaaggagaaattacgtcacaccaagctaggaactactaggagaaccttctagaaaagaagtgcgcatagtttttaatcttttgtgaggacaagtgtatatagaaaatattgatacttcagttgccaacttgacttggtccttaagaattttccacttttcagttaagaatttcataaaattcaactcaaatatcaacatccagatcagtaatgtggcatttcacctagcaaactttaaaacttcggagaaagcacgtgtactgttgtgatggtggggtcgtggtctcgtagatgcatgaccatccactaagatttaaatcatgccgcctacgaatattgttcacgtaaaattgtgcttttaaaagatatagtgggttccggtcaacaaaaaaaaagatatagtgggggccaacaatatgtaattggtttttgtttttgtttttgagcgtgtgttattgagcacactcgcataagtgtgagtatggtgtgtgtggtgatgcgcgcgcacgttttcaatgtaatcggggaaaaaaaatgaaaactttgatcattccaatttccgaaggcatggcactatgcggtagcatcgtgttaacggaagatgagctaacccgcaaggtttttcccctaaataaattcctatggccaattttctttgaatcaaagggggccttagtggtgtggatgatgagaat

SEQ ID NO: 27832 - DNA, 2023 bp, Oryza sativa
aaggtcaacaaaattggtactttgtgacatcttgtctcataggctcgtttgctattgcatatgtttaaggtgcccattaattagctagtgtgagatgggtggtggtcctgtcctttgatgatattacatccaccctttgttctgagtctattgctctcatttccactcatttttctctcgtaaaagtctccctgttgtagccattttggagtccttccatcatttttagaatacccacgctgtactctctctctctctctctctctctctctctctctctctctcctcattttcgtttttattgtttttgttcatgtgattcttatatgaaaacgtttgctttacgttcatgccattcgaccgtccctcttgtttataaaatcggccctgaattcgatatcggtaactaaacacggaagaacatcatacaagatcaaaacttgatgatgatatctatgcacgatatttagatcgagttcagtcgaaacctacatcttcatagcactaattatggacgatgattttcaaactagcatattacaatatatccaggtatcacaaccatcgatcggctcagtcgtcggctagtcgtttccacacctatgttactgtcactacgtggatataacatgtatgcttttctatttgcgagaagacttatgacagggtccgactcaacttctatcctatccttattacaattccaagttctaatttgtaattgattgcatattcatactaaacacaaactctatcttatcttttagaaagaataaaagaaatgtttctcatatgaacccactcataatatatactccctccatccaaaatgaatatttcgttggttttgtcaagataagttaattactcttggtcttggcaattaaaaaaaaatagatcttaaacttttggatgaaaagagtactactttaaataatgctaatggtggtatccaagtctgtctcaaacaccataaactggtatatatgtggggctataaggtatccacacgtgaataaccatgtaattgttattcaaccgtatgctttaatttagcccttctgaaaataggcccgtagaataaaaacatatgatctagcagcatatttcagtacggctgcattaaaagatggcattatatgcctaatcaactaactatactataaacttattgtttttgcttttgttgttatcttttataatatatgttgcaacgcacggcctttagcaagtttcctaaatgaatttacgtgtcacccgtattattgatggcatttcatcatgcgttgcacaagtagcagcataagtcggttgcaacctgtactgcagctatcggcctattcgcatttgttgaccaagtgggcatgcaaaatttcgcgttgctttctgggtgttttacagcgcggctccgtgtaccgcgcgaggaaagaaaaggtgggtgtgttccacttggtctgcaagggaggcagccgattggcagccaaaaggcgccacatgcgaccacagctgcacccacacacccaccttgctctttctcgcaagtgctggatcctctacaaccaccaccagaatgtgcagcaaccccagggtcaaacggcaatgtcaaaggctatgtgaactagaactacacgtcctgagatatttgatgacctcatgtgggattaatcttcgactgtttgttcgcggtaattgagagagtaaaggccatttgacgcagcttgtagtagaaaggaatgtataaaaatgttcatgtttttctcacttactctttccctccacgagattacggtagagaaacaacatgtttttaaaagattacgatagagaaacaacacggtttaaaagaaaaaatgaaaaaaaaaacttaaaaagaaaacgtgaccacaggtccacaactcagtcacgtatacgagtcgctgacagacttatcacgtgggggcattttacacgttggcttgggcgcgcccaccgtactgtagtcggcatttggcgagtggataaaccctatggacggccacatggt

SEQ ID NO: 27833 - DNA, 715 bp, Oryza sativa
ccaacgccaccgcaacacctgtcccaccctccccgcctataaatccccggcgccggccgcgtcccccggacaacgccgcatcattgtgtccggctccggctcccgggacacgacacagcgcacgcccagagcgcgctactacttgctttcgagagggttgcgtgcggctttgcatgaggaggaggaggatgggggcactgcacgtcggcgagccgcgggtcagcttccagcagcagcagcagcagcaggtcggcaagaacgggcagcaagggcatggccatggcgccgtggtggaggagatacacgggctcatcaaggtttacagggacgggttcgtggagcgcatcccggcgatccccgacgtgccgtgcacgtggggcacgacggcgtcggtgccgggcgtcgtcatcgcgcgcgacgctgtggtcgaccgtgccacgagggtgtgggcgcggctgtacgcgcctgcggcggcgacggcggcgggaagggtgcccgtggtggtgtacttccacggcggcgggttctgcgtcggctccgcggcgtggagctgctaccacgagttcctcgccaagctggccgcgcgggcggggtgcgccgtgatgtcggtcgactaccgcctcgcgccggagaaccgcctccccgcggcgttcgacgacggggtcacgacggtgcggtggctgcggcagcaggcggcgatctccagcgcggccga

SEQ ID NO: 27834 - DNA, 1123 bp, Oryza sativa
  unsure (1)..(1123): unsure at all n locations
agctgtgccaaacaggcccttagtaacagtatgacatataagcaagcaggtaatttgtaacctgggatttctgcgaagagtcttcctttctgttcgcagccaaacaagaactttctgatacatgcttgacttcccccgctgttgatacaaaagcaacagttacaaataaaacaattatcccaacatcattcggtgtggagaaagcactaacaaagcaatggattagcttatcattatcataacatagttaccatttatagttaaatcacatgagagtggaatattgtcagcacaattcgagcttgaatgagtcaaaaggttggttggtattagcacaagactgggactgggctcttgcaaaaacttgagctgtggtgtcattgttttctgtttgtcatcatttgaacattgcgaagcactcatagtttccatttgcataacttcatgtttactctgtgacattgtcgggtgactccttttgacttcagaaaccttctctgcagcctctttcaaggcattcattgccacatggtaaatttcttctgtaactgacccttcttttgcaaattttatggcttcctgacatagatggttgtaaaggacagttagtgaatctgtagaattacattgaattcctgtgctacatccttcagcctttacttcattaggatcattactcgttgcagcaaaatcaataacttctctagaagaatcatttgatgtaatagggactgctctagaagataacaaagaatggttatgctccttctcaaatttagaaaccatccattttccagagttcatccttttcactacaatcatagctttgcatccaactcttgttatcattctagggcgcttcgttgttttgcctccatctgtaatatcttttctggctcgaacctcacggaagccttccttggaacacacgatctggcgtgaaatgattgaattatcacgtcttgaacggcagtacctgctaatacgtgcacggaaaccattaaccctcgcatagttaatatagaataatttagcagcttcttcagattcaaattccataccctcgannnnnnnnnnnnnnnnnnnnnnnnnnnnnnnnnnnnnnnnnnnnnnnnnnnnnnnn

SEQ ID NO: 27835 - DNA, 1004 bp, Oryza sativa
atcataactcgtgcaacaaaaatcaatactttctctagaagaatcatttaatgtaataggaactgctctagaagatacaaaagaatggttatgctccttctcaattttagaaaccatccattttcagagtttcatccttttcactacattaatagctttgcatccaactcttgttatcattttagggcgcttcgttgttttgcctccatctgtaatatcttttttggctcgaacctcacgaaagccttccttggaacacacgatctggcgtgaaatgattgaattatcacgtcttgaacggcagtacctgctaatacgtgcacggaaaccattaaccctcgcatagttaatatagaataatttagcagcttcttcagattcaaattccataccctcgactggctcatcaatagggtccacctcaatagaatgtggattttccattagatcacaatcatgatgttctccagcatgaggttttcttggtggaaccggtccatgattatggatttttatgaatttggtaacaacccatttgtcaggcccaaactttttaatcattaacatggccttgcaaccaactctagttcctacccttgcttgctgtttctggtccacatggaggttttcacaatcacgagtttcatgaaacccctcttttgagcagacaatacgacgagaaattattgaattatcacgtctagaacgagtgtacctgctgattcgaattctaaaacctgcatgtcttgcatatttgctgtagaaatccctcgcagcatcttcagactcaaattccattccttcataaggcgttaattcagtatcagcttcatgtccaattagcttttgagcttcaggatcatgcatggctgaagtctccatgtcagtaatgactctgggaagttctattgaagaatcccttggctcattgtcttgatttggttcaccaactgaactggttaccacaccttccatgactcctatccacgttacagcacaaatgc

SEQ ID NO: 27836 - DNA, 705 bp, Oryza sativa
  unsure (1)..(705): unsure at all n locations
nnnnnnnnnnnnnnnnnnnnnnnnnnnnnnnnnnnnnnnatcggaccggcgagcgggtgttccaggtttagggtgtacggcgccggcggcgcgccggggcgcgcgccgcttaaccaggagcaggggaggctcaactcggtgcgcacccgaagatgaggtggtgtcttccggtcgttggttttgggcggcgcagcgcattggtcagtcagctcagctgttgaattccggtgcaggagaactgggggccgttgcttttttgctggcaaaccggaggttcgtcgcgcgggatccctggagatacagggaaagggatcccctggcttaacagctgtgcagttgagtcatgtcagtgactcaactgcatgtgcagttaaattagaggatctgctttcgagatacagatatgatattctgcctctgggaaatcaaatgtgtataattaaaatggattgcgctagaaacgaaagagaatgtacaaattacagaggtgatatattcccttttttttttggtgtcctgtacaaaagagttgtaatcacccgtttgcgaaaggagacgggttaactgagtctttacggggtgatcgatgaattgcacaactttgcacgctatttgcacaaagtttggatcgatacacggctgctggtgctgctgcgctacaccttgaaaatggccctctgcataactgcctacatgtgtaatggc

SEQ ID NO: 27837 - DNA, 581 bp, Oryza sativa
aaacataaggtccaatttattgaatagtgcatcatatagaagattagcacttaattgttaataccattgaagttcttgtaatggaaaagtaagcggaaatctaaaaatatgaacaattatccgtttttcaatttgatacattagatcagacagaaaatgtccataatgtggtacactacatgagaaatagtgcattttcttagtactaccacatttctgtaaacattacagctaacttcatgagaaatataaagcagaactggagcattagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactaaccgaatgtgcgctctttctcttttggcaaccatgattggacaatcaataaatgagaattctataaaagctcctaatcaacaccactcccgaatacggtatgctcgatcctaacagaagacacgagagtagccactgct

SEQ ID NO: 27838 - DNA, 410 bp, Oryza sativa
cttttatctttgcacattttaattgttggaggctttctcatgaattttaattattctttgcactatttcgaggatagattttagagtcgttttgggacgcgacaaacctaccccccttaaacggaatctcgaccccgagattcggaagaactggcgaagagatcgggatgggctgccttcagctcgtcttcgcgctcccaagtagcttcttcttcggcgtggttgctccactggaccttgcaaaaacggattactcggttcctggtcctgcgctccatggtgtccaggattttcactggcttctccacataggtaaagtcttcgcgaactttaatttgctctgaatcagcctgctcggatggcactcggagacattttttgagttgcgacacatggtacacatcatgcac

SEQ ID NO: 27839 - DNA, 8746 bp, Oryza sativa
  unsure (1)..(8746): unsure at all n locations
cccttttgtctgaaacctgtgcacacctcgcaatggcgtgacccgaaggtacacaaaatcatccactgcgaattccagatcacggcgtcggttatctgcataacttttctgccgggactgtgccacctttagattatcccgaatgattctgactttagcttcagcttctctcaggatatcagtcccgaacacttggctttctccaacttggtcccacaatagcggtgtccggcatttgcgcccgtacaacgcttcatatggtgccatttgtatgctggcttgatagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaatttagtcgggtaccaagctcttcttggagcttcttccaaaagtgagaggtgaattggcttcccctatcagatacgattttcttgggaacgccatggagactcacgatcctagcgaagtagagctccgctagtttattccctccataggtggtcttcacaggaatgaatcgagctacctttgttagtcgatccacaattacccatatagaatcatatccaccttgggtttttggaaggccggtgatgaaatccatcccaatttcatcccatttccattccggcacttggagaggttggagaagtccggccggtcgctggtgctctgccttgacacgctggcacacatcacatagagccacaaactctgcaatttcccgcttcatgctaacccaccagtaattctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcagccaagaatccgcgaccaactatgcttaggttcagggcttccatctgttgattaagctcgggtggaatgcctcggacgttgagagtgttgcagtggctctttcgacttagagcgtcggcaaccacgttggccttaccaggatgatagtgtattcccacatcataatccttgatgagttctaaccatctcctttgccgaaggttcagatctgactgagtgaagatgtatttcaaactcttatgatcagtatatatttcacagcggttcccaatgagatagtgccgccagatttttagagcatgaaccaccgctgctaacttcaagtcgtgcgtagggtagttgccttcatgaggtcgtagctgacgtgaagcataggctaccacatgaccgtcctgcatgagcacgcaccccaatccttggcgcgaagcatcacaatacaccatgaagtccttgcgagtatccggcaagattaacactggcgaggaaaccagcttttccttgagggtttggaacgccttctcgcattgcgggctccacacaaacttctcttctttcttcaacaactgtgtcatgggtcgagcgattttggagaagttctcgatgaacctccggtagtatcctgccaaacccaagaaactgcgaatctgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgtttccgcaactttcccaacaccagacggagatggtgctgatggtcttcctctgattgtgagtatatcagaatgtcatcgatgaaaaccacaacgaacttatccaagtattccatgaacactttgttcattaagttcatgaagaaggcaggagcattggtcaagccgaacgacatcaccgtgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcgacgcacatcctcttcgtcttgtctttcttctctacaaaaatcacaggagcaccccaaggggaagtactcggacgtatataccccttttctttcaattcttccaactgtttcttaacttcggccagttcatttgctgccatacggtagggtcgcttgtacagaggagtggttcctggagcaagatctatccggaactcaatctctcgcttgggcggcataccaggtagttcttcccgaaacacgtctccgaactctctgacgatggggatttctgacagacctatctgatgcagttctgaacttctgacagaggttggaggtgcaaagaaaacaaccggttgttctggtcctcggtacagagtaacagtgcgtctcgcgcaatccactactccttggaattgtgccagccaattcatcccaaggatcacatccaagttctttgtgtctagaagaatcagatccgagggaaaaggaatcccctgaatttctatagggacggcagggctataatactttgctgtcataacccctccaggggtggtgataagcagagggtttctaagcctttctacccccaactgatttctccccacgaatggcacagatataaacgagtgggaagctctagagtcgaacaaaattgtagcagggatggaatgaacgaggaacgtaccaacgatgacgtctggagttgtcagcacgtcctcggccgtcacgtgattcacacgaccccgaatgacatccttcccgccgttgttggagcggggaggcgcttggccttgctgacgccttggctttgggcatttatccgcaaagtgtccgggctcgaagcagttgaagcacagccgctgcggacctgaagcgtccctgcggccttgaacgggctgcccagctggcgtaggaggacggggcgcacgagtcccttgctgattctgctgttgctgcggctgtgggacgcgcaccacgaattgaggtcggggcgctgggcgaggttgctgctgctgttgttgctgctgcgaggaggatccccctgggtagggattggtgtagcggaccctctggttagcaccctgctgattgcggaaattcgccaagcggcgcttgtgcgattccagctccttgtgcttggcttccaagcggatgctcttgtccaccagtcgttgaaaatcaggatagtccccagagactagacgaacggacagctcagggtccattcctgccaagaacttctcttgcttctcctcatcttcccgcacatcctccggagcgtaccgggccagattgttgaactcgtgcaaatactccatcacggagcggttgccttgcttcaactctcggaattcccttttcttaagagccacgactccggcgggcacatgggttctccggaaagcggcggtgaagtgggcccaagtgatcggctgtcccgctggctgcgtagcctggaagtggtcccaccatagggatgcgggcccctgcagctgatgggcggcgaagatgactttctcttcatcactgcactgcacagtgtccagcttcttccccacggcatgcaaccaatccaacgcatccacagggttgttggagctagaaaaggtgggtgggcggatgcggaggaattcggcgagtttggagtgttggggagggggtggtggagcattctgttgtggtggattttggaggtggtggaggaaagcagtcatcatgttggcttgttgggcgaggatctgggtgagaatggcgttggtgtctggtggtggtggtggaggtggattgccttggtggttggggttgctgccttcgggttggttgccttcaccggtgttaacatttctcctggtcgtcaccatctgaaaaccccacacagcaccagcaaacagagaaggaacttacaattaaaactaaccacccacgactaccattattcttaaatttatcactgctattaaattggttcattaaagttcaagttgcttaggcaaataaaataagacaggctccgacatagttacaccacacaccggcgtaaccatgccccacacgactcaaaaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaaacaagtccacgccagggactgacgaacaagctcgggcctggaggtgctcttgcgggcggtgatcttctggctgcggcagacgcggcgacgcttgggaccgctgtcctctccctgggcgatcttgagctgatgcagctgcgcctccaacgcgtcgaggtccttcttgagctgcagattctcctgacgcagctccaggatcttcaggttgttctccaccatgccacgacgcaccatctgatggaagtcgatacgagccgcgtcgtacgcctccaccatgcgtgccagatgcacgacggtagcgtcatcctccgagctggcgtctcggaaggtggcgtagtcgcgggctcctccgcgacgagggtggtagcggtagggcgagtgctgcaactcgtccgggtagcgctggtgaagagtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgcctcgcagctccaagacgaagccagtcatgtccacaccacgacgggtgacgctgccggccatctacaaacaaaaacaaaaaggaaaacaacatttaaaagatcagattttgacgataaatgaagcagcaagacaaagagagaatagcgggttttcacaaataataaaggatttttatttttttgaaaatatagctaaggcttgggatctacggctcgtcctagggtcaagggaggctctgataccaacttgtcacgaccggaaatcacccaacaggcgttcccgacgtgcgtgtattattccttgtcccaggaggcaaggtacaccaaaagttgatacaatacagagtttaacaagcggaagcgtatataaaattattacacgggcaacgaaggcccagcacactcaaagacaacgaaagacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcaaagctactttgtaaacacgatcctagaactatccaatattattaatcaaggccgtgaacccacacgaacctgccttaacccaaggcctatgatgattcagaccgaactggcaacccgaccctgggtcccagctcgtcctaagccaacccaggccaaccattccacattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcaccccgagcccagcctaaaaccattttaggggattttgaatagagggggcggtgtgaagccaattccacagtaagccaacaattccagagtgtccaggtgatatgaatatttcccaagtctaaagttataaaaccacctaaggttacctaattaaagcgaagcatctacctaaaattatactagggataccatgagtagagtgtccactagttgagggttttgtttgtctagggtgaacaaggtagtaataacaacaataacaataataatatggtcataacaaaggtaaataggcatggctaaataaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcggggcgcgctgtcgcgaccgggaaaattgccttttcccgaacgctagtgtattaatccccgtcccaggaaaagccggggtacaccacacaaacatgatataaaagacacatctttattatatcgacaatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcggatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgcaaacacgtgccacataccaccacggtatacggacggaagacgtgacatagttcccaacccatcctagccataaacaagagtaccgacccaatcccacctacggccgggatacccgggacaggcaggcagaactgagcccctagcagcagggcaccaaccctctgccatatgacatctcgactaccgggccgcagctcgtgtagccttcatttgtcctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaagttgtaaaaccacctaatgttgtcctattaatcagcgaagcatctacctaaattcatactagtggaaccataaatagagtgtccactagttggggttttgtttattctagggtgaacaaggtaataataacaatagcaataataatgtcataacaaaggtaaataggcatggctaaataaaacagtgataacgcgggaatttaaataaagcgatnnnnnnnnnnnnnnnnnnnnnnnnnnnnnnnnnnnnnnnnnnnnnnnnnnnnnnn

SEQ ID NO: 27840 - DNA, 671 bp, Oryza sativa
  unsure (1)..(671): unsure at all n locations
cagtcacgttaataagcaacgcaaccataccagcgctagttccgatttacgacccggttctgccattgatgcttgcagcatccaaatgccggtgcaaaaccccgaagaaattaaaagagatgatgaacacgtccgagccagtcgagagggagatcagcaacgcgatagtgtacaagatgacaggacaggagtgnanaggtgtggggcgtattggcggaagtccgggtgcgcttttaaaggggcagcgagttaaccatggttaggtgctctaaccatgagtaggtgttccaacctgagttacgaggcccaaataccgacgtcgtcgatcaggattgagaaatgggaaaatatacggtgaaaactatgtatacggtgaaaacttaaaacctaccattaaatcgaaaaataaacgtctaagattcatctacgttatcacgggtaaaaattttactcgtaagtttacttatgagtaaaaattttattgagacttatattgacatggacgattctcgtacatttaattttcaatttaatggtaatttttgagtttctaatatatatgatttgcaccgtatatttgtcggactttctgtcccacgggaggttgtggttaacgtcggaggctcggagcgagaggaatcaccaccaaaggggatcctctagagtcgacc

SEQ ID NO: 27841 - DNA, 388 bp, Oryza sativa
  unsure (1)..(388): unsure at all n locations
nnnnnnnnnnnnnnnnnnnnnnnnnnnnnnnnnnnnnnctgtattctccaagattgatcttcgttccggatatcaccaattacgtattcgtgaagaagatattccgaagaccgcattcaccacgcgatacgggctgtatgaattcacggtgatgtcgttcggcttgaccaatgctcctgccttcttcatgaacttaatgaacaaagtgttcatggaatacttggataagttcgttgtggttttcatcgatgacattctgatatactcacaatcagaggaagaccatcagcaccatctccgtctggtgttgggaaagttgcggaaacatcaattgtatgccaagcttagcaagtgtgagttctggttgtccgaagtcaaattctgggta

SEQ ID NO: 27842 - DNA, 556 bp, Oryza sativa
acccctgcagtaggagagacacaggcaaaacagagtgatcagtcagctgcaaatcagcaagcagagcctgcagaaacagagctttgacatgcacaagtagagtaggcggtgaactcacttgccccaccaaagctcctgcgcggaggcctcatccttgacgatgcgcttgtccctcggcgaccggccggtcttggcgccggacagcgtcgccagcgcgccggtggacgtgatgaacgaccccttctcgtacttgatcgcctgctcgtacagctctgctcgcccacatcccaccagaaaacacgtcacttacacatgtcacgagttataatccctgaacaaaaattacagccgttctggcgtcgcgtcgcgtaccagcaggcgagaggttgtagagcacatgggtgaacttgagggagctgtcgctgacggcgatggtcggggtgacgtgcgggtggtggtggtgcaccggctgcgggtgcggcgacggcgcgcccttcgccgcggcctcgcccttcctagccggatctcccctgacgaccttcgggccggtctcacg

SEQ ID NO: 27843 - DNA, 575 bp, Oryza sativa
  unsure (1)..(575): unsure at all n locations
nnnnnnnnnnnnnnnnnnnnnnnnnnnnnnnnnnnncaatcataacaaagtgcaaccacaaggtggaatgggacaccctagctaagtaactagtcggttcagggaaacctcgcatgccaatagttggggaacgccggggcggggtcggttggagccaacccgggttcctggtaaggcaagaacgcgaagcttgccagattaccgatcgaggtggttggagtttgatttgtgaaaactgatctggcctatatttatgtgaaggatttgatccttctatgtggcatgaggtaaccctgggtcggcttgggaaaggctttgttgcgaacctccgataccgacaggtgttcggaataagttcgtatcttgtgggtaaagtgtacccctctgcagaggttaactaactgttcgaacagccatgcccacggtcatgggcggttgtgaggtggttcccgttgcgtagatttgtttgcttgtgctttgtgaaaagttgttgtgtgggaatcgtaaccagaatcagcctatgtggcagatggatgannnnnnnnnnnnnnnnnnnnnnnnnnnnnnnnnnnnnn

SEQ ID NO: 27844 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnnntttgttttttagataaatatcatacttctatttgactgttactgatattcaccaggatagcatgaaattaaaatttgaaaaaaaaaacactcaccataatcttcaatgaactttaaggccttctccaggaaagctggactaccatcagcatctacaagggcaaactctgcaggtctgccaatgatagatttattgtccgctgcaatggaaacgataggatttgcctgttcaagtagaatgtagggtcccaaccccctagctgaatctagtactttagatcgtgggcaactgatgaaagttatcttaacttacactgttcagctggagcttcagcaggctctgctatgtcagtgctgaaaattggattttggccaacagtatttgctacaacaggtgcctgtgccagagcattctctagtgcacttctccattcattgagttcttctgtagtttctgcctgctcaatgaaaatcattccattacagtacgataggcaggtgtgtcaaacatgaatggaacaacttcttgtaattgcatgatctaatctcaaccaaacagttggtctgccggagatgatcattccctctctcttccctcggctttattgctgcaataatcgcttgcacccaatggtagcagtacatactgcagatgaa

SEQ ID NO: 27845 - DNA, 1177 bp, Oryza sativa
  unsure (1)..(1177): unsure at all n locations
cgcaagctagagagggcgagtgagaacgagtaaggagaatgaagggagtcacttccgagtcgggtcggcacggtcacgagtggccgacggtgcgggagtgagttctccgttctcagcccgggacagggaaacaaggggggtgctcggagtcccgtgtcacacgtcctcgcacgcaccggcctccccagtgcttgtcgacgcccgacggcggcgagatcgtagcgagcaccaacaatagcgcggcggtgatggaagtgaaacgagaagaggattcgatgggacgggctcgggttttataggtggccgggtaaggagcttcgaggggaagaacccgactcggaagagccggtcaaggagaggagctggcggtcacgcccgtggtccagcggccggcaggcggtcacgggcggtgtcgggcaaaatggaaaaaggagggggaaaagggagctctgttcttgccgaaacggggaatgggagagggagaggagagcgcgtgaggcagagagacgcgctgcctccacgtcttggacgcacgcgcgcacagggtgggggcgagcggcaggccggcatgggcggctgcgcggcgcaggcggccagggctgacgcggcgacgaccgggcggtctgccacgcgcgggcgagagcgtgcgcgacgcgagggcgcggcggaattcagaggcggcggcgggaatcggcgccgggaggggagtgagcagagagagagagcgaagatgggagagagaaagaacgagagagcgagagagctctctctcggttcggctcggcgcgtgcaacgcacgtgcgaggctgagggaggagaaacggctgagagagggaggtgggctaatgtcacgcccagaaattcccggatggaatcccaagcagaatgtgcattaaaatccccgtccaggaccatccggggtacacaatcgacaatgttgacatacagatccacgtcttacatacattataaagtctcacagaaatgcagcggaaaaacaaaagaaactggagctaagccttgacttgaacggcagcgggaacaccactccacaggcatcctcgacggcacggacgaagcctactcctcggagaacaagccatcggacacatactcgagctctgaggttgnnnnnnnnnnnnnnnnnnnnnnnnnnnnnnnnnnnnnnnnnnnnnnn

SEQ ID NO: 27846 - DNA, 13162 bp, Oryza sativa
agcaactaaatgtctttaaatgctgtttactgcaaccctaaccctttatattataattcccttgtactcccttgcatttattctgcatttgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcgggaacgcctgttgggtgatttccggtcgtgacaattgattgggcttacatgaggaagaagaacaatgaagtgttcaaccaagtgatgcaagtgtgccacaacaagaatcttggagatattcttgccttggagtatgattggaatgaggaggtcattgcacagttctatgcgacagcattctttggtactacaaggaagggaaccccttatgtgaagtggttgactgagggtgttaggcacaagatttccatggcacagtttgctaagatgttggggttagatgatgaggatctcattaggcccaacattcatagtgaagcacccctccccatgatcaagaccaagttcatgtatgcaaaggatgctcctaggacttgcatgggatctactcatggattgcatcccaactacaaggtgttgtactccatctttcgttggtctttccttccaaaggttggagatgctactgctttgccatccaagcatgctcatcttctcagttgcatgcgctacaatcagcctcccttcagtgtgatgaaattgatttggtatgagatcgccaacaccattcttgagcctaagcggggttgcatctatgctcctttcattataaagatgattgagacagtcaccggggtattctacatcaaagatgggcaccataattcttttcgccctcgtgctccacctttctcttctccagtggtccctcgatctgttccttctacttcagctggtccttctactagtgccccaccaagttcctcgagttcttctcccatcaagaaggcacttcaggcaatttttctgtatgtgtgctaagactgccaagaaagtgaaaaagatagaaaggcgtcagaaggaagatagaagagaggctgggaaagaagtgttagatgattctgaggatgaggtctatgttgatccatttgaagcttatgaggcagccagcaacgttgccgttgaaggtccatccaccttcttcaatgaagaatcttcccattctgttgatgatgatgatgatgatgatgatggtgatgagggtgacaccgaggcagctgctgaggatgctcccactgatgttgatgagggtgacaccgctgctcagtccgatgagtctcatctctccggcgatacagagattgttccctctgatggagatgagtgatcatcttcttctcttcatagtttctcgcctttttggtgccttgatgccaaagggggagaaattgtgaattgaagggggtcatttaaatccttatcctttttgctgccttgactgttgtctggtcatttgaccggaagttccgggtcctatgatctggaggttccggccaggcagatttcctctctattatctctctctatatggacatgtaatcgtattctattttggttggatgtaatgtctgttagatgctttattatcctttatgtcagtaagttagaccatatggatgttgcattttgatgtgatgttgtgttcttttcatcttttttgagtgattgccatgtcatctagtctttctttttgcatcactcatcattcaagcactttcatctacatctcttatttgatgagggcagtgtgaagtttcttttgagctttccttcatcttatgcataatgttttcatttcaagttctttatatgcatatctttagggggagcttcacacttctctcatcattcaaaatttaaattctattatctttttgtgtgctttaaccatgttgtcatcaatcaccaaaaagggggagattgaagatgcacttaaaccccctagtgggttttggtgattaatgacaaggtggttaaagaggactaacatgtttatcaagtttattcataggagtttagtcccaaagcgagttgtgatggctaagaatgcaaggagaccccccaatttgaatgttcctaagtgcaaaaaacaccgaaggtgattagactaggtttttcactttcgaaattgagtttagaaaaaaaaccgtactattaagaggggtttcaagtgtggttctagggtatacaaagtgagtcaaaatatttttggaatcatttttgaaaaatgattttctcctcgggacagagagggctacccggaggttctggccggaacttccgggtgccgtttatttgcaaaaagtttcctaagtactgcccggaagttcctggcacttttgcccggaacctcctggcaggtttccagttcaaacttgtgagtaacggctagatgacgtcacctagtcgttatatatatggatttcgtccctaggtcaccctttggccattccacttctgttcattcttgttctagggttttctagccactcccaagcttcctttacttcctccactcaaatctagagcctatcttgtgagattgagagattagatgagagagtaggagtgttttggggatggcttgaagattaggtttgattgagcactttggataccttgtgggttgtcacttgggcttattactcttggagatcttctcctagacggttaggtgtcgcccgtgagcttctaaagatcttgtggatgtcccgggaaagtttgtgaaggttttcctcacctccgcaaggaaacaaggtaagtgagtaaagattcttgtgctgagttttcagaggttgtcctaggtagagcaacttgcacttgtggtcttttgtagaagaaattttgagttggatcttggtggtcactcaattctagaaaatgacctagaagtgttgagttgaaggctgtggacctcttctgggatctttgcataagtgaggcaaggggttaattgagacccggctctttggagcacctcaacggagagtaggattcatgtgatccgaacttcgggaaaaaatcgtctttgtctctcttgtgcatgatctttgtgtgaatctgctgatattctgcaatcttcatcttgttcctctgtgtgcctaaacttctcttgctaggacctgtttttcatctctgttttaatttatctctgctgcccggaaattcctggctcaagaactccggaagttccgggctactcatcctgcccggaagttccggtgttcatcaccaggaggttccgggccctgtcaatttaaccgctgcgattgttgagaaaatttcaggaaaacctattcacccccccccccccgccctttttaggctacatctctgatcgttcagacttaaacccgggtgcttgcatttacgtccaattattttttcagtggtaagcagccgatagtgaggcgtttgtgaactctatcaatttgaagatatgcacctgtgtttttgttgtgtttctgaaagaaaaatcactgaagcaagtcgtatatgtcaatcccaaagtcagtactaaaatttagttgcttctgtacaactggaagatatgatgaacccatgaaagacgttgaaggcagcaggtaattgttgcgatagcgctttttggtttaactattctctacatacatccaatggcgcaaaccaggtaagtcaatgtttcgtggtgaaaaacacgattacctgagaaacttacagatcatgtttacctagagctatggatgtttgtagaatcaacgatttatgtaaacaccaccaccaacctctttttctcacatgatgatgcgtctcagactgagcaacatctggtaatgttacaacttaaaatatacatcatccccaatccccatcttccaaagcaggagtgaaatagcttatgtaacgtccatcatatgtgcattgctcacatttgagaccaaacagtgcaaagttccgtagcctgataatgatgccatgttaaaattctcacttctcatgtggagtttctcttcggagctggagctggaggccctggcgggcgagccaaatctaagttctgcatctcacttgcaagaatcgcccttctttctttcaagaaattgagtcgatttgtcagcttggctaatgcagatggtgccccggaatcctgaaatataatagcaaagcacatacttttagcataaacttcaatccacccaagtggcactaacaaccacatttctatagaaggacgcgaaaaaggaggttcatgttggccaaagaaacataccatctggccgactagctagaactgatatcagttaaggagtcagtgagatttacctctgttctagatccaagcctgcctaatagtggattatttgagtattgtttctgtgcaaggttccactttgatgccaatggatcttggccatccttgacaatctcacccttagaaatcaacattctttgagcctgaaatgtgatatgaaaataacttaagctgtgttcaggagtattagttggcaacttcttcccctcgcacgcaaaacgaagcgactcattaacgtatgtttaattaagtattagctaaataaacttgaaaaaatatcgatatgatttttttaaagcaactttctaatgtagaacattttataaaaaaaaatacaccatctagcagtttgggaagcgtgtgcacagaaaacgatggagtagaagttgggaagaggatgtatagaacacacccttaatgatagaattgagaccattaataacttaaaacacacccagaactgattgcatgctcattgttaacttcgttgagctggatctttgctacgtaatctccgtttattcccttggttgtctacagaaaatgaaatatgagagattgtgatgtaacaaagatatttagtttttttcctgcacatttgctactgggcacctcagacactttaagtctttatgcatattcaggcagaccatacttatggtgccattctggttacccagtttcaaaaacctttggtattatttccatttccaaatgtggggattatcatagagcactcagagacatgcacatgcaatagtatccaagactaaaaagtgtttggctctcatagtcttaccatgtgtgtagccgataccatgtcagatatagaattgggcccaacatttgatgatgtggtactctgttcacctctggagaaagatagtccacaagtaccctttcacattactcaacgttctaattgaacaacaaaaaagaaaacgacatacagtgctaaaatatcacagaatgctctggacagaaatccttactcggttagcttgtctgtatttagcagtcgtttgttgcatgagtcacataatgaggcggagctcatctggacctggttgttgagttgtccacggagatcagaacccttttgtttcaagttcaaaatatcagcttcagcagtagcaacttcctcaagatcagccttagtcttttattagcagaacaatttttttttcaaatggtgaaaaaacacttgcactttaactcaataataaaattttaaaaagaaaaccttgttgtcaattgttgatgggaaggacgcctgccctcttcgcaaattcatcagccctgactccaatgagaccctcaaatttctctccttctgtagctgatctcgcaaattttccacctgttgagtgcagaaacagcaaaaacattttcttgtttaacagtgaacagagaatgcatgtttcaggcagatattgaagatgtataaaatttctggtgtgcttgacatagatttaaggatttcttatggatgtagagactaaatcataaaatctacctgggcgttctctttctagaaaaaaatataatacttttcccatagtttgagctcttacttctttttcgagtgctaatcggcgtttatgcaattctactttccttctttcgagacttgcttgtaggattgaattttctttcgcctgaaatagacagcacatcacctcatgtgtaagtatttaatgctacagaatctctcattgattccagggaaaagtctgtacctccttagtaattttagattggagatctgtcttgctgttctcaagcttctcaataagagtcctagttgaaaatttcgaattaaaagaaatatctcaaaatttaacaacagtgtaaaagctgtttgatatcttctcttaaagtttccaactgttcttgatttgatatttttaaatatgttaaccaaagataagagacaaactctaaacagtacaatacagaagcaactggaaaattcaccaatcatgcaatggaagaaccaaaaaattccaggaatgattatggaagtgtgcttttattttaacttcacaagcacttctatccactactaatcctaatgggagtggaagggaagttcaagaaaatgttggggcaggagaaaatgggaaaaaccttctatagcttttgataccatattagcataacagaagatatatatatttaattgttgcaatgaagacaagcgggatgacaagtaaaagctaaaagagtaagcaatatcacttatttgcattattaccctaacaaaactcaatttcccattgttggtccaccatcaaaggagtagttagttattgagacaaaaaggagagcaaagagataaggtagaatcacaaagggaaaaataattcagtgcttctaaaggatatgtctggaactcttccaacagcacaatacaataatatatagctggatacttactcgtcatcactgcaatagtcaatctcctctgctgacaggtcttttcttgcctgtaaagaatgtatttacccaaaattatgagattgccctagtctcactaatgtgtaagagtatgcaaataacaattgcacgcactgaagtacggccccataaggtctttttgctcttatttcttgagctgcttgatttctccataaattttgctcttgctgatgatgagcgaacatttaacttttctatttggtctgtggatccatttgattcgtataattcttgttttcgattggatggatcattgctttcaatttggcaggtgtcttcccttaccgcaccatgtcctgttcttgctgctttcttaggaggttgtaaaccctgatcgttgccattagatgctgtgccagagttattgcttttaacctacagagtgtggatcaaggcattgtaagggtggcgtagaaattgcatttgcattaagtcagagacacaaagatgtaattctgggtaatcagtatacttaaccacgtcagttacttattcaaggtttctacaaagttgtggagatgtagtcgatggtcgtgttcattttcacatctcacatcattgagctactgtgaacagatcgttcttttcatgtcagaacaaagttacaagcatccctatgaaagatttgcacttcaattctaagttagcttgaaatactgattcaactttgggcatatagcttgaaatactgattcaactttgggcatactttttcagaggtaacctaagaattgctcatatcggtgatctaaaagcataaaaaactgtagcagacagtggggtagcagctactgcagttctttgtacaattgcagcagcataacagtctcgtgctggctttcagtatattctagtttgcatacatttcaggttcaccattagcatggtcaaacatttaagcctattattggtttaaaattataaactaacatgttctactatcaatgttatattacgttatcaaaagtggaaaaatgatcaaactcgtaaaaacttctatttaggagtggagatagtatataagaagttaatccaagtatgctaaccatttagaaggacaattacaacacaaattcagcagttaaccactgaaatcaacaaaaaaacgcatcggcggatcataaaaggcaacacaagggaagctccctcgttactggacctttagacacaacacatctgtaatgcttgaaatcaaaacgatgactagttttttgccagaatgaccgaaggaggtcattcaatgtaattaagattggaaaaacgatgactagttgaagtaccttgtcatcagagacactggtcttaatgttgttgtcacattcactgccaccagatgagtgctcagtatcatcatccatgtcttcttcaatgttatcttcaccagaatcataagagtcatcctcttcagggccatcgttgtctgtggaatattccttgtcaaaatcaccgtcttcggactcagtatatgcatctgaagagtaggaaccgtcttccaagtcctatacaggtaactgctaaattagaatccatcaagagtcaatgcagtataacttcaaatggaacttgactgtgtagaaaggaacatgtaaaggaaaaagaggatacatcaaatatctgatcgtattcttcgagcataatgatgacgattgcttgagcatggttggcagcagctgcagcttgaagcagctggaatgaaccatccccagccatactaaagtcgctatcaatttcacattcaccgagaagaagaggtcggagaaggagtggtgccatgcaagccgccaaagcagattgagacatcctattcacagctttgtgtgattcaacaatctgcatcatcttaagagtcctaaaagaaaactagtgagttttggaatccataggtggaacatgaagctactccatccgtttcacattataagtcgtttgttttttttcttagtcaaagttttttaggtttgactaagtttatagaaaaaactagcaacatctacaacactaaattagtttcattaaatttaacattaaatatattttaataatatgtttcttttatattgaaaataatactacatttttctacaaacttggtcaaacttaatgaagtttgactaagaaaaaaaatcaaacgacttataatatgaaacggagggagtattattgtactacagtctaatctaaagctaactcatacattcataataaaatgattgagaactacaaaaaatgagaactggttcttcacaaatgaaaacctcagacatacacaaagtgtgtaatttcaaaaaaaaaaaaaaaacatccaaggtagatacctctgcaaaagttgtcggtttggttctgggaaaacttcataaattactctattcatagcatcaagccttcttgtcttgtcagttcctgtacaatcacacgtctatatcagtttgtaatcctaggaacatcagcatgttttcaggttaagggcatgcgctgagctgactttagaagatttacttatgcatcagttaaatgcaagactacattgattgattgttgaagtaatatataaagtaatgtggatggtgtttttagccggagttgtggcttagagtgcctgtttttgctgtaaagtaatgtgcatcgttgtaacaatagcggttgtacagctcttagcctccatggcagctgtatctgttgtactagtttgaacctcttctcaatcttaataaacttcggccgcgtatcttacgccggcccggcgaaaaaagaagtaatatataaagaaaaattgaagtcaatcttacggtaagctccaaccagtgcagtgcaacatggtgcaggaactggagatgaaggcatctctcgaagaacatactgtagcaaagaagaactgaagatatgttactgaagaatgtggtaactctatgttgtcactatgtagtcaacgtttggcaaaaaaagattaccttgatgcagtcaccaataacatgtgcatcctcttctggggagaactcatttttccctataagatcacattagtgatttaaatggtattatttatcatgtgaacaggacataggaaattcaaggatctgttatctatgcttaacggcttacaagtgacataaatatcctcaggagtcatgaataaacattttattatttgattagagtacagctcttgttagagagagagagagagagagagggagagagagagagaatcacccttttcatagtcccgaactcttcgtttgacttcttcaacatcagcagactgacgtaggattccttccaccttgacacctacaaacagagtatgtttctgctcgtcactaaactacagattaataaatatacatacaatgagttattgttttttagataaatatcatacttctatttgactgttactgatattcaccaggatagcatgaaattaaaatttgaaaaaaaaaacactcaccataatcttcaatgaactttaaggccttctccaggaaagctggactaccatcagcatctacaagggcaaactctgcaggtctgccaatgatagatttattgtccgctgcaatggaaacgataggatttgcctgttcaagtagaatgtagggtcccaaccccctagctgaatctagtactttagatcgtgggcaactgatgaaagttatcttaacttacactgttcagctggagcttcagcaggctctgctatgtcagtgctgaaaattggattttggccaacagtatttgctacaacaggtgcctgtgccagagcattctctagtgcacttctccattcattgagttcttctgtagtttctgcctgctcaatgaaaatcattccattacagtacgataggcaggtgtgtcaaacatgaatggaacaactccttgtaattgcatgatctaatctcaaccaaacagttggtctgccggagatgatcatcccctctctcttccctcgtctttattgctgcattaatcgctgccacccaatggtagcagtacatactgcagatgaacgccaacagtatattaaaaatgaaacaggtgtgcgaccaaccttgagagtgaaagttcgcccatcgcggccatcaggaaataacactgttaaaagtttcttgtcttctttgaccacaacactgaaatcatagctcaagaatatgtttatcagattacaggaactatagcctttaaacaaacattaatttctcaatgcataccttccggagttattcaagtcaattccacctagtgtaacaatcggttcatttcctctgggaggtgcattctgaaattaaagcagaaatttgggatgagttatcatggttataaataccttaatctttttcattttgaatattatcaaatcaagtaaccaaccctcatgatatttcaataacaatctgaaacgtacattattatgaacgaaaaataatatgcttaagtagttcttttaatcatgtgattcaagtctatccgcttcgacatggctacactgacagccagtagtagcctcagtgtttgttttttcactttcatatacaactaatagtatgtgaaaaaaataagcattccgcttcacattcaggtccgcgtatttcttttttctttttccataaactgtgtaggcataggtgcttaaattatgaccaagccagaatgctattgctggggtgtatgaatgctgatcaggtacggatattttctaaaaaaaaatcctcattcaaaggttcgggtttcctatttctgaatattctacaattataattcgatttctatatttagtgctcaaagaccaaaatgattactgtgtttgtcaggtgttaaaataattttatgatgaccagaaatagcgtatatctatatcaagaggccccaaatacagaacctatcaagaccttgtcagattctacctccagtgataataatgcaatgagtaaatatgtaaaacaacaaaaagactaagagaaagacaggtcaaagccatagagaagacttttttatcccagcagtcagctagcagtttagcattgctaaaactttattaatttacaatgtaaaagtatgaaaccatagagcattctttgttacaattaaaattatcttagcttgaatagcaaaataagtcatccgcatcagctttgtgagtgaacaactgatgcaaaggaacataacaaagtagatatgctataatacagtattacgtcaaaaaaggaaaagcacacaaagaactactgttataatacagtattacgccaaaaaaggcacagcacacaaagaatcactgtgatatatcttacaggatcacttctgaagaacaccaatgatgcccttgtaagaataaaccagcgctttttccatgttgtccaaccaattcctgttacttatcacttttagttgaatatgaagaatactgtagattcaagtattacaaacttttaagaacttttttgtttttttaaaaaagaatcattaggtaaccaagcttctaaatttgccacatgcaaaagatggaactaatcattctcatacacctatgcaaactacaagcagaagttcacaacaaaataagtccaaaatacttttgttggcttgactctgttctatgtggggcttagtatggttaagtgattcttaagcaaatagaaatttggcatttcaaggtattgattgtgttatactatgctgaaacttttcaaggatctgatttttagagaggcgttccctataagttctgcgggtaaataataaacacatggtatattgatgtactttttgtgctcgatacaacatacaaggcagactaaaatgagtcatggttatcaattttataatatacaattcaccatattaataacttaatttattaacttattatggatcagttttgtaatttattatgctacctaaacatccatgacaaatggcaaaactgtcattattcatcaagacattgtcataattgtgtgacttcaggataacatgtattattggttcttgtgtacttgaagtgcatggggacgttatatttgttctatttagcccacttcatggacaatattcatatccatagatatattactgcaatatttctaccacaaacatatgttttcgatgtaaggatgtactccctccgtcccacaatataagggattttgagtttttgcttgcaacgtttga

SEQ ID NO: 27847 - DNA, 6194 bp, Oryza sativa
aaatcccttatattatgggacggagggagtatctattaatgctaaaaacagaatccatgcaaccgttacagatattactgcaaatcgtacctttagatgagagcagtaaatgtccactcttaagaacctgcatcagaagagtacctaaaattggtcatggaaacttgtgcatgcgactatgaagcataaaagcaatcatgtctacttctttttccactgaacatagctctgaactaattatgcggttttacgataagaattcaacaaacccccctttcatatgctccccaaagcacaaatgatacatatcaatatcaaaagtgaagtttcaagtatgaataagctgcaaatatgcatagaaatggaagcttatgtatctatagacaatccggtaatttagctacaaaccagtgatgtgtcaagtcgtgtatcacttgctcaagtagcttacaataagtcgttcaccaggttatttagataaatacatatcacaagttttaagtgcaagaaatctcacaaacctggcaattaggacaactagttggtgatttatcaccagtttcagatgtgtttgtatttgggtctccttccccacatcggcagatcttgaactggcctgcattctcagtagtctgtgaagatgatacctatcaaaagtatggaacaaaatggagtgaatactcactaatgccacagtaaagtgatgtaattgaccttgtgaaacttgagtttagcaaaaataaaaaacttttacatgataggtattgtgtgcccatagtgtttaatatagtgtcataaggaggtcttgagacaaaatgctaatattttgccagagagaggtgctatagagcaatggtatattcataactttgattaccgagactgctgaaaaaaattgaaatgttcattttgttccttcaatgagattcactctttatgcctgaagaagtaactggcctactgctaaaatattgtcttgaaataacatcataactgtaatgaaacatataacagaaattcactctatcaacaaaatgaaaccttcaccttacttttttactttgaatgaattgcactagtccaatatttcaatatatactcaaaatcaactgaacttttacttaagtggttaaatggtgaactatatactggaatgactgtaaggaaagcatatcccctcttacttgctggtaaggaatcctgaactccgaagctgacattgtcttctctaaatggctgagttatgaacacaccagaatgtttcttttccaccaatgagttgatatttctctagagactgatacagcatacaaggttacctgtgataaatttacaccatatttcttacaaaaatattatgtggcacaatgatattatcgactcaaacatcaatagtcttaaaaaaatcaaacttcaataattaatcgctgaatgcagaatgattctctccattcagagctaaagtgaaaatatacatgtgatttaaccatttgattggcccagtctcttccttaaatactactagtaaagtatatgaggtgacaggaatccagaacgaagtgagttcccgtgaaactcaaaattcaacaataggaataagggtttaccacaagaaagtgaagcatgtagacttatttattagcccctcatgcagtggcttcaaatctgttgagttggcttccacatccaccctaaatatcagcctataagctattaatccgttagttggaggtgggtatgttcaatagataacaaacaaacataaacaaagttacagagttacagacagagtaaatatggcagactactagcatacgccctacagttttggttctgttatgccgcacgtaatgagaactctgtttcataatggcattacggaatgcatttatgttcgtgtatgtaggaaccacatggaaatttctgcctccagcagataactcaagttatacagagatcatagtacgtagttatgctaaaagctctaaatagaattcatcaaatgaggcaccccacttgaacaggcaccaaattcgcagcgaagcacatattataaaatatgaaatgaacaaaagttacgatgtacaccaaacaatcccaaaattatcacaagcaattaagcaaaacacacgcctcctatggatcaaaccttcggactgcacccccagcgatccgcatgcagaatcagattcacttcaccatatcaagcagacatgcgagaagtcaatcccccccccctcctcccccacaaactaagggaaacaacaatgcgtcatgcggttgaagaacacaagtggaggcggcggcggcggcaatgcggctcacctgcgaccacgaacgcgatcacaaatctcacggaagcacgcgcgacgccatcgatcccaccaccgcctccttcaccaccaccaccaaccttccgtttctcccctcctctctctctctctctctcgttctatttcggtatttcctcctccccttctcgcccgcactttctccggggacttcttttggcagacagggggggagggcgaggccaacgaaatcgctgacgacgcgtcccacccccactgtagcgtgggccccacgtgtcagagaaacgttccaattccattccctttctgccgttcctttccgacggggtcaagcgatctgggccgtgggtttgggtgtcgcgcgacacgtggcatccgatcgaggggggtcctgccgtgcgtgcgggcgtagtgggaggcatgtcgtggacgggagggacaggttccgttttgtggggcccatgaacggtatctatggtttagctgggctccactgctttgaaaaatcttatcttctcccctagacttttgttccttttgttcgtgggcataggcccaaatatcatactactgcctttttcttttctgtgcttatctgtcgcgatatctttggagttttgacttttggctgaagaagaaatgatcaatccaggattctcaaatgatttccagagcaaagtacatgtttttcttcgaccaaccaaacggccaaagcttcatgatgatattgctccgtaacaattggatgctttgggtgctcttggagaagaagcattttactattgtgtaacacggacacgttgaagcagttgtacggaagcatgcacagtactcctgttgcagcttggtactgtagattggttgctactatctccgtcataaaatataagagcatagaaccaacatggcgacatatacagcctgtttagattcgtggtattagaaaatgtccaatccgagcctgctaccaccgctgatccttgaatcctcggtagatacgcatgttcctttgtgtcctgcacaagccatgtgcgagccgaacgagctagatgagcccccccggcctaagccggaccccattcacgagctcacggtcgcaacagaattgaagacacataaccagacaagctttgttcagtgaggccgtacaagcatggcaaatagtagtggcagcggcagagacaaggactgcacttcttaccagaaccaaaccgaagtgtacaatccctccagggtttttgtcggatgcagcaacaaacattacgctaaacacttgattaggagtacttgaattcttgaaacatcttgcccacgattccacaaaccacattgacttaacattagcagattactgagaatgtcagacgactgtccaaggtatacgtaatttttggatgcaattttggcgtttgatggtaaccacacagtcacgccttcttcgaggtttcaaaagcgaggtttcaaaagctaaggagggaggagaacaagggccagccagccactgctaccacaccatgacaaatgtgcctctgcttttagttgtctccacttggttcgtcgtcctcgtccagattgatgccagagatactcattttccctatatttactgcagtgtaaaatagaatgaattagtagtagaaatttttcaacaggttgcacactgaacacagtggaaacttgcactcaaatgtaagctggatcaatgataaaattggtgcggaataattaaaccatccatcctttactagtgtggtgccgatatacatgtcctctctacaacctgacactaaaccccaagtccccaacacttctgcaggaactaaaatactatggtggaaggccaagaatctctcttgcgcactccccaaacaacaaaagacataggtatgtgcttaccgatggcatccattccacttagatttggcatatacttgctaatgtgctcatctgcagctttatcagccttcagtgtctcacattcgaaagagatcgagaatttccgattcccatgtttcttttcaaccaaaccaacaatgtcatcttcccaactgcacaaaatatttattccttcaggaaaattgaggttggattaaaaattcacgctcagcataaaacaaataaatgatagtaaaaaagcaccgagtccacagtttcctcagactataattaaccattaccatcattcaccggagtcaaccaagagagaccctagatctcactctgcttaatcccctctttacttttttcacacttcctttactcattagaacttatgcaagacatctaattacaaaagatgtgcaatccttatgtgcattctcaaaaagatatctgattaaagataagacaatcaacacacatcatagcattttgggaatatgaaaggtgttacagcattaatctacaactccaacttcatgccagtaagacccaaagcaattatgcattaattaacagcattttggttgcttgaaaaagtaccacaaagaaccaatgccacagcgaaacagtgtgttgcatccaacagaaattttaatgaaaaacagagaacaaagacacacaagatagcactaataattggtacaatgagccatttatccttttctcggttttattcgaagtatgctactatagtatgttgctttggtgttcattgtaatccaattatgtgcctacagagcctcagaaaatgagtattcacagtatctcagtacaatcctcttatttgagaaattgttgatagatagtaaattctgcattagttctaatgaaatccatccatgacaaaaagtagttacccatgcaaatggtcaatgttttgcaaccgagcagcatcatggcccctgcattccaccacagccaccttctctcgcttgttctgtcaaatgagcatcgcagtttcatgaggatatttaactcttatgagcaaagatacttcttatagatccaactccaaggaaatatatagcacaaaaatagtaggtgcttgatggtggacaagttagaatttctcaccttaaaatcaattatggaaagctttatcaggcggtaatcttctcctcgactgcactccctctcacaagatatcgcttacatgacagacaagaaaagggaaagaataatgtaagttaaatttttttttctatctagcagatacagatggtgcacaattccacccactttgattctcttatactagatagaacatattatctacctcagaacatattatcttactgtgtatcactcaagcttccattacatgtcgataaggcaccagcagttaatcatgattttttttcataaagcacaaaacaaaccccaatttcctagataataacaggtcgtacaattttatacacattttcttttgaatgacacgctagtaaagggcattgtctaatacgatttagcacgtcttatctcactatgccttcttttcttttgagcaagggaggagacccctcccccgattccattaccagaaatttaagtttaacggaatccacagtttcatccggcaaaaaatgaagagtaaagtgcattggcggtccttaaacttgtatggttgtctcatataggtccctaaactctcaaaatgcatatccaggtcccagaacttgtaaaagtgtatcatctaggtcccaaatcgacacatcccctctaggatcctacgtggcgctgatgtggcatgccacatggatgacgtgccattttctttttttttcttcttttctttttatttttcttcgttttcttcttattcttctttttttttcctttcttctgctcgggtcatagagaaaggagaagaaagggaaaaaaagagaagaaaaaaagaaaaaggaaaaatttttaacgggacccatttgtcagtcaaaa

SEQ ID NO: 27848 - DNA, 4001 bp, Oryza sativa
cacccccttaatcttttcaatcaattttccttctgggacagaatgtggacatttgcaatgattccaacacagatttcgccaacagaaaaaaaaaagtatatcacttgcttctcattaggcgatgagcaagagagggttttggtgagagcaaaagggtttttgggtgagaccgcagacgattcaggctataaatatgcagtaagagccagccccccatgatcaggcaccagcaagtgcaggaataggcaacgaagagagatggatacgtgtgccgtggagaccgtagcagacggagtccgggaggcggatgaagtgcccggagatggcgccggacggcagtagcgcgatgcacgcgacgccttccatcgtctcacccgcatccgcctcctcgactttcaccccagtgtcctccatctccgccgccggcggccggtggtcgccgttcgcctgggggtccgagactgagctcatcgttgttccccacgcgccaaagaaccgcggtgcgccgcccaggaagcggaagacgggaagacggtgggtttttttttttatttggcaccgaaaaaacggtggagttctgcacttttgctaggctgtgtttagatcaaactttggatccaaacttccaactttttccatcacatcaacctgtcatatacacataacttttcagtcacattgtaccaatttcaaatcaaacttttaacttttaaaggaactaaacacagcctagtgtaacccccctaataataaagattttcttcagaagccccattgccccataattcatctcaaaacattttgagtactagttctttatgaatttggaaataaacccgctgacataaaacttttaaaagtttcatttttttttaagaattacgcagtacaacacaagacacccacaacgcacgcacactcacccctgtgaacacacgcacgcaaaccctacccctatgagcatcttcgaagactgggtcggcaaatcctagagattgacgaagtcatcacagacgcctcgctatcgacgggataaaggttgtgtttagatacatgggtgtaaagttttggcgtgtcacatcggatatacggaaacacatttgaagtattaaacgtagtctaataacaaaacaaattatataatccgtctgtaaactgcgagacgaatttattaagcctaattaacccaacattagtaaatgtttactgtagcaacacattgtcaaatcatggcgcaattacgcataaaagatttgtctcgtaatttacacgcaatctgtgtaattagttatttttttcgtctgtattaaatacttcatgcatgtgtccaaacgttcgatgtgatagcgtgtaaaattttaccagacgatctaaatatgtcacaccccgatccggcactgccgtacaacggcacctgacaggagcgtgtcgtaggaaaaacggcgcgaaccgcttcctacgaaaccgcgatctcaataccagtcccaggacatagcgctggtacccacggtgacaaatatgaatcattgcaatccttaaaataaatagaggacttatttaccttaacttaggttgcagctcagacagcccgagaatgcaaccgacgacacggacgaggcaaacaccaacaatagcagcagcagcggaaccaacggtctaacacccaacaccacaggcgacggctgggaaccaggacgaaaccctaatcttcacttcacttcatcttcacttcacgacagaggaactatatatacatatatagagcaagggtgagtactttcgtactcagcaagtcacgggaatttaggtgtttgatgcaagtttggaagagaggcaaggttgttttggtaaatcttttgtttgaaatcattttgaaatcactaagtgatttatttctttttaagttcgggtcgaaaagagacttgcgtctcaaatttcaacaactcaattgataatgtaccgacctcccgggtcagatcattacttctcggctcccagagccatttcacttgattaaatcggctcccagagcctttttcattttctcggactcccagagtccagctgcccagcagcacaacaatccacttccactcgggaagcctagtctatgatgcccgcagacatcccgaatcacacagattcgtttctgaccactcaggtcatccatctgccacataggctgattctggttacgattcccacacaacaacttttcacaaagcacaagcaaacaaatctacgcaacgggaaccacctcacaaccgcccatgaccgtgggcatggctgttcgaacagttagttaacctctgcagaggggtacactttacccacaagatacgaacttattccgaacacctgtcggtatcggaggttcgcaacaaagcctttcccaagccgacccagggttacctcatgccacatagaaggatcaaatccttcacataaatataggccagatcagttttcacaaatcaaactccaaccacctcgatcggtaatctggcaagcttcgcgttcttgccttaccaggaacccgggttggctccaaccgaccccgccccggcgttccccaactattggcatgcgaggtttccctgaaccgactagttacttagctagggtgtcccattccaccttgtggttgcactttgttatgattgatgagtttcccacaggaatcggtccttatatgcgaatacgggacagcgccacgcaggcaccacctccgcatcgtgagttttcacaattcattttatttttaaacacaccgacaccacatgtcgggttttcaaggcttctcaaacccatttcccaatttttcgacaatcaacggtgtatgtgggatatttggtatacgcgctcagagagcacggataccgaggtaccacaagagtggagcgacaaggaatcagggtagtacaacctataggaattagtgcgactactgggtaggtccgtcggtttggcacgcaaaccgaggccaagcaagttaagtgtgtgattctaataatgcaagttgcaaacaaaataataatgattttccaattataggagcaattggttgaaggggtgacttgccttgctcaaggtcttcacggagcttcacgaatcttcgagaaaacccgcgatcggcgaaaatccggtaaccgcaactatacgcaaacaaacaaaaacctaaacaaaagaccaagaaaaagaccctatttagactgaataatagtgccattaaatagatctcaattttacggaattactagaagttgaacggagtcaatcggaagagcggttgggaagatatgaattttggaagtttaattggaatttctggaagacgagaaatggtttatggaatttatagaaataatattctcaagaatattattgacagtcactgacgtgcgggaccaaaggaaaatgattcatagaattttggaataaagaattttatttatgaaacaaaggaaaaggatttattaaatcccttggaaaattaaagggatgagggatgtgatttggacttttctcgggtggcattggtgcggcccaaagggttgaaggaggctcggccgagccattgggccgggcgcggccacggggaggcggcccaacagagggggcgcgggggagagagagacggcccggtggaccgattccaccgcgcggggtcccggtggggcccacttgtcggtgatacggcccacggtgggatgggcgcatgcgagggtggcgctagggttcgggggggaagcggtccacgcgcggcccgcgggtggacgcggtgtgcggcgggcccacgcgcagcatgttggctctccgtggaccgcgcgcgagggtgggggacggagggaggcggctgaccgaggtcagctttgacccggtcgcgtcgaggtggcgccgacgtggcgcctacgtggcagccacgcgggccgggagagaggaggaagaagaacaggagctccaaccaacggtggccgacggcggggtttcactggagcacg

SEQ ID NO: 27849 - DNA, 734 bp, Oryza sativa
tgtccaacgctaacccacgttgcgacaggcccaaccatccatttaacctatccaagttctacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataagccgtcgcagggcccatccaaactccatcacgcccacccttgcctggatgcgtcggctagaggaaagctacactacaagcccagccgttgcccacgctggcttgtggtaagcacggtaaattcttccagggcatcccgcgaaccggtccttaactgccatgggtgcgactagcaaaaccatgcacccacagcccaccatgtggttcattttaattaaccaacaccagagcggtggtattaaaccaacattatcaaataaaactatagtctaggttttaaatgagatccccaatgtgtgctagttgaactaagcatggctaagcaagtcctagtccaaaatctaatcatgttataacccaagctaacaaagggg

SEQ ID NO: 27850 - DNA, 640 bp, Oryza sativa
ccctagtgtaatctgtagaacttggatagtttaggtggatggttgggcctgtcgcaacgtgggttagcgttggacagtggatgttaatactgcttaattattacaactgttttcgcattaaattcctgtttataaatgccagtatttatgcaaatgaaccactctagctctcctttgttaattccctgcatcatacccccattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgtttttccgctgcatttctgtaagactttataatgtttgtaagacgtggatctgtatgtcaacattgtcgtttgtgtaccccggctggtcctggacggggattttaatgcacattctgcttgggattccatccgggaatttctgggcgtgacattagcccaccttgctctgtcagacggttcttctcctcagcctcgcacgtgcgttgcacgcgccgagccgaaccgagagagagctctcttgctctct

SEQ ID NO: 27851 - DNA, 809 bp, Oryza sativa
  unsure (1)..(809): unsure at all n locations
nnnnnnnnnnnnnnnnnnnnnnnnnnnnnnnnnnnnnnnnnnnnnnnnnnnnnnnnctcaagatacttggtgtgattacttatgttcaaccttgttatatagcattcaccttagtcattggtataccatatatctattcatgtcctactattatagttattaacctgtcaatcactaattgcagtgatgatatttctcttattaggcagttgttgtaagtattgaccctcgaagagtatatgtcaagaatccggaagaggtgcaattcaaaactgtaaaggtgtccaataaaggtgcaattcaaccactcatcctgaatctccatttgcatttcaagcattaagatctcatgtacttttttcaggtccattaggagaagaatatgcatggtaccagtgcacagtaagccatttgttttccatttactgctaatttcgcgttactctcttatccatgcacataaggggtatttttgtatattcatatgaaaagtttttcccagtacgcaggaatattattacccaaaacgcccataccaaatttcagactgattaaaacatgtgctttcttcagatatttggtgtactaccttttaggcaacattaaatgactttatgctggcataatctactgtggcatgctgtcctttaataaagattgctcttttgttacaacaagtgttgtttatgtctttccaggtaagtggtgggcgtgacaagcgttctataggagcatatgaactagccaaagcagttgaagaattgggtgctggaaaaatacttcttaanatgcattgattgtgatggtat

SEQ ID NO: 27852 - DNA, 661 bp, Oryza sativa
  unsure (1)..(661): unsure at all n locations
nnnnnnnnnnnnnnnnnnnnnnnnnnnnnnnnnnnnnnnnnnnnnnnnnnnnnnnnntgcataatgttttcatttcaagttctttatatgcatatctttagggggagcttcacacttctctcatcattcaaaatttaaattctattatctttttgtgtgctttaaccatgttgtcatcaatcaccaaaaagggggagattgaagatgcacttaaaccccctagtgggttttggtgattaatgacaaggtggttaaagaggactaacatgtttatcaagtttattcataggagtttagtcccaaagcgagttgtgatggctaagaatgcaaggagaccccccaatttgaatgttcctaagtgcaaaaaacaccgaaggtgattagactaggtttttcactttcgaaattgagtttagaaaaaaaaccgtactattaagaggggtttcaagtgtggttctagggtatacaaagtgagtcaaaatatttttggaatcatttttgaaaaatgattttctcctcgggacagagagggctacccggaggttcttgccggaacttcccggtgccggttatttcaaaaagtttcctaagtactgccaggaagttcctgcacttttgcccaggaacctcctgcaagtttccagttaaacttggagtaacg

SEQ ID NO: 27853 - DNA, 780 bp, Oryza sativa
ctacgttctctgcttgtttgggtgaagcgttcatcatgctcaaccggaccaagtacgccgcaatgctcgccgagaagatgcagaagtatggcgccaccgggtggctcgtcaacaccggttggtccggtggaaggtatctgctactgtccactgtaacagcgtccacaccattgcacatttacctgtggcatgaactaactctgaattcactgttcaggtacggagttggcaagcggatcaggctgccgtataccaggaagatcatcgacgccatccactccggtgagctcctcaccgccaactacaagaagacggaggtgtttggcctggagatccccactgaaatcgacggcatcccgtctgaaatcctcgacccgatcaacaccgtaagctccgtagcatcacgcatcagttcatgccatttctgctatacatgtaaaaaatgcagagtctgagttgttcttcgtcggaaatgtggcctctgtgcagtggacggacaagggcgcgtacaaggagacgctcctgaagctggctggcctgttcaagaagaacttcgaggtgttcgccaactacaagatcgggggagacagcagcctgacagacaagatcctcgctgctggaccaaacttttgagttactgaagaataaaaaatatgcagataaagaacgcgatgaagctagtcagttggttacaataaagaagtgggtctatgcgtgtttgccaatgatgatgacgaaaatgttggatcgatgtgcagctaccggtagagtttagctagc

SEQ ID NO: 27854 - DNA, 743 bp, Oryza sativa
  unsure (1)..(743): unsure at all n locations
ctcggtaccctgtaatggaatgattttcattgagcaggcagaaactacagaagaactcaatgaatggagaagtgcactagagaatgctctggcacaggcacctgttgtagcaaatactgttggccaaaatccaattttcagcactgacatagcagagcctgctgaagctccagctgaacagtgtaagttaagataactttcatcagttgcccacgatctaaagtactagattcagctagggggttgggaccctacattctacttgaacaggcaaatcctatcgtttccattgcagcggacaataaatctatcattggcagacctgcagagtttgcccttgtagatgctgatggtagtccaactttcctggagaaggccttaaagttcattgaagattatggtgagtgttttttttttcaaattttaatttcatgctatcctggtgaatatcagtaacagtcaaatagaagtatgatatttatctaaaacacaataactcattgtatgtatatttattaatctgtagtttagtgacgagcagaaacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27855 - DNA, 611 bp, Oryza sativa
  unsure (1)..(611): unsure at all n locations
nnnnnnnnnnnnnnnnnnnnnnnnnnnnnnnnnnnnnnnnnnnnnnnactatcatttgaccgaacatcaagacatgcaatgacctggaaattttaaggcaataagaagggcgagaatggaagttgcattgacgctaaaacatttggcgatacaaagcttactctctttgcaaggttcgatgctttcctacgagatgggacctgtgttataaatgcaagtatgaacttttacatcgaagaagttaatgaaaaggaactagcaacaataagcatacatatagcagctacctttgatcctgaagtgtttggactgagaaaatttttcaaaattgaaagcccagtagctgcagtaaaacaataatgggtatgcttagaaaaatctgaagtatctatatattctgcattattaagtattaacagaccttggtgatcaagaccagtcaagttatcagaactcaagaatctacatgtttcaatcctgtcttaaaatacattgtacatacttggctatggcatatcataacacattcaatatcaaactgcattttacctccgctcttttctgggtgaaactgaannnnnnnnnnnnnnnnnnnnnnnnnnnnnnnnnnn

SEQ ID NO: 27856 - DNA, 1047 bp, Oryza sativa
  unsure (1)..(1047): unsure at all n locations
taaacttcaatccacccaagtggcactaacacccacatttctatagaagaacgcgaaaaagaggttcatgttgggccaaagaaacataccatctggcggactagctagaactgatatcagttaagaagtcagtgagatttacctctgttctagatccaagcctgcctaatagtggattatttgagtattgtttctgtgcaaggttccactttgatgccaatggatcttggccatccttgacaatctcacccttagaaatcaacattctttgagcctgaaatgtgatatgaaaataacttaagctgtgttcaggagtattagttggcaacttcttcccctcgcacgcaaaacgaagcgactcattaacgtatgtttaattaagtattagctaaataaacttgaaaaaaatatcgatatgatttttttaaagcaactttctaatgtagaacattttataaaaaaaaatacaccatctagcagtttgggaagcgtgtgcacagaaaacgatggagtagaagttgggaagaggatgtatagaacacacccttaatgatagaattgagaccattaataacttaaaacacacccagaactgattgcatgctcattgttaacttcgttgagctggatctttgctacgtaatctcgttttattcccttggttgtctacagaaatgaaatatgagagattgtgatgtaacaaagatatttagtttttttcctgcacatttgctactgggcacctcagacactttaggtctttatgcatattcaggcagacataactaatgtgactatcttggttacacagtttcaaaaacatctgttatgatttccatttccaaatgttgggattatcatagagcactcagagacatgcacatgcaatagtaatcccagactaaagagtgtttggctctcatagtcttaccatgtgtgtagccgataccatgtcagatatagaattgggcccaacatttgatgatgtggtactctnnnnnnnnnnnnnnnnnnnnnnnnnnnnnnnnnnnnnnnnnnnnnnnnnnn

SEQ ID NO: 27857 - DNA, 1566 bp, Oryza sativa
caccaccacacaagtttagagaccggccatgtatttcactctattatttatttgataggttctcaaaacatttgatgagcacctggcactgaatagacagacactttgtattgtgaaggctgatgaatgagttcataactcgtggggtaaatcggatcatggatccaatgaaaaacaaaatttgaagaatattctggattaaggaaactggttgcattatcagttgacaatataaaatgatagtgatatattctattatatacatcaaatagtggaaacaggctcccaacattattttgataagaaagctggcctaattacagtagatatcataatatgacaagaatgatacattctattatgtatttcagaggcaaacccttttacttttaagtcctaaatatcaaaagctaccatagagtgcagaccggcagatattaaattgtcaagtgaaaaaagtagaaaatatttaggattcaaaaagcaatccaaaattgaatcccaagccaagtactacaatccagtccttgtattacgggcttgaagttctagaactgcccagtgcagcatgatctgcacaacataaaaaaagctcccagaatattttgaacgatgcagcacgaagtttacaacacgccaggtgtggaagacagagagaaataagatgtcctcgctttcatgaggtgagaacatgttcttgtgtgcattttacatatttgtcctcggaaactatgcagagttatgctttgagcagaggagtgatcatgtgctgtgtaaacactatagtgtatggaactaaccatagattactcggatataccattagctaaaggctaaaacacacaaaaaaactgcaaagaggaagaaaacatacccataaaagaatgttcgccatccacttttcagcctctgataaatgaaatagatatttgctgcacaagagatggccacctggagagttggcccttcttcagtagggaaaacaagggtaagcactccaagcaatacaaaagttattgctgtctgccaaatcactttactagaaggtgtttgaaatcttccctgaatagccttgactggacgtgactgagtaagttccctatactttttcttgagatccacttttggtttttttctatcagagaaactctgcatgatgattctgtcatgggcagactcaattgcatcaacacttggcttatgccctgcatacttgtttatcagaaaattcctggcagctcgaatttcttcttcagatgcttccctgctgattccaagtcgctgatagggatccttcacatggattctaggaaagatggctgaagaaattaagcggttaaaaagtgaggtgataattacaaaaaagaactaatccaaacaacaaaaccgacaggacaataaaaagtatatgtgatctcaaataaaacatgagaggaacagattgtgagaaaaagtatatgtgatctcaaataaaacattagaggaacagattgtgagactaaatggcgtgattttgatataatgtccaatgctttggccatggtatagttaggtatttatactttt

SEQ ID NO: 27858 - DNA, 681 bp, Oryza sativa
  unsure (1)..(681): unsure at all n locations
nnnnnnnnnnnnnnnnnnnnnnnnnnnnnnnnnnnnnnnnnnnnnnnnnnnnnnnttttgattccaaccctcatatttttctcaatttataacgaaggccaaattttacagtgaacaccttacaatggagaaaaaaaatacaaatctaacccaccaaccaccaccaccgggtcacaaccctctctacttcaccggcgctgccgctgccttcggcctctccccactccccgcgccgaggcgacgaactctgccgccgtcggcctctcctccctccccatcggcgcttctccactcccgacaccgctcaagcccaacccacatggggacacagtggcggtcgaggaggccgagcgaatcgacgacgatgagctcctcaaagtgcgagagggcgacaacttgatgagctcctcggtgcgcgaacgggggacgacggtgagcgcgagagggtgatgactcgacaatggcggcatggatctggagggcgacgaaccgacgactcgacgaccagatacaacaggtacctcaactgtcaaaaccgatacaaaatgagtcccaaggcagtttggacagctttttcaactgacgtggtgcctacgtgggtaatttgacttgatcttcatatgacgtggcacatgaagcaaaatttaacaatttaaaaaaataaaacaaaatatgcgtgcc

SEQ ID NO: 27859 - DNA, 544 bp, Oryza sativa
  unsure (1)..(544): unsure at all n locations
nnnnnnnnnnnnnnnnnnnnnnnnnnnnnnnnnnnnnnnnnnnnnnnnnnnnnnnnnnattgcgtatgacatagcatctgggttaagccccttgttcttcagcagagtcgccatgctgaagcccatttgcgctgccctcagttccgggaaatcgctgtcgccgttgaggtactgcacaacctgacgcatgctcggccttgcactagccagtggatgcgagcaaagcaggccaagcttgagcacaagctcaacctcctcctcggcatagccatttctgagccttggatcaactgtttccatgattgaaccgctgcgccaatagtcgagcacccaatcgacaagcaccataggagcttcctgctcaacaggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 27860 - DNA, 458 bp, Oryza sativa
  unsure (1)..(458): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgtaatggaaaagtaagcggaaatctaaaaatatgaacaattatccgtttttcaatttgatacattagatcagacagaaaatgtccataatgtggtacactacatgagaaatagtgcattttcttagtactaccacatttctgtaaacattacagctaacttcatgagaaatataaagcag

SEQ ID NO: 27861 - DNA, 521 bp, Oryza sativa
  unsure (1)..(521): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcagaacaagtcataggggagggcaacatgttagaggcgttcgaaatgatagagatgtactacaagcgactcatcgagaatgctgcaaagctggacaagcctgggtacatacatttcatttcctcacaccagactttatcgcgtcctctatctcttttccggtcacatgacaattgtatttggtgtgtacagtgagtgcaccgaggagatacgtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27862 - DNA, 625 bp, Oryza sativa
  unsure (1)..(625): unsure at all n locations
nnnnnnnnnnnnnnnnnnnnnnnnnnnnnnnnnnnnnnnnnnnnnnnnnnnnnnnnnnnnnnnnnnttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattgtcgatataataaagatgtgtcttttatatcatgtttgtgtggtgtaccccggcttttcctgggacggngattaatacactagcgttcgggaaaaggcaattttcccggtcgcgacagcgcgccccgctccctcggctgacgcaatanataggatttttaattgaaaaataaatgaagaaattcgccaatattcatttaaagagcatataaacttcaaatgggcatatcttggccatttgaactcggaattggaccgttcaagtctctaa

SEQ ID NO: 27863 - DNA, 767 bp, Oryza sativa
  unsure (1)..(767): unsure at all n locations
gactacagagctctcaatgaagtcaccatcaaaaccaagtaccctcttccccggaatcgatgatctgttcgatcagcttaaaggtgccactgtattctccaagattgatcttcgttccggatatcaccaattacgtattcgtgaagaagatattccgaagacggcattcaccacgcgatacgggctgtatgaattcacggtgatgtcgttcggcttgaccaatgctcctgccttcttcatgaacttaatgaacaaagtgttcatggaatacttggataagttcgttgtggttttcatcgatgacattctgatatactcacaatcagaggaagaccatcagcaccatctccgtctggtgttgggaaagttgcggaaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgttccaaaccctcaaggaaaagctggtttcctcgccagtgttaatcttgccggatnnnnnnnnnnnnnnnnnnnnnnnnnnnnnnnnnnnnnnnnnnnnnnnnnnnnnnn

SEQ ID NO: 27864 - DNA, 783 bp, Oryza sativa
  unsure (1)..(783): unsure at all n locations
nnnnnnnnnnnnnnnnnnnnnnnnnnnnnnnnnnnnnnnnnnnnnnnnnnnnnnnatataggctgatggtacacggcctgttgggccaaatgaattgggcctttttgggccgaccaagtttagcccatttgccacttcctctccctcgcccaccaacgaacaggggaaaacacagcgagaccttccccgtcaatgtccgcgtccccttccaaggagggagttagggtttaactccgactgaacgatcccccccgccggccaccgccctcgccggcgtcgatccgatacggcgtgcgcctggtcgctgcaccatggggtacctgcaggaggccagggagaatcacgtcaagaagaaggtcgaggaaggtgagcccccgcatcctttgcctgttcaagcttccgaattcgttgatttggggggtcttgaggtctgcaaaatcgcctgatagttgcgtaacgggtgaggtactgacgaaaaattgcgctccgctggtgttgcttgttgaaatgggaacacaatcctgtgtgaaatgagtcgtcaaacgaggaggttaaggaggttggctgccgtttggctggccgaaccttgtagactttagttgagaagttatgtgatctagtgcttgccggtatggaagctgaatcattagttgattaagcatgccattcagatttcatagttcatgtacatctctcccaactggttaacactatctgatgatggtaaccggtatatgctgtagttaatttgtttacagaatgcgggatctgtgtgatgttatt

SEQ ID NO: 27865 - DNA, 2725 bp, Oryza sativa
ctataggcgaattcgagctcggtacccccgcggtgaaatgaactcttatggtttcgaggaatgggccaagctttggccatgcccgggacgcgacatcggagaattcgtcgcggatgcgattgatcccctccaccacaaactccatcgtcttctcatctacctctaggaacttagtgtccagcagcttgctcatccaaaacaattttttctttccaacgccgactaacctcgccgatcttctcaccagagccatcactttctggttgcatgatcttgttggttggtctgatccagagtcccagctgagtaagctgtactgtccaatggaactagaccacagtggccttctctcgggccacccaatatcactggaaaagaggaaccaggacaagttggctagccagtctctcttctgtgcagccttcaaccagacccaagtccatggagatgttatgacaataaacatcgcacaaaaatctaggaaaaagcctccgataaacagtgaatacgtaattgcaatatcaactccaatgtaccgatctttatcactcgcaaggaagagtgcaaaagcaacgaaggagcatgcgtgagagatgcatcggagtataatgcctgtccttgttctcagcacaagagcctttgtgtagaggtcatcgtacatcatggcgagctcaagctccaccaacttgaacatttttttggcgtcgacttgagtatcatctggaccaacacttgggaagctataaccgaacaagttgcgcgctgcaaagacattgaggacattgaacattgaacatagagcattggaaaccatatttcgatagtcgcaatcagagtctcttagttccggaaaccgttgcttgtagtgatgcccaggtgagctctcaaggctttttgagctcccacacttgagtgaccatgtcctttctccatacttgataactccaacgatgaacacgaacacacccgaaactataagctccgcactctgccttctagctgacttccagaaaacgtacacggcgaggactacttgcacgaccaaattcaagaaatgcctcagccacaagtcattgtcctccatggcaaaagcagtgattgtgtcctgaccaccgagatggatgaggaaaaacggtgcccaaaaaaaagacagtggcagctgacttctccttgatatgatgctctcctgtactcctgagaggttgccaagagcataaactgctacccaatctgctcctaaataagctgtccaaatagaaacactgaggaatatgttggtgctgcgccgccgaaggctgccagtgaaaaagaggaacacttggagtgcgaagctgacgaggacaaacagctggatttccctctcataatatagtccaccaaattcttcatcgcataaatattattgacaccaagccacctgttgtatacaattagttatatagattagcactttttttgtgagataaagttggtttagctttatgcatgttcaagaaagaaaacagtcggagaagcactggctgcactacacatatgcaatttcaataagaatttacattgtgacaccaccttgctaatgttcgctaagatgtggccaagaatttgtttactccatcttgccttagcccccaggggaataagagcatgacgtgtgaggtccatggctatgaaacttaatttggcacaaaaaacttgtaacaacaaaagaatcaactgttacaaaacattctatctcttgtagcatgtgcctgcgtatatagtggtgtgtgtttacgcatggacatcttccaggtaacacaaaagtaaaaaaaaaaaagggaacataatcaatgccccatagtttgtgacaatttttaccatggtaattataattactccatattatatttctagaagaattacgaatcctaactgtaggaagaaacccatagaaaccattgcttcgatctaaaaacaaaaggtatataagaatctcatatagtttgggtctatagatggtcaaatgggcccgccggtctggcccgggcacgaccaggcctgagcccaagatcagtcgggccagcacgggccgacctacacactgggccgggtcgggcctgcccacgaactacaccaatggcttaggcatgggccaataaagacccaggctgtgctggccggtccggaggcacgaaatcccccgtgctcctccttggagtaagtctattttgccttccttatctctttgagctgtgttttatatggatggaataagtctattttgcatcgctcatctctttggtcatgccttatatggctcaaataagtctatttttcctacctgatcattggaccatgctgaggcagaggcccaggcacggcccaacagtcgggttggtctagcacgggccccacaccagtcgggtcatgccgttcctgggccgagccatcgggtccctagccttttggccatctatatttgggacaggaacaaaggggaaagaaatttgtcaacctattaaggaaaaagtacaccgaaggtccctcaacttgtcatgaagttacaaaatcgtcccccaatcacaaaaccagatatctgacgttccttaactaatcaaaaccggtcacaataggtccttcagtggtaggggtgaaaacggtacgaaaacggacggaaaccatctttatccgtttcgttttcatatttttttgggaatcggaatcggaaaccccggatacgaaaaca

SEQ ID NO: 27866 - DNA, 3107 bp, Oryza sativa
tgtttccgtttccgaaaaattccgaaaaaattccgaccgacagattccgttttcgaaaataagtatgcaatccggaaagtttccgtaccgttttcacccctattcagtggttttgaccccgattttatcctacgtggtggctaagtcagcgtgggacccacgtgaaccccatatgtcagcgtggccacgtcagcctcctctctctttcccctattctcccccttcctcatgtcaccgaagattttgcaaaaatacatattgaagaaaacgagtgagtttttttccttgtgccgctgccaaacatagtccaattagaaaattaaatgaacagatccatattatgcctaaactatccgcacgcttgtagaaaaagaatccctcaactgttctactggacattatccacccttccatttctaaaaccgttccaatttatccttaggttcaaacgaattaaggtgaatttgtttatggtttaagaatgtaatttgttatcgaaaacctctccggccctgacggttttctagataactgtaatatataatcgagcagtcatagacgaacccagtggaatttaaacaaaatttgacgaaaaaaatttctaaatatatatcgccttgataaaggcatgcacaatactttgagcctccacgaggctttgagacaatacacatcatccataaatcgtttggctttttttagtcaaatttatttaggtttaactaagtgtgtaaaaaatttagtaacatccacaataccaaattagttttgctacatttaacattaaatatatttattttgtgttgaagatgttactatattttcttacaaacttaatcaaacttaaaaaaagtttgactaagaaaaagtcaaaacaaatatgaaacgaagggtgtaccttataatggttgagacaatagtcgcttaaatatttttcttatattatccatccttcctttttcccaccttcatgctataaaacttacttttatcatgggctaaaagatgatattaagcttaacattgatatttctctctcctcacctatccctctcgtatgtcagcaaattttactactggtagttggtgatttctccgttccaaaataaatacacctattatatgatgtgacatatcttagtactacaaatctagacagtctgtctaaatttgtattactggaatatgttacatcttgtattaggaccacttatttgtggacagagcgagtaactctattagtgtgctattattaaaaattgttataaatacccgaacgtcgcatctgtaaacgtggttttgacggtgttgacatggcagtccgggaagaaaagaagttttgaaaatcatgcattactactgctgaaatgatctttggaaatcttcaattacaaaatacagaacactactttgtttcatgtttcaaaatacaaggcgcagatgcatatatgcaattaacaaccacctctcccttttctaaatttgttttctaaaaatcctatttacatggaataagatttacaccttacctttgatccaccacactgcatgggctttaggccacctggcccatcttgtgtaacatggcccaaaggcataacattgggtacctagataccgtgtctcttacactcgtgatttctaacccattgatgcatgcattatatttgttagggtgattttgggttggggaggaggggggaagggggtcacaataaattttattggtctatcgtgttagtgatggttgtgttttactatattttaggatggagaaacaacaagttaaatgaaatccaattatcaacaaaggggtaatctgaggcagcaacaaatattacgaaagaaacaaagatccaaactttgtccacaaaaccacaaaatctttttttttcacgaacgcgcaaaagaattgcacgtcaatatattaaaagaaataagagtttgtttatacaagcaattagccaaaccggcttatgccatgggaaggaagaaaaaaacacaaacaaaaagaaagcagaaaaacaaagagactacttcaacggccaaacgcaactccagtcagcgggaaaggggcagagctacactaccctcccaagaagaccccaaaggaagggggcagagccgcactaccctcctaagaaaaccacaaaatctcgaatccctacatcccaattcccaaaccagtcaaaaatcctgacaaatcagctcaagaacggcgaccacctcaaatcaagccaagaaaaaccccattatatcttgaaaaccaaaaaaaataaaagaaaaataaaaggccaagaaacgaaacccaccctgtccgtgttggcctcgtttagtcgtcgacgctgctgctgcagtctctcctcgctcgatcgccttcctcctctccggcgagccgctccggcagccggcggcggtggctctttgcctcagccacttcgacggcggcaataatgaggctagctagagctccggacgatatgatccgctcgagtggatcagtgggcagtggctgcttgaagttgcagcggattcgattgggcgatcgaggaccgagacacgaagagcgatctcatctgcagggcgaaaaggtgtcgttgcgaggcggacgtctgaggttaattatgtagtatattcgcgcgccaagagttttctactgttgacttgagtcagaagaaaatacgaaaaaggaggtgatttttttaaggaaacgaattgaaccgtgcagattttatgggcctggcctcgtgatcgtgagagagttgttaggcctcggatttcaataggggtttgttcaagagattcctgacgatacaacttggaatacctttcaaatactcagtgacttgggagttggtactcgatcatggttccgtactttagtacttcctcccaaaaagaaaacaatttttatggaatcaacctcaaaaagtactcgtagaatgcatgggaattaggggtagaaatgttatatcgtgtgcgtgtttgagtcaatagcaatcaaagcggacggaaaatgatatgagaattgatagaagtgttaaaaatgggaacgggataaactttgagtgctaacccaggacatgatgtgacgttttccaataaaa

SEQ ID NO: 27867 - DNA, 2200 bp, Oryza sativa
  unsure (1)..(2200): unsure at all n locations
nnnnnnnnnnnnnnnnnnnnnnnnnnnnnnnnnnnnnnnnnnnnnnnnnnnnnnnnnttctttttaattaggagtactagtgaaatttggaaaaaaatgcatcaccaattgtgattgggagatttattggctcattggaagccaatactcaaagttcgcatttcagaattcatgcaaatcatataaacccttgttgtcaaaatgctaccaaaaagcttgataccaaaacatggccaaaaccacaaagttttcagataagtaagataaatttgcatgggcatatatgtcttttcatgatagattcaacacaattgctttttaaagtaggtgcaagaatgtaattatcccttttttaaaatagagaagtaggctatagcatacaagagagactaaacccacccacgaatactcaataggaattacccaccgccacgcagccggctagagagaggaagaggagtatgattatgaagccggaaccgagaggaagaagagaaggtagggtagggctcagcttttatttatttcgtttgctgtctttgactcccatcagcgtcaaatggatgaaaggtgccaaatacataaaagagtgaattattatacttaggatcggaaaagattacagctttgctataagaaaaacaaccttgccagcacaaagatgcaccatatctaatagtatagttcactactatggaatcgattttttccatgcggtcaaaatcgattttcgcaggcgggtggataacctgccctactacagaaagtgtcatcggtgccggttggaaaaacacatgggggcaccgacacaacagacgcggcacagatgactccgagccattggtgttggtttcgcaaccagcaccttcgaggcgctcgctaggcaaaaaaaaaaaaatcggctcgattcaagtcgatgcatcgagttgctacccgttgccccaaatccccaaatcaaaattagatcgccacactgatcgattgtcatcacaaaatcgtgaacatacacaaaatcaacgacaaaaacatccacaaatcagcaaaaatcgtcgcccgtgcacttgacgacgttgagggaatgctacagcccaccgccatcgccaccacggatctactagagggcgccgcacggggagggggggggcagatccagaggccctcaagctcaagcctgccggatctggcatccgtaccaccgcccttgccgtcgccgatgaatccgctggccgctagctactgggcgtcggccgtggcaaggcgagccgccagggagaggctccggtggagaggaaaagctggggagagacgaaaagaagacagagagctaaaggagaggaaacggcacaggtgagagaagaaaaagagaggaaggcgtaggcgagagagagaacgggcgaatggataatggcaggagtgggaaggtggctaaaacaatctctcgtcccgcaagcgagaactggcaattatagtataggtattattttttatctagaactggcaattatagtataaaaaaaccaacacatatactatatgtcggtttttatcttggatttttgtctgatagaggtgggaaactgtaaataggtaccatatttctaaaccggcacctatgagccgtaacctatcaggtgttttgtagtagcactgcctacactcagatgtctgcgaaaatcaaatttttacatgcaggtagcaaccacatgcgaaaattagggtgactgtgaaaagaaaaatttgttaaaaaaaataaaaattcctaaaatcgaaaccctagccagatccgccacaacttgatcacaaccgtccaaagcctgctggatccacccgggccaaggtcgcccaccgccgccagccatcgtcgcagcaagcaggttgtggtcatggatgccatcgccgtcaaggtcatcatcgtcatcacggatgccacagccaccactgggatccgccacgggcggatccaccacctcctgtctttgctggatttggtcgtccgtcatcgtggttgcccttcaccgggccacccccaacttctttgcggcgacggcggatcccgtgcccagccagctgctctactcccacgccccgctggctgctgcgcttcagtggcagagtagagacttgagagatcgagagagaaagggagaggtagagacaggagagaagccaagaaagtagcacccaccgccacccgtgcttg

SEQ ID NO: 27868 - DNA, 16125 bp, Oryza sativa
  unsure (1)..(16125): unsure at all n locations
cgcgaaattttctactccctccatttctaaatatttaacgctgttggctttttaaaatatgtttgaccggtcgtcttatttaaaaaaatttaagtaattattaattattttcctatcatttaatttatggttaaatatacttatatgtatacacatagttttgcatatttcgcaaaagtttttgaataagacgaatggtcaaataagtgctaaaaagtcaacggtgtcaaatatttagaaacggagggagtcctatttaaccagagaatatgataccccgcgcgcgccaagtaaaatatgaaaaaggaggtgattatttttgcaagaaaagaactggagaaattttatggttattaagtacacctcgtgatggtcagaaagttggcacttggcactccaatttcattaggggtttatctaaaaggttcacgatgcgtactatacacaactacttggaatacgtttcaaataccgggtgacttggtagtcgacttgtatgtagttgagttggctagcatgcggtgatcaagtctagaagaaaggtaggagtatgagataggacacggattttttttttaatttcattttgtttgctgactctcgactcccatcagcgtcaaataaaatgtgccaaatagttgaaaaccgcactagtttgaacaaatttgttataacggaaaaaaaaaactccaccaaatgtagtgaaaaaaaataaactccaccctgtttagttcccccaaaaacttttcgcaaaaacatcacatcaaatatttggacacatgtatagagcattaaatatagataaaaagaaaaactaattacacactttgcatgtaaatcgcgagacgaatctcagtaacccacatgtgctaatgacggtttaattaggctcaaaaaattcgtcatgcggtttctagacgagttatgaaattagttttttcattcttgaccaaaaccccattccgatatctggtcaaacgtccgatgtaacatccaaaaattttcatttcaccaactaaacaagccctttgttataagaaaaaaaaagtacttgccagcacaaagatgatccgtatctagggggttttagatccagcgatgtaaagttttggcgtgtcacatcagatattatatagggtgttgtatggggtgttcgggcactagtaaaaaaaactaattacagaatccgtcagtaaaccacgagatgaatttattaagcctaattaatccgtcattagcaaatgtttgctgtagcaccacattgtcaaattatgaagcaattaggctcaaaagattcgtctcgcaaattagtcgtaatatgtgcaacttttttaagcctatatttaatactttatacaagtgtttaaacgttcgatgtgacagggcgtaaaattttggggtgggatctaaatagggccctagtaacatcctagtaaaagtcaagtaaaagtcatgagtagctagacgtgttcagacataacgcatcaattcaccgagacttcgggtatgcgtaaaagatattacctccatccctaaatatatgaactaactgacgtgatatatataaagaagaatggaagagtatttgaacaagtatctacccccatattcgatcatttgacaaacctataagacagcatcaccaaacaaattgatggtctaggccttaaaccctgttctgtcaattggatcatcggcaaccaacaaacaaactttcatggatggatcttcattgaggacctcgtaaatgtagtggcaatcgacaaataggtaagagagacaaaagattctaaacaaatctacctccataagaatattaaacgataaaccctaatctacctcacgcaaaactcctaaaaatgccaaataaaaatctaaaaactgaccagagaaaatggcagaccggtccccagctagcaagaagcgaggaaagtgactccttaattagctagctatacatacactacttaaaaaacgatttattttcgtgatacaagggttttatttttactaatggatctaaaaaacctcacttgtaaaaatcacaggagatactaaaaacctagccccgctaataaaaatgtcttatgagcaccccgctagtaaaaatcgattttactggcggggtctatgagcgatcaccataaaaaaattgtgggaggcataaatcacgtggagactacgtccaagtcgtccatttcctctccgccgcatctctcccacctctccctacctccgagatacaccgaccacctctcctctcccttcccctcccaactctccctcaatcgtgggtggtggcggcggcaaggggagctgcggcggtgcggggagggttgggctgcgggcggcggggaggatgacagattcggcctgcaggaggcaaaggagaggggtggttgcggtggaggaggtggatccggcggcagggaggggcgttggcggcggacccgtggccggaaggtggatccgacgacggctgccacgacgatgacgatggttgccacggcaacgatgatgacggctggtcctcgagaaggttccaggcggctcctccaaccccctcccctctcccagatccgttgtgcggtggcggtgctcaactagtgtttggtattcgtctctcagcgacagcgacgatgaccgggagcgatgatgaattgacgatcctatctggttagtttatttggagatgggaattgatacagttgaaaacatgtgaatggaaattcatgactataaattgtgatgatttgtggattnnnnnnnnnnnnnnnnnnnnnnnnnnnnnnnnnnnttagggaataaggatttgggaataatttctgcggattttgggattcttggcgctaatggaggcagacggagcgacgtcgctccgtcatttttttagtgctggctagattatcgcaggcggacgatataatatagccgcctgtgcaaatttattttcgtaggtggctaccttacgaaaaccaccaatgaaaatggatcggcgttggcggttggcgaacaccaatgaaaatattgtattatcattggcctttggtctctggcggttccactggctacttatgaaaacctattttggccgccatgaaaaattatttttaaagtagtgatagcaagttaaataatatatagtatgggagttgaaagttgttatagataggggtgaaagtggttcggatagtttccatccgtccggaccatttttcggattcggatagtttcggtcggaactatccggaaattctcggattcggaaacgaattcggatttttttttctcggaaacgaaaacgaatacagtaagggtactatccgtcggaatcggaaaacggtcggaaactatccggattttttttcggatatccgcagacattgagcaaagtttagaaaaaacatgtatatatacataactttttcatacggaatcagatggagacaaactttatatcaacattgtagagcttgatgagacctacaattttcttattgactattttattatttgaggtcatttaatgagtctaaatattcattataatataccatattaatttttataaaatctcatatctacaattcaaacgacatctgatggagatgtgttccatatcaaagttatagagctcaacgggatctaccactttgtagtttataacatttgtatttgaaagcatttaaagtataaaacaaacattacaagttttgaagatgtaaagtaaaataaataacatctccaatttatacaatggtaagtaagttatacatctagtaaaaggtcttgggaatagaaaatgataatcatatttgcatatggatctctaagaggaatagccatgaaaatcgattctcacatagggttgtgggaccgtctataaaattgacgatacaaatgttggagatgttgaactaaaataataagcgatatctcttccttgatcaagaaactcaatttgaggggttttttatataccggtaaatatccgctaccgtattcgttccgtctcgtattcgctctgtatctgtattcgataatattcgatttcatttccgtatccgagttttcgattccgattccgattccgaaaaaaaatatgaaaacgaatatgataaagctagtttccgtccgtatccgatccgttttcatccctagttatagataaacaagatagttgaggtgtaatatatatgtttccataattaaaataaaaacaaggagatttgcaaaaacaacaaaaagaaaataaataaaataagggtgcctttaaccgaattggctgaaaaaaatcaatgaaagaaatatattttacctcccaaaactattggccgaagtttgcatccccaattatagatagtgtgacttcctcaagtaataaaaccggttcattttgtttccttcaatagttttgatggtgctttgtcctatatggtgcttgcatgcctttatcgtgagtaattggtccacacatggggcttacgtagcaattctctaaaaaataaaagaaaagttgtagagttaacatgccaattgcaagtaaaaaaaatgtagggtttgcatgtcaagcttcctcccccctactccttccatccacatccacctccacctcctccttaccatgttatcaacgaagacccgcctccctctgctgcttccaggcttgccacagcggtgtggtcgagcgactggttgagggcgagccccctgcgccgctaggcagagaccgaggcggaggagcccgatgttgcagatggaggcgagccaaagaaggggagggggaagtataggaggtggggccattaaggaagcatgaaggggatcaggatccgccggtgagggctcatacgaaagggtctgtttgggggagtttctagcagctgctcatgtgtgtgtgcgctctgtaatatatattatctatgtttctacatcaataaataatcaatattatctttgttaatgatattttatttatataaggtatttgactagttttttaacaactggaaacatatttttgctaaacataatttagaatgctataaagattaataatgttgaacgatataaaatgatattttttatggataaattagagattaacaattgttatgaatccaatgatcatagtgcactatgtatactattcaagtgtgttgcggttcacaatttaatagttaaatggctatgcattacaatgggatctagatataaaaatatgatttagtttatttctaaaatgattttttatgatgtattaggtttttatattttttagagatatattttaggacatagtttttaagaggcatgaataatttttttaagggggaagaggattaatgcactgttgattcttttgttttttttaagttttttaatgagaagaaacacttttgaaagcggtatggtctacttttagattaattaaaataactacatggatatcttttaacttacggtaataatatgtaaacgctatgtggccaccatataaaatgataaccaaatcaatgtatcgaaaatttaatctaaacaaccatcaaggaagataaattagcccccatttaacagttgagggagattttatttgtgcactgcacaatcaatgttagattaatatatacagtataacaagctgataacaaaatgaaaacattatattttaacctcaagtagttaagtctacaaatactcgagttctaacttgtttctcaatgtcctactttgatccctctacttatactttgttagtttcttactttatctctctacttactttaattaagtcctagtatgttaaatacgttacggttttaaaagtttagtaaattattattagaggaggaagaggagaagctacgacaaaaaaagttagcacgacagggccagattgaaacacgacaaaaaaattagcacgacggggccagattgaaacacaactaatgtgtgttagctatcatcgtattttagaatcatttattaaatttgtgtggtatgtctttcatcatggtacaaatcggaccgcggaaaacaatttatatcactataatattaatgctgatggtaatattcaacccttggagaagtttgggtcacattttcagtgtgtgtgccatctggatgagtttatgacatgatagtgatttcagtaagtcaatcactggtatgcccatgaagtatgatgttcttcctatttgttgatgaatatctattaaacaaaaataatttgaaatcaaatcacattacatatagggttaagtccttgtataccttcataaagaaccgttcattggagaaagctagcctcaaatcacattacatgtagggtttccttgtatatcttcataaagaaccgtgcatttgagaaagctagtctctttagttggccgtctgatatatttaaagatgtgaaatgcatataggtgatctggaaactaatgcataggtctaatctctgttattataaaaattgaagatgtttttgctggtattttggtactcatccgggcatgagtcggtttttaagtttgttcgcttttagaaatatgtaggttttaagttcgtttgctttagtaaatataaaaggaatcgtacaataattctctttaaaaaacttgcatgctaagttgagacgatcggactcctaattgcagctcacgattttcttaaaaaatatatataaccaaataagttcccacaggagattttatcttaactaaaacatataacaataataagattaaaatagtctttacccgttgcaacgcatagacattttttctagtctatttaaaagtatgaaatacaagtaggtgatcataggaaactaatacttaagtgctgatagagtgtgcaaaaaaaacacttgatatgtgaggaggggctctcgatcagaatttgttaagacattatcacacatgggaaagatcttgtgtgtttttgaacgttaaacacgctccttctgatctctcgtagtgagagagggcttgttcggtagcccattttcacagctgtttgggctgtgctgcacagcccagctgttcgactgtagaaactgctgtagcccctacagaaaaaactactcccctacaagccctacagggtacaacagctgttggctggctgctgcagccactgtagctgatgctgctgcgcagctgctgcagccagtgccaccgaacagacccagaagtgaggctcgaaccgtgctggcatcttgtagtgctagccgaaaggccctatatcttgtttggtggcatttacgaatttagagaatgattcagaaggaagcatggatattaaggatgccaatgtttaagctccattttggaactgtgatattctcctgatttttttatatacggtaattaataattgtttagttaaataaattgtaaatcatagattagattcacgaaactaggatggacgctgtggagattagcgccgatgtgtggatgtgcctcgcaaacagcgtccatactctggtacggctcagtggcgatgtggttcgtcttctcattaaacagattctctcaatagcaagcacattccatgtatcgaaggagatgaaaaaaaaaagagaatgggccatttaactatttgctacttctaaatatggtaattaaggatttgccacttgttgtctataacatatgggtcctcatgtatctatgatatgtgggtatagtgacaaatcctctatgaccatttgtaagagtggtaaatagttaattattcccacgatcctgtgatccacatccacgccgtgcttgacgcatggctgctttagccaaaacaaagaagaaaattgtgtagtttttcatgcgcacatttcctgaactttaatagtgtgttatttgaaaaaacattctatagcaaagttactttagaaaatcatattaatctattttttggtttaaaataattaacattcaactaatcatatgctaatgacttatctcgttttacttgtcttctcaatcttctcctttccactgctctcaaacacaccacaccctaagtattgtgtgaagctttcgttcgtttgactgtgtcgtacttctagatttagttggaatgttcagattctacataagttgcacattgaatatgtttacctatctttaaatcaatatttctttcgttgaaccttttatatgtccaacttatttttatttaaagataagtaaaaatatcccaaataaaaatatttctttccctggcttatttttatttgggatcatggtcttatatatgttcatgtacgcttcctatatgagattccttgtcatctttctgatttgatggatggagtaaaagtaatttactggtactatccgatcgaacaaaattcaggtaattgttggcggtacgatgaaaaacaggtatgctcatcagcaatgtatggttacattatagtaattcgaaaaggggccaaacgagctcagctagtatattaattgtttgatcaatataatgtttgatgtttgaatgtaaaatgtcatatatattttttttccaagtgaatggcacatatctcatacctgattgtctgtcgctattcacaagcataggaatgacataaagtttagagtaaaatatttcattagcacctgatagctagtgttcttatacaagtcacatgtcatgcatgctaccgttccaggttcaaaaaaaatacaatggctccgaccattccagatagagtacttgcaataggaccatgggagccctacgaagcctcgactaaattttttttatcatatatgcatttgaagggaagctatagctttatctaattatatcttcttggatccgccactgtccttaagtaaccaatatatgaactaaaaagatacataggagtagtaggcacctgaaatgctagaagcagccgacggcggtgttctctttggagttagtagatgggggcagtggtgggtgcctcctgggggcagacgacggctacggcctcacgaagttgaggtggatggtgatggtggcctcccggcatccaagtcgatgatgacggcagcctcccggggtagaggcagaaggaggaaattgcttctcgaggttaaggcggacgacggcgacagtggcacctgcctccttgcgtagggccggaagaaggttgcggcggcactccatcctaatgtcgccgtgagcccatgacattggcctcgatgaccctatttttttttaatcatcacgaaggagtagtttcctttgcatatatattgcgcgttgaagtacctagatgttttggtattgtttaggaaactatggattatgagaaatagcttgtgagaatctataaaaaaaaatatggtttttatttattttctagattctatatttctatagctctctatatatattttctcataatctatgtgacagtagggtttaattttctacggtgtgatacgagctggcttgacatgggctagctagctcgaccaagcaaaaggcaagatatgaattttaccttatgcaaccatgccaagtgtacacctcctcttctctctttttgagagatcacttctgatgaaagtatccactccgagggatcacttacgatgaaagtatccgaaagataatgtcacatactccttttgtttttataattcctatcattcttttataagggtgatgtcaaacttttataactttgacaattagcaacttttgaaatattaattttaaggcactgggacaacatgtgtagatgagacttaaaaaatcaaattaaattagatactccctccgttttatattataagtcgtttaatttttcttagttaaagttctttaggtttgaccacatttataaaaaaattagcaacatctataacaccaaattagtttcattaaattgaacattgaatatattttaataatatatttgttttatattaaaaatattagtatatttttctacaaacttggtcaaactctaagaagtttgactaagaaaaaagttaaacaacttataatataaaatagagggagtacttattaaggtttttatattataatagaaaattatattcaaagataggttttggagaatgtgtcgctgtctatatgacatgaattatcaaatcggagtgagtatgtaaataccctgggtaaaagtgaaagtgaaactaaaagcaaggaaccatgacgcatatgtaattcctcttcggcttctttttctttttccctttcctctccttatctgcttatattttcgaaatggagggagtatattagaatcttgtatcttgatctttccacttatgcttatcagccaaaatttaattttttaatcttaaatttggaatttggagctgattttgagttttttttttcattccatagtttatttttcagtctttactcttagatcgttaagaacatgtatataaaagttttattcacaaattatttttcatttgcaaatatgccatttcgttttttcctccaatacgtcaaacgatgaggctaaatacttatcaactaagagtggcacaacagttgtgatgaactctattgaagctcaatttctctgtgggtgcagtccccaggatattcattacactaagttgaagctcgattacaaactactagcaaatattgccaggtcccccataaaagaacccatcattttcaataacagaaatagtgtaacaatttgatataaatccgagacgaaaatcgattggatgggcgttgccaccggcatcaaaaaacttgatactacgaaatgatgcggcgtttttaaacggggcattcccgctgcccattggaggacttggcttttgatcctttctcaaggcatagccaccaaacaatattgtcactggtttatctgacaagcttgtaaacagagatcttggatagtaacctgcaagcttggcatccccattaaagccatagtagatttgccaatcaccggaattttgatcctgaaatcatcaaaatatagtgtcatgacgcatactccctccgtgctaaaatatctcaaccagcatggaatgtgacatatcctagtataacgaatccggacataggtatatctagattcgttgtgctagacatgggtatgtccagattcattatactatttccattttatatatgaagggataaaaaaaaggaatgtaagattgttctgttattaattagacaataattaaaccttggatactctgactgtaatgtattgtttcttgccagaggtggtggaaacagggctaatcaccattccaggaacgatttctgagctaaatacactttcgaatccaggacaacgcatatcaggacaaacattagaaccttcaatctggcattaattggagaatgagttatgacataataaatacaaaatctttattatggcaaaaaaaataaaaataaaaattgatggataggaaactgcagtgtttatgaagaaacttacaaaccaagtactgaagtgcgtctgtgaatcattgtacgattcaggctcaacctgtatgaggtacaatacaactaaatgttaaaactaaaagacatggagcaaatgattaatcaaagtaacttgtttagtgacacatcttcgattgacagtgagaagctcatgaacctgttgagcatcaaccagctaagctaatgtaggcttgaaattacaattccaaatcaagcagataagtttaacttacattccatccagctataactttattcacggcagatgcttcatccgtattgtaaatccaaatgaaacctccggtttgttgtccatgctctagattaaagccataaatgtccatggtggcctctaatccgtaatacttgatagcgtcgtctgaaggaatcgatccatatgctgcaaactgccaaagtacgtatttggtcatgaaaatcatgatcatgagtacaagtgcatcttttagatctagggaaaaaaaacatactccccaaaaaaactcaaattttagcttcctatggtggagttaagaaaggagacaaagaaccaaaatgccccaaattaataggaaagttatattagtaggtacggtgatgggatattgaaagaaatttatcgatttattcatcgatgataggtaagaagatatgagttgcattattttggaacaaatttctaactatgttttatatttggacggaaggagtatatgacactcacataatatactgggtcagcttgagttgatatatgatccgatgaagagaaattcacatgaagtagaggggccatcaatgttcgccaattcttttggacctggttaattgtttgggaaaaggggaacaaatcaatatagactagctattacttctatgtttcagttgaataaaatcgaatttgaattataacaatatatatagctcaagagaagtacctcttcttccattgtaggagagcaacctccaactattgaactactaagaaacaacacacagagtagtgcagattgagtaaaaacgttctccatgttagaagtggggaagggaagaggtatcgtgttttgtgtgtcttttgctagcctgtttcatccgctttatatagatgagtcagaaagatcttcaacttattaaatccgaaatctgaacgaaatcttcaaattcaatgagaaaacaaaaccaaatctttaattcaatgaacattaatgaagatatatatatatatatatatatatatatatatatatatatatatatatatattatttatttatttatttattacagtacatttatagaaaatagactaggaaggaagaaggggataaaataagaagacagctgcaatttggtactgaaaattaaaaaaaaaagtgaaggggtataatgacatggtttcaaatagttgaatagtaatgatatatttcaaaatcatgaaatttatactaacatattaaccctaaaattttattattggagttgaatcttcttttgaaaaaaaaaataatattgtaaaatttatactaccaatgatcaggatgttaggaaacacccaggtgcattacatttactttatcagaacggaggccccacatttggctagatttggaataagtaaactctaataccaaaacaggtacaataaaataatatcaatataaatgagcgcatgaccccattggatcgattagtcttacgcatgcactgtaagtatttttctttaaattaatattgtaaaagacgtaattttatataaaaaaaatcttgtagataactgttgatgctaaatctgataaaacacacgaacattcgaaagatatgctttgctctagtgtatgtcctaaaatacgacaaataagtgtgtatgcacgtgcaaccgtagaagaccgtatagaacacatcatctccaactcagcaaagttatcatgacatggataaactcagctcgctttggcttgcaaagggataaaatctatggccatttggtataattttgtttttggcttttccaataaatcaaatactctatccgtcctgaaatatagcaacatagtatcaaataatatcatatttgatataacttataagaatatgaaggaagtagtaattaggatatatttagtactaattagtactaaaatttttaggatggagaaagtactaatttgtactctcggttcaaaatatagcaacctatgactgggtgtgactcatcctaatacaatgaatttggacatacatacatatatatatatatatatatatatatatatatatatatccatattcgaatttggacagatatatccagattcgttgtactataatatatcacatctagtccttcgttgctatatttgggatggaggaagtaagaaattagcagactagcacaagtaatgtgtatttttttatgtattttattacaaatcttaatatagaataccttgaacatatgagccttgcaagaactaagataggtcaaccacaagtcttcatatcaattttcataactataaaaaaagtagccaaatggttactcataatcttttgagaacaaatccatgaatatttgcccgggtttcctcacccaaaaggtataattatatcttcatggaacttaacttatttctctttttttctgccaaaaaataaaaataaggagatatgaacgaccgaataaggcagggggagagagaccaaggagtgacacacagactgtattcacttcctcttgtctctcaaacaaaagacaaaaaaaaattaaaaaataaaacaaaacaaaagataaacaaacaaatcaatttagcagaagcatgagcattaccatgataccatcagatcaatctttttcagaaattacaattaccagtgataattcacggtggaaggcggtgacgacgacggcgacgatggcgaccacgaggagggctgctccgggagacggctagggttagggtttggattttatttttgatttgggatgttgattttgtggggattcttggtttggatttgggattgcaattgagtgattttgtcattcatgtattttgggaattgggggcaaaggggttgggagcaatcggctgatctgcaaggggattttttttaaagacgggctcagactcaaacgacgacgacggacgaagcggacgatcggaagccttaagtattttttaagtaggtatagatttcttgcgtgaattggattggacgaacagatgagttggggcttaatcccaatctagaagttgcttgtttaatctggagaggcaaatcctgcatatcacaaagaaagtcagtataattttttttaaaaaaaaatacaccaaacttctcctacatataacaaagaaaatcagtataaataaataaaagaaagaatgcaccaaacttatggtgtgtcccatatagggtatgtataactgaatatcaatatatatttttttaaataacaattcaccaaacttaacttttagtatatctaaccaaattggatcctctgctattaggtcacatgactttgagtcactgacatgtgatcctatagtagagtggtctcacatgtaagcgactcagtcacctatctttaaggtagaggatgtgttccttatctcacatacctgggtgtgcatggctgaccattgatccatagtattcgctgtggggtgcgtatccgatagttggttcatggtatgcgccgaagtacggcggcggcagaaactccgacaaaggataatgtggtggcggcagcggcgggaggaaaccaatgtgagagatgatgtgttcctgtccatgcccaccatggtgatcacctctccaaccgtcacgataatgcctatggaagccatagacaccacggtgtccacttccatatatagccgtgtcccggcccagggcggccaccatggtggcctccctcgccgagacgaaggtgctcgctggagtcacctcggttctcttggccctgatgatggttgatatccgatgactaggaaatcgtgggtctatccgactacggaggcggtggcggcgacgtggtatacgtcggagaggcgatgaacttcatcgtggatagaggtgcggcagcgtagtaggagccatctttcctagattcagaaacaaatcaatctgctcagtagcagcggtgggtcttggtggcggcgtgacatgcgacggatcagcagcattagtcgacgatgtcaatggaaatgagtctgcaaccatcagtccgaacgctgccagtagatcgatctgctccgcggcgatggcggctgcaacgacggcggcgctactttcgccaagaaacgtacgtctacccacaggtgtacaggttgctatagaggaacattctcccacggaggggagggtataaattggtataactgcaaaattgagattcgtataggattcgaagtctcttatggaacattgacacaatcctaatcctaatctaattcttaatataactgctaagcacacatatataataataatgatattagtgactagtatatatccagattcgctgtactagaatgtgtttcatccagttctacgttgctatattttatgacagaacaaataagaaattagcagtttagnnnnnnnnnnnnnnnnnnnnnnnnnnnnnnnnnnnnnnnnnnnnnnnnnnnnnnn

SEQ ID NO: 27869 - DNA, 40117 bp, Oryza sativa
aacttcatcgtgcatagaggtgcggcagcgtagtagaaccatcttttcctagatccagaacaaatcacatctgctcagtagcagcggtgggtcttggtggcggcgtgacatgcgacggatcagcagcattagtcgacgatgtcaatggaaatgagtctgcaaccatcagtccgaacgctgccagtagatcgatctgctccgcggcgatggcggctgcaacgacggcggcgctactttcgccaagaaacgtacgtctacccacaggtgtacaggttgctatagaggaacattctcccacggaggggagggtataaattggtataactgcaaaattgagattcgtataggattcgaagtctcttatggaacattgacacaatcctaatcctaatctaattcttaatataactgctaagcacacatatataataataatgatattagtgactagtatatatccagattcgctgtactagaatgtgtttcatccagttctacgttgctatattttatgacagaacaaataagaaattagcagtttaggacaatcaatatgtattttttatctattttattataaatcttaatatagaattccatgaacatatgagccttgcaagaagataggtcagccacaaatcttcgtatcaatttttatagctacaaaagagtagccaaatggttactcataatcttttgagaatagatccataaatatttgcccgggtttcctcacccaaaaagtataattatatcttcatggaacttagcttttttctctttttttatgcaaaaaaataaaataaaaataaggagatatgaacaatcaaataaggcagggggagagaccaaggagtgacacaaaactatattcacttgctctcgtctcccaaacaaaagacaaaaaaaataaaaaatatatataatcaatttagcagaagcgtgaacattaccatggtaccatcagatcaatctttttcagaaattacaattaccagtgataaaattttttatatactttacaaacacatcggaaatgtttaaaaagaaaaaaacaataattcccatgacaaaaacgcaaggaacaggaaagcaagaactgaaagaaacagccaatccacagggcaaagccagcacaccgttttctcctacggttaggcacggaattaggcgctccgatttcttcctggccgccggattaatcctcccatctcctctcgaggttggtcaccttcgatgcaccaaatttctgatcttcttttttctttttcgcataatttttgggttgggtttctattttagggcgtttggaggtggcgaaattttttgctagcttctttatttctttctgtttcttgcgtgaattggattggaggaacagacgagttgggggttaatcccgatttaggagttgcttgtttaatctggagaggggaaaactgttttcattttgagaatcttggatcggcgaggcgagtttatccgttggttggcttcttgttgcaggtgaggagtggtttgatgctggtttctttggatttcttgtactccaactcttacattttggcctagattgcgcgttaaaaatcccatcttggagtttcttgtgttggtgattccgacttgagctgctgttgttcgtgattccaactcgatgatgccttctgatttggtttttcaccaaactgaggtaaaaaaggagtttttgggtgtactaagatcctaatgttttgttattcatagtctagaactctgcccttagtttcaaaaaaggatcaaaatctgccctgatttctttccactctgaagcttagtattttacaagggaaattgggctgagatgaaatttgtacttcgctgctacaaattttgggatcacagattcaatcaatccaactagttttttaattgattcttacgttaaagctcctgtttttgcatatttagtgtggtccaaattagatctttgagtacatggttccgatctgagctgctgtactgtactattattgctccttgaaatcttgattgggcttttcaatgttatggaatcaagggatgctttttaggtgaagttgtgtgccatctgatccagattggttgattggtctaccccatctgacagataagaagaggttttcagtttcagaaaaaaaaagattagaagaggtttgacttttcctaggaaaaaagttactaccattttctggggattcttccatgaatgtacttccggatatcataagatgttcctagttcttggctcaaaatcagaattcagaaggatagccgatttgtctgaatcatggtctaggtaattttggttaaaatgcagtagatagggtcatagggagtgaatcctttcacacggttaattaacggcttaggtagaatgtctagttgatttaggggcttttcttaggcctccttttgtactaaggaaacaagccatggctgctcagagcatggaaactggaagctcttatagtatagattgtacctggagtcctggacttgtgaagcttaaatgatgcataagtgacagtcctgcagtttagtcatctgctccccctttgttcagcttccaactttgagctgtagaagttggtccgattccgtttgattgctaaaaatggaagggaaaaagaagtcggtccagattctgatattgttcattctggatttgctctgttcattaagtagttttgtgaacgcatctccgaataagggacaatatcttgcttctgatagtgtaccagttgtccacgaaccatacttaatgaaatacttttgtagttcatgtcaactcttgaatgtttaacacaaccccaactgagaatctggtgcattttgttggagtttggtcaatttacttgcgtactttcacatcaagatgctagaactgtgcacccataccttttgttctatattgtgttgcctgattcaatgagcgctgcgttgcttccgtcgttgttctatggcctcaacaaatgatgttacaagttagtggggtaccttgcaaactaatctgattggactcagcactatacctccagggtagttcttttattcggtgactgtaaggtctcctagatttcttctttaaataaaatttagcagatctttggagtgatttaatcaatgacagtgtctttatcccacttgtatgctttacctagaaatacagttatatatactttgacaaaatgacatctttgttttcttatccattcatgttttgttattctttcagtagtgcaagtgcttacttttactttcctaatggtctgccttttgtaagcagggtcaggttcttagtgagagatgatgaaactaaaaggtacaacgctacataactttagggatagcaatctaaactttgctgctgaagggatgcctgcagtgaagaaggatgatgttagcacgcatcggccagttggtatgagaaaaggcagatgggttcttggtgacataactgaggttttggatcgtaattcgtggaggcttgggaagatcgcaaaggtgctgaaggatgactatttcgtcatcagggtaacaggttgcatgcaaatgagagaattccacatatcttgcttgaggtttccacatgcctatcatggcaagcagtcagctgtaatagacaaagtgagtactgattcccacgcgttactctttattacagtagctagtcgtttcagtacttcaattcgttgtgtggttagctcatgttcttccatgtttgtgctttgtagtagtgcatatatgattattagtggattctttggacttcttaggaagagattatgttagtatgtttgtcgaatttgcaaaagactccattgagtgtatttgaacttcaactgatgatttagattctttattgaaaatctgtaaagcttgttattgcttccgctagtgtgatttgtttccaataagcatttggctacaagattgatacgacagcagacgaatttatttgacatcagtagtatgacatggcatgctcaagtactatatttcattactagttgggtgtaattattgcaaattttgtgaaatgactgaaattttgttcacctctctagtttcactcaggtttttcagcaagcatttcattgacatggtaattaaaaagtcattgcccccttttcaggtcagaaagcagagtgaaaaacagacccaacatgttgatcaaacatttcatcactcaaaaatggtgatggaagatgatcatcactccaatgaagctaatgatcacatcactaagaggcacaaagcgatcaatctctgtccttcctctagtgcaagaaatgtgaagaaaaaattagaactgactaggatgccaccagatgattcaattccaggagcaagcaagaaaaggagagtagatgcacatgaagttcatcggcaaaccaggaaaccacagcctctgaaagtgtctgcaaagaatgacatccacagagatctcttttgtagaccttctagtgaaagatacaatgatcttgccaagaacaacttaacaaagagaaaaccagacagcatagttcgtcctccatcccaaatgcctcttcaagttagagaagaaaacgagtgttctgtggctagttgtagtgtgaatttctcagaacactctatgaacactgacacacaatctgtcggagtcaggaacagcttccctgatgatgccatgtcttcatgtccatccatgcttaggcaggagagtgacaatgtccatggctgtgatttcaaaatggatgtccatgagctggagctacaagcatatcaatcaacagtgagagctttctatgcattgggaccactgacatgggagcaagagtcacttctgacaaatctgcgcctttcgcttaacatcacaaatgaggaacacttgcttcagttgagacacctattatcttcttgaaccattgaatcttctccaatatcagataagttgagaactgaaggctatacatctaacggttttcgcaagaacagtgtgctgttctgagctcggtgtatctcttcgtctccatcttgtagatatctctggagcttacttcctcctttttccacctttgatggtgttgtaaatataaaaacagttgtggaaattttactggtagtttattgtatttcaccaaacttttgttgttagaagtaaatgagaatttgatggtttttacttccaggagcatgaaaagctacagcaaaattatggttttactttcaggacaatgaaaagctaccgcgaaattatcctacttgaatactggtccattgtgttatttgtccagatctgaatatttggtacaagaggtgcatacactcttcacttgtttattactctgtccatggctgtacttggtgattctagtgatagttatgtttcatatatgtacctgatgaaaaatcttgacagattaaaatctgatctagaacctacctggaagatgaaaatttcttggatgatagagaatgtacagaatttcattgccatatgtatggtcttttcagccacaggtataaaatgactccacaaaggcaataatcagtacacagatactcttatctgaacaatggataaacatcagttttgtctttataagagagttgtgggctgcaagtgacagaatttaaaagagtgacagaattaaaaaaaggaactgcaagtgacagtgcactgaaggctgaaaacatatatgcttgtgtccttttctctccctctcaatgagaaaaaaaatgtttggattttgtgttcaactatcaagtggtggtccattgtcattgttattgtcactattcatgacaaaaagattgagggcttcctttgagagagagagtagacgtatccacatatcctgaagttcaaattttgcatgtgagcttcggcgaagtttagagggcctatgtgtaattgttaacaccaaaaaagtcgatcagctgagagaagcctatctagaagagaccgagttcatgaaggaatcgtgaaaccatggcatggcagtttaattctatcaattaattaagcatgatcgtattcgatcaggactagtatcaacctgagagtataaatatgtacacccgggtttttttagtctatctccacatatcaatacaaatactttcaatgcattgccacccttattccaacgagttcttagtttcgagtagggctacatcggttaagttcgatctccagtgaggaagtaagttctatcaacttcgcctgtatcggtgtggctagaactttcttgattaagtctgatagtctatccaagttgatgcaagcgttgcatattagatatattaattctatctttaactgcatcgctatttacagtcgtatcagcttaattatgactttctcggataggtctgatattctggataagttgatatttctctaagcgtacgttgttttaaattgatttgttatatacatcacgtttgtgtagatctatcggtttatatagtttatttattagatgtgatctcgtactgtctcggttaggtctgatcctctagattgttgctgataatcaagtcttgctaagttgataggttttgtgctacgttttattggagggctaaccgataagttatctttatattacatctagtcgatctacgaccgtagtacgactgatctattttctatcggtttagtttgttaacttcaactcggttcagaccgatctatcaagtaaccgaacgaaagttgatagctcgtaggtttcgtcccttcggaaagctggatagagctgatatcattatttatgtttatctgcatgtaccttactagcatcggttttctagccgatatataagtgctttgacagatattggcttcatctgatttacatcggaccactagcccgatgtatgccgtaatcttgtatttactactctatatcaacatcggtcgattggtttattggtacaattttgtttatctattctgtcagttgtggtatcaaacttactggcacgccctaaacccgattgatatgacctgcactagagctaagcggatctcccatgtcttcgtgtgcgacgaatttcacgtcaatagtaatgcgttcaaaataaattttcaaattatttttctgatgaaaaattcatgttcgatttttcaacttcgaggaagggggattaggagtttattagaggaagttgatgtgcttgctatagagattgagaatcgtgtttgggaaaggggattgggagattaagagaaaagttgatgaccttgggtgtgttcggatgctacttttcctaacctctctcactcgttttccgcgcacacgtttttcaaactgctaaacggtgtgtttttttaaatagtttttatataaaagttgcttaaaaaatcaaattaatctattttttttaaaaaaaataaatacttaattaatcgcgtgctaatgtaccgccccgtttttcgtgtgcactgtacaccgttcccatcccctggtagcgaacacaccccttgtttggttatagagatgagaatcaagcggagtttaggtgggagattcttcttttttcttttctaaacataatatagatataggtgtccatatgcgcgcagacccaccggccaccgctatccatgcacacacttacaacctatccctattagcacttttaaagattgaccaatatgtcttgagattgatgaagttattacaggtgcttcgctgtggaaggatttatcacctactactgaaagaattagaaaaaaaatagagctacaccgagaaaaaagatggaaaaatatgattcctcttcaaaaaatttaacaccaagcgtgagataaagaatttcatttcatgtggaataaagaaattcttggactacgtggtactccctccgtccaagttttcgtgcttaattttaatcgccgtcttatttaaaaaaattaaaaaacataagttacatattaagtactatttatgttttatcatataataacaataaaaatactataaaaatttcaaataagacggacgatcaaagttggacgcgaaaatttatggttgcgtttaaaatgggacggatggagttctaggaaacaaagtcaatcagtcaatctggaccgtccacggcagaagaagttggaagccgtgcgtatacgttctctttctaaagaagtcaatcagtcaatctggaccgtccacgtgtacgttttctcctcttttcctcgcaagagaaaaaaaacagaaacaaataaacaaacgaaataaagggtaaaagtcaaaagtagaaagtgctcttcgcctcttcctcctctcgcgccgccggccaatcgccggcaacctcagcccacatcaccggagagaccccgtcggctcgccgtcgccgctccccttgccggcctcctccttcccaccgccccgcatccatttcttcctccagcgaggtcagttcccccgcaaaaccgcccttctccctcgtctccggcgcctcccgctgccggatccgccgccgccgcctcctccccgggcctctctctgatcccgtattcaccggtgaccacctttactccaccggacagagcatgcagaggtggacagattgaagtaggaaaagaaaatgatcactcctcccgtcgccggtgacaccttcgccggagcgccgccgccgccgagtcaggaggaggatgctccgccgtacggctcggttgtcctcggcggcaccttcgaccgcctccacgacggccaccgtcgcctcctcaaggtgcggtgctgcgagcttgagaaaaaaaaaagaagaggatttctatttttattttcctcctaaagaaccgagcttagtattaatcctctttgaggaataacgaatttttcgatttgttgggtgtgtaggcctcggcggatttggcgagggatcggatcgtggtgggcgtctgcacaggccccatgctcgccaagaaagaggtagaaatgacacaccatttttcaccggttattggagctgtgatgctagctgctggttgtgttcttgatttccaccctctgtgtgtgtgcctgcagtacgctgagttgatcgagcccgtcgaaaagcgcatgaaggctgtggaggattacatcaaggtgggggataatcttgcctactttattatgtagtatatagtttctgttagtaaatactcctacaaaggattggaacattgggtgatgactagtggaagcagtttgcatgaattaagttactgagctgctttttattgctgtttgtgagacgttgtgacaagatgaatcttttctcttccaaaaatgaaggaaatcaaaggtgtaattttcagttgatttgggaggcggtgtataatttattctggtacaaagacaattcagtaaaccttagatttcgcgcatgagaattagcttctctcatgtggcacattactttaggtgagtaataagaagttatacagtgaattggtttggtgaagagttatgtggcaatttaggaccaacttgctgcgaaatttgttccataacttccttgtactgaagacctgttcctagtcgtctacattttagaaaaatatagaattttggaattgcatgcttcttaacttgtaagggttattccccgcaaaaaaaagaaaaaaaaacttgtaagggttatcagtttcacataagtacatacccaattaagcatgttcatacttaggaggagctgccaaaagtgaaactgctgcttctgggatgctcaattatgatgtttgttgaaagctcatgattggttttgtataaaatgcagtctgttaaaccagaactggtagtacaagtggagcctattgaggatccttatggcccatccattattgatgataagttggatgccattattgtcaggtatggacaatttgatcatctcttatctgatattaagtctctgtaatttttttccctttattacttcatgcatgtgttctgaccaaaattgaaattcattcatcaaacagctacggaactatattaaaaatgtatgaaatatgccatgcttaaataatgtagagttgttcgtgcttactttaaattttctcctttttgtttttcctcatttaacctagtgatgctgcttatgttcagtaaggagacattaaatggtggatttgccgtaaataggaaaagagaagagaaaggactacctttgctgaaggtgtggtgttcatactccctagaattatttttttttaaaaaaaacctggtacaagtacaagatatgcttcatagtgatccaaatattgatgagctcaattgcaggttgaggttgttgatcttctatccggaggagcagagggtgagaaattgagttcatctgctttaaggaagcttgaagcagagaaagctaatcagcaagaaggagcagcatctaaaggtgtttagctgtttagggagtaaagtgattctggttggctgtatactaaaatcgagtgaattgcattttggaccccttttcttactataatttcactttggacccctattatttccttttgcttcattttgcacccccccccctttttttttgcccttctcctcaaactcaggcacatatccactgccagtattatggcagcggctgcagaaccgcggaagtggtgtgacctaggagataatgctatttccagagctggagaagaagaaaaagggggttcaaagtgaagcaaaaggtaaagcggattcaaagtgaaactatggtaacaagagacagtccaagctgcaattcactctactaaatcctgaatgatcctccatagtctcaacaagtaatctgaaagtggtattttagttacctttttgaggaattatgtttgaaacttgtcccagcttccagggccctgtaaaagtattacttcactctgaatgatatagttgtacaaattcaatcttagctcctgggaacttccgcactaaccaattttacacatttttttatttcctacctttgccatgtgaatgtaaaaaaggaagtcaccttgacgttctttggagtaatggtaaatcaattataaatgaatttgctgccccttctgtgatgtacccatgtgatgtatatcttcatcagagctcatgcgatataattctttgcttgatttctgctccagtgttgttcatggtcctcttcacattgaccaggtatgctcaatttactttggttgatcatgagttctccttggtcgtagacctatatatttatctcatagagaattttttatggcactaaagatatatagtcatttacagatcattaaaagcagaaaggtgtcactgttagccttttctttttacttaactagcaagatctataaacatgttttatttgtccacattagagttgagaggtgtatacctatcaatttggattatgtggattaggattaccaaaatatgggttttgtctatggtaagttggtaacatttgcacccattttagtttgtgaacttaaagaaatccataagtttacacaataaaatattttcacttgcagaagtaattgtgtaatcacacatatgctgttaatcttccttagaactgaaaattatgggtactttaaatgatacttgtattttagactgttatgggcagctcttgtaactttcattttgaatttgtgttattccaaaaaaaaagctgtttatgtagcataaaccaaacaaattaggtgtaatgtttggatgagaactaaaaggactgcaagatgccaagtagcaagtcccccatacattcctgtccagaattgtcatccataggtttacaatccccaacccacatgtccccatcaatggagcaactagaggagatgaagacaaataaagccatcagcatcctgaattcctgatggaatagaagcttaagccttttgttgcatcacaaaaaaggtctatactgtacacgactacacacacacacatgcttacatacatggctgttgcatgttctcaagttcctgtggcttggcagctgaggttaccatggccaagaactagctccctctctcctgcatcgtacaggcactcatatgtgatctactgatcttctatttatttgcattgtaaatctaccaagaaacctcacaaatgaagcataggagctacctagtccattcctgtttgttgattctttcgtacataaaaccagtattctcttgcccaacgatacactaagccatacgtgatttgatccaagttttcaaacaacaatgaaggaaatggtttcttcctctacatttagagctcccggtggattaggattcttggggccttccaaaataggtttgattcctttgagaaatagaagtggtgtgagatcaagggtaaagtatatcgcaccaaagtgcgcggtctcctctgctaggccagcatcacaacctaggttcatacaacacaagaaggaagcattctggttctataggttcctttccattgtgtatgaccatgtcataaacccggggcattggaccgaggacatgagggatgatgcattggagcctgctgaactctaccaccatgggctcaaggttgtcgatgttggtggtggcactgggttcaccacattggggattgtcaagcatgtggacaatgagaatgtcacactgctagaccagtctccacaccagcttgagaaggccaggcagaaggtggcactgaatggggtgaacatcattgagggtgacgctgaggacctcccctacccgactgacacatttgatcgctatgtctctgctgggaggtgattctctaatgtcctctttgcattgcagtttacggtattttctcaattgtgtttcccatgagcaacccatgaaggtttattctgtcgtgtttaataggacatatagcaacacagaatcattcttataatttggctataagaagatgcaggatttattaaaataaatataaaacattttatgtgctgtcttgtatagatatgtgttcaggattgtgaagttaattcattcttggttgtgtttactaggataaaccaatatacggtatgtgtgggcacaacttaagtttggtcaagaattttctctttgctaatgtgaatgtgttacacttcacatgtgaactgtacaataacattttttttcatctatcatcaactaatgccattattttgtcattgcatatccttgaattgatattgatgtatagatttctgtatcaatgaaagaaaatacctgttaaattctatgtgatctagcgttgacaccatgacaaaaccatctgtttggatatatttgcagtagtgtggtttctagtaaatggttaatgttatcagtgattcaagtgtccatgatgagatgtttatatatttgttggatcagatttctgttaatatgataatactggctcttatgattgttttgacttatattgtccatgtgaagatgttaagtatcactcctatccaatgaatctattacctgaaatgtgaaagcaatatgcatgtggtcatcagtgacctgtgtttcatttacttttaagcttagtcatatgtggtcattgatcagttttgatgccatacttaccaatggtgttgttttgtcagcattgagtactggcctgatccacaacgaggaatcagggaagcctacagggtcctgaagctaggtggagttgcctgtttgattggcccggttcacccaaccttttggctgtcacgcttcttcgccgacatgtggatgctcttccccaaggaagaagagtacatagaatggttccagaaggcagggttccaggatgtcaagatcaagagaattgggcccaaatggtaccgcggtgttcgacgccatggcctgatcatggggtgctctgtgacaggcgtgaagcgatcgtctggcgattcccctttgcaggtattctttgcatctcaatgtgttctagcttcatattaactcagaattgctttcttgttacaaacatcaaatgttaagagcacctaaatttgttaacagtgagtctaacacacctgagttctgtgtcatgctagctcacactgatgtgctttgttatctggtttttcaccttttgttcttgttgcagcttggtccaaaggctgaagatgttgagaaaccagtgaatcctttcaccttcatcttccgcttcgtcatggggacgatttgcgcttcttattatgtgctggtacctatctacatgtggatgaaagatcagattgtccccaaggaccaaccaatttaactgtttcctgatgccaagcaatgccaacaaaacgaaatgatctgtgcttcttacttgtgctggtacctgtctccatgtggatcaaagaacagattgtcccaaaggaccaagcccatttaactgttacctgatgccaagttgccaagcaatgtcagacaaaatgacagggaaagttgtgttgtgttaagcttctgttacatgttaggcactgaacactccaatggtctaatgttcgtgttcatgttgtgttgtgggtgctgatggcatgctttgttctctagcttgcttcatttgttcccttgttggttttatgaaccgtcaaaaataaaaatgaggcaatatttaagggatctgaaaaacaaacatggactcgactggaatgcaggaatatgaatataacagttaacagattcacagctcatttttttcttgtcaacagaggaaaaactcgtgttgaaaacaagaaacgtgccaatacaaatatctaaacaaagttaccaacagactttaataggacaagagactatctaaacaaagttaccgacaggctttaataggacaagagactacaaacttccaatcataaaaagacgacaaagggtagatttacctataaattatgcttaggttatgatgcgaagcattttagaacttagaagtctaaatatcatatccaaatagaagatgcataaaaacaacaatctctgaatgagaaacgttacaaaagaagagtacattaagccattaactacatcatcattcttaaagggtagtactcaataccaagctaccatggaacatagggttttcaactcctgatatcacctcaacttctgatatcacatctcagtatgaaaccaagcctttacttccagcagggctactggatcttgaactgctgctgcgcctgcggttatattttgagctcccctttttggcaggagcatctggtgatctggacttcgagggatcacggctcttcgacctggatcttgaccttcctctattgacaggagggctgctattacggtgatcagggccaccaccatcccgacctgatcgaagcctgtttcttacatctcgcctctggtgctccgctgggctgcggctgcggctgtgccttggactggggcggcgatatcctccacgctcacggtacctcaatggactgcgtgacctgctcctgctacggtctctccttgggtatctgggcaatggttcagagtttcttaaaaaaatgtatagctcattgctaaagtaacatggccttgcaatggtaaaaaagggaagcggataaaaaggaaatgtttggtgaatttgaatcacgcaagaaagctgattgatctaagcaaaatatactgtatctatgttaacatgtaacccagtttgaggtttgtccatgcatagcctctgctatctacctaagagaagaattggcatgaaatataaggcaatgaaagcaagttatgaacttgggtaatattcagattaactaaactcttgaaggcatcataatatagttatgagtaaattttataaagtttttataaaaccccactattatggtccaagttgaacaaaatcagatgtttcggcacgttgcacataaccccgggtattatggtactaaataataacaaactacactgttaaccccaaagaaggcatgaactcatgaagagtacacaactatattcaaaatagttcatccactctacccaatcaattggtactgaccactaggagattccaaggataatcagaagaataccaacctggacggactactggctcttggggaaccacgatatcttcttactggtgagcgtgcaccgtagggaccatttcttccatacctgcacatgatggcatccaaacattaaattaatcatcatttttttttaaaaaaatgtggtaaataatctaactgcagtacctattaaaatgattccacctatcatttcttccatcattgtagcgagaccgaacaggggaacgctctggagatggtgtcctgtatcgacgtgcaaatgcatattgttgagtaaaaccacgccccttcctgacacgttgaggctgtccgttgtctgtagagcccattgctaaatctttaccattggttggcacaggttcagctctagatataccagcctctgcagtatcagcaccattgttgccatccacttttgttaaacttgcatcagccctaataggactgctcctagctctcgcaccaggatcatccctgcaaatacaaacaaacatctcaattgggtactcaaaggataaggttatctcaatgttgaacaggacatttttatccctgctaaataccctccagtcacaaaaaagtgacgttttgcacaatgacacagtcatcaagacaattattttattaggaattactggtataatattttgatactatttttaagacaaatataatcataacatttttaaaagttgaattcaaaatattcaaagcaatattgatggtcaaagtttaaacatgttgactgcacggtgcacgcattccaaaagtcacatatttgtgactggagggagtagtactgaaaggaacctgacagtaagtaatttgttttaagtaatcaaaccttaatttactagctttatcttctgagttctgattttcgtacctgataccagccccatttccatctgtgtttgagggtttgcttccttcatttgatatgttgtcaagggtagctgtttgtttgcctttatctgcatcttccaaagtactatctttctccaaacttatagttttggtgttatctggatctgctatgaacaaagctgcttattagttcaaaattgtgtagacaatctcagtacattcaaacaattaaatgcaacacattccatgaaacatacgtcataaccaaacacagcaggcaaaacttcaaggtcaaagatggtaacttctgtcataaattagaaagatgttaccttgttagcaatttaaaaaatataaatgatgaaactctacatttaccatattcagaatcagttcaaagtattctagaatgattttgtaattaaggtcggcaagaaatgataataaacaaaaggttggccaagagtatcgtcaattatgtggatgcttaaagaatttgagtggtaaacagaatcaaaaaaatagttgcagacataagttgttctgtgtatcagaatagaatagatagtttagttgcagaaaaaaagtagatatggacaggtcgcaagcagggattagcaagtgcagtggacaaagtcagccttttgaaccacaaaacagaaaatttaacaggcagagaaaatttaaagtaacacggacaatcacagcgagtccaaagtattaacaagcagaacagaaatctgtgcagttcaatcaaagcagcatattttagactactcaggattttcatagcaaatgaatgtgaattgactcttctattgtcctacctttcttcgaggaatgcttggtacgagtcgtacgacggccttcactttcactgtcagaactgctgccgcctgtctttgagctatctgaatcatcacttgagctcctgtagcttctgtaaaaagctccagacaggggatctttcagcaaatacatcattataagctaataacactaccaagatcatacaggtcatcaacgtaccgtttggatttcctttttgttcctctactctttctcttagtcttcttgtgtttgcttttcccctttgcagacctgtgtttatccttcttcgaactttttcttctcttgtgtctgtggtcgctggatgagctagtatccaatgatgacgaagagtatgattctgattccgagccactatctgaggactgtgtgtcagaataatctgagctataggaatcagaagaataatgctttctctttttcttttgtttatcatgagtaggtggtttttgggttttgacccttttttcagcagcagaattgtcttctgttcttctgagcttcttttctgcaaaagaacaagtagtgagaaagctaaccagacaacacatggactgtttggtattatctgtttatgttgctttttacctttctctccctttagctgattctgggaatcagagacttcaccacagtccacgattttcacttcacaagtaggctttccggtatcagaacctaccgcttcaagcttcttcagcaagggcattccagtgaccaccttcccaaagaccacatgtttgctacacgattataattttaagtcatttgaagttgatagattttggagccattggtaaaaggaagttatatgacttcttatccacaggaaaacaccatagaaattaggaaattgattacttctgtgggcaacatacactgtgttggagccaccacatactctcaaccattacctgacacaacttgtagacacatttaagaaaggagtagggcttaatgatgtgttctacacacacacccactccagagagttttctatggttgtatatacatagacataaatgtgctgtttataagatattatttaacaaatggcaacttttatgtgtgtatgcatgaggctaattgatctttcatggttgtacagaatttttagattcaaggttttttaatagactaaatctctctagaatgttaaattttggtattggtagatatcaagtactatatctttgtgcagtaaggaaagaaagaaaggcataacttaatatgcacaaggaactagaagagagattaacagagaaaattgccaactgactaacagaaagaagcaatacccatcaagatgtggtgttggcatgaatgttataaaaaactgggatccattactgtctggtccagcatttgccatggaaagaacaccaggttggtcatgctttaacttgaagttttcatctgtagaacaccagaaagtacatacaaaaactttagcgaaagcatactaatgcatttgacactaattggattaaaaaaattctatggcagccacaaatttcattagtcattaacctttaaattttgcaccatatatgctctctccaccacgtcctggaaacagcatgtaacgttgagcttataaagtgtacaacagcaagaagtcagttgaaagaagatgcctgggataatgaatcaataccatctcctcttgaaaaatcaccaccctgcagttgaaaattttgataagatgagtatagttagggaaaaaatggatgctagaatgcaatctagagtagatatatcctgcaaatggaacaaaaaaaaatctgggattatgctgtataactagcaagccattcatatctacattctagaattatgtagagttcagcatttgaaatcccataaaagaacaaaaacatactgtgagttgatacaaagaaatatgcagtggccagaggacttggatcatttggtttaattttcagtacctgagccataaaacctttcagaatgcgatgcatgtttgttcccttaaaataaagtggcttttgtgtagatactccaaggcctctctcacctacatatcaaccaaaaagtgagcatgtggatataaaaggtcacacaggttgcaaatcagtgctaatacatcatttaaatacaaactatcatagtactgaaatgataagcctatgacttacaagaaacctgaccaaactaaatgccaattgctcattgaaagaataatgtatctttataacagaacaaatcatgccagaaccattgaaaggaacatagtgagacttttttcccactattctactttagataacaatattaattaccatacacgagcatgcagataataaaactgagtatgacttgttagcattgtaatatactacattcagaactggcatgtgcctcatcactcatgtaaattcacccaacagagctgcggagcagaaaagctcacgcgcatccttatcataaaacattgttcatcacctaaggtttattacaagtcgcatagcgcaaataaatttcctagcgacaactgatccgctacacgcaacttatatcccatcaaacgagtaaaaatttacccgtgcagagagcccggaaattctccgtggtcttcggaacgacatccgcaaacagctgcaaatcgaaggcaaagaaagttagcccaggcagcaacgattactcaaacaataacaccaggtaggcaactagccatgctggaacaaactagctcctcaaccaaccaaccaacctcaaatgtgatcctctcagcggcgcgtccgccgatcgctatgtcaaagaagacatgagggttcttcttcgccttgggcatggcgtcctcgaccaccacctgcgggcgcgcgagtgggcgtgctaacgcagcaccattagcaacacatctcgataaaaaaaaactgccatccaagaagatatagatagtatagatagatggataccaaccgaggcctcgcggcggtggtggcggcaggcccggcggcggaggagagggtgcggggcgcgcggcgacggctggcctagcgctaggggggttcgccggcggcgcggcgcggcgaggggatggggaggggagcgcgcggcggcggcggctagggctaaggtcggggagtggtggtattcgcgcatgtatcgaggtgaggccgtgagggaggtggagtgggccgggccagatgggatgggcctaggtaggatgtgataattttgtttgagtaaatttcacgaaatttcagtcaaattaatgaattatcgcaaaatataccacctccatattttaatattttaatgtacgacgccgttgactttttgacaaacgtttgaccttttgttttattcaaaaaatttatgtaattataatttattttattgtgacttgatttatcatcaaatgttctttaagcatgacataagtatttttatatttacataaaaattttgaataagacgagtggtcaaacgttgattaaaaagtcaacggcgtcatacattaaaatatggaaggattatatatttaagatggtgtattataaaactacggatttaacaataaattaaaactacatgtttaatgctaagtatcgcaaaactacatggctggcaataagattaccacaaaagtacatatttagggggtttaaaaccttatcactaacgctatgttcgagttataaaccaattaaattaatggagtagtactctttttgagaaattcatatagttttatgctccctcggtctcaaaattgtatttaacatgaaatagctacaaaatgcaaaacagaaacagctacgtacattttagtacggatagagtggcatgacatcttaattattaatcacatgtttttcttatttccgtatttgataaccatgcgtgtcgaaggagcccttaaaaatttgcttgccaagtactaataaacacacatgcatatggccacaaatacttgtagtgttatgttttgtgctgttattttgctcttaaattcactccctccaacccaaaatataagacacaaccacttttctctcatttctcataatataaggtgtgcatgcatgcatacattaactatcatcctttagtcctataaaattattttgttttaaatcttatatcatcaaaccttccaatcatattgcttacatgtatcaaggtgttccaaccaagaaagtgattaaatattttcttagtctttgtattatgggtgattatgacttatattttggaatgagtactaaagtttagccatgcaacctttaattggccgtcgatgtgacaatacttccatgcacagtagtgatagtgtagctaggatactactcgtacatgcatagccatctagcctactccatccataaaaaaaaaacttaacctaaaaaggaacgtgactccctcctaagacaataagatgtgacccctagaacaacaaaaggttcgttgtcctataaggggtcatatcccttcctagattaagctttttttttttttggacggagggtgtacatgcatagccctctagcctgtgcttccaccgattgagccaaataatttgtaccacaagcatatcaagagtttaaaatttattgacaaaaatataaacactccgaaatactaccgcatccatcttaaaatataactaagttcaaattttaccccatatatagctaattatagaatatataaaatgtgatttttaccccattacttcacatgctacctggcgcgctcatcatcccagcaaccgttgagacctgccctccacccataatatttataatttccatcaccccaccatctagtaatgagaataatttcaccacaatccttaattacctcaaaatactcctaggagctttattctgggatggagtgaatgcttatcttattaatcaccttgcacttaattgtaaatattttgcatcttatccccgatcacactcacactatacttatcccttctttattaagtttattaaggagcatcaaaatgttttctcctaaccctttattgttactacctccgtcccataataaatttatttttagctccatctatttattccaaaataagttcttttaagtaataattgtatcagagtttgtaaaagtatgaaacaattatattgggaatagataaagtagtgaatagttatatttggagtagataaagtgatgaatagttatattagggtattctattattttttgtttttgcattgatatgtatgagaagagtgaaaaatgaacttagggtgtgtttagttcacgttaaacttagaattttggttgaaatttagaacgatgtgacggaaaagttggaagtttgtgtgtagaaaagctttgatatgataaaaaagttaaaaaatttttaaaaaaagtttagaactaaactcgaccttactccattttagtattgaggaagtaaacaacataaacatatttatagttggggagggaaggaggaagcgcaatcatactccaatgaacactattgcgatgcacaccaatgcgatgcagggaatgcacaccattgaccggacaaaaggaagaagctacggcagcagatagtcgacgagacaagtgatactagactgttgtacctacctaatgctactcctgcatatctagcgaaattaacagtaaaagagtactgatccttttagctagctgtcaaatgtttcagctagctgtgctcccaatgcaatccaagtatctcatcgatgatcgatacggagtacggagtagctgttgatctgacttgggaggatcgatagctgttgatctgacttgagaggcctttgtttcgagtctcaagatcttgtcatttctaggagtacagtatgttctgtcaggatttcatctgaacctcttgtcggccagggtcaatttgaccatgcatcgatctaccgatccgtgccaaatcatcgttccttgatgcagtaattaacaaccaattaaacctcacatgaagatacgagtatgaaattacagccaccatccagttcatcagtgaagaaaagtcctgcttaatttgtggccaataggccaatatgcacaaataaaggctaccacaagctactagtatacaaactcaaaattgaatttacatttggtaattaggtcatattttaattcatcattgccaggttcaaccaaagccaaattagcatcatctcactttccaccaactagaagaataatttggcaccataaaagatatgtgtagtcgacatatatatttttgtcgtaaccacgttcaaattaaagtgctgaaatggacgaatagatgatagtttatctgattttgtgatgactagcattgcccatgcgttgcaataagatttagttaaaagaggaaaaaaatcattaattaataattatcatcattttttatatatcatctcttaatttctacatatatatttgttactaaaatatgagtcctcaggtttgaacctatattatccttttctttctcatcacaaaagtaggaagttgacgatgggggacggtaacatgtggttcatttggtcgtataatatcatttccatagaaaaaaaaatactggagagttggtgatatgatggtatgagagtcaaattaagcatacacgatcactgttcctttttaaaggaatatagatatccgagaatagaaatgtatgaatgaactattataaagttaattaatagctatttaaaaaatagtttttacgaaacttgtaccgtttagaattttaacaaacataccccccatatttttcatccattcatgagattacaaccggatggaatttggttcccaacatgcaaactattactatacgtacgcggccagctccatcgcgtaggcaagcatatatggtggcaatagctatcataaaatcacaatggaaaatatttccatgttttgtgttaaagttaaaagaaattattgtaatctaaagtataacaataatgtaacattccaaatgtatcctaaaatgtactactaccaaacttttcgacatcactactacaaaatatcaaataggtgtcgccactataggcttttttccacctccgcggattgaaatcacaaaaaaaaattgacatctttaaacaattataagtgtcggttctaaataaaaaccggcacctattaggtgccggtttttataaaaaactgacacctttaatatgtcaaaaaccagcacctattctaggtgacggtgggaggcaagtggcccatgccccctcagctgcgggaggcggcatgagacggttggatggaggtagcctgcgcccctcaacggtgggaggcaggcggcccgcgcccctcagctgcgggaggtggtcggacggtggcggcggcagaaggtgcgacggcgtcggtggatccatctctccccctccctctctctttgtgatttgtgatttgttcttattagagttcatttgttgctcatgtgagatgatgttcttgaaattgatgtgccgatgtgagttcatctgagatttattaatgagaattgatgtgttgttcttattcatcatgtggattcatgtggagttcatcggatcgaagtatcggctcctgcgtcggctcgaggagccgtttttttttggctcattgattttatattggtgccggtttttaagattgacattggtgtcggcggactaatcattgccgctttcaatgtcccaaccggcaccgatatgtggttctgtagtagtgcatgcttttgtcatctcaactaaacaaccatctattgttaaatgttcacataatagttttctcatattaactaatcataattattatattatcgatcaatttaagcttctttaaaactctaaacacttatattttgagatgtagtagtatcttcaacagctcaacacatatccacagcctttcactcttgtggtgcagcagcctatgcttgctgtctagacatagctatagctagctaggcatctagggttagctagctatactacggatcccttctattgctagtcttcttcattggcagtttctccctatctagatagacctacctcaggttaatgaattgaagatgctgcatactctctcttccatattaattattttgaacaaagttaaggtcaaacttttataactttgactatcaataactttaaaaatatttagtttaaaggaactaaaataacatatatagatttgtcttttaaagcactataataaaaataaacatgtatttatttattatatatattataatagaaaaacaaagtcacagatatatcttgtaaaccatgtcattgtctaaaacgtcaattaaaatgaaaccggagtgagtactctcatgtaggagcactatgtttatatcagacttgtttagtttgttgctaccatactaaaatattagcaataccaaaacataagtaaattttggtagtgttaatttttttagcaacttatgtatcttattggtatatttgggtaacaaactaaacactaactaaactactattcaaaatgacaacaatctggtagggtaattttggcatcaaaccaaaatgacccctcatcatactgagtgcaggtagatccttctttattttgttccttttcctttcttaacattgttcttggaatctttcttccttgtacttttgttctatgtaatctctctcctgccctcatttctttcagttttgcttaattatcgaccttttcttttaaccagatcgaagtcgcccaggttaacctttcagtgctaaattaattaaactatatatcaccttagaaataatttggcattaattcataggagctagctagctagtcaccagtgtctttcttagagatcccatgcatgaatggtcccagatgctagctggttagcagtgagaagagaacatgtgattccctagtacttgtgtatatactgtataattaatctattaatcttgtgatacaatcttggaactgcccaaaggaatgggtgaagctgccctgccgccagcattgatatgatctacaccatccgtcctataatataagggattttgagcttttgtttgcaacgtttaaccactcgtcttattcaaattcttttgcaaatataaaaaacaaaaagttgtgcttaaagtactgtaaataataaagtaagtcacaaataaaataaataataatttttaaaaaaatgaataagatgagtggttaaacgttacaagcaaaaactcaaaatcccttatattatgggacggagggagtactagctagctatgaaatgatcaccaagaaaaaagaattttatggtcatgtggcctcttttggggatcatatgcattgcatgccttgttgctaggtcatgctggctgcagctaacctatttaattcgtgtgtaaatacacatgaaagacaggcacagattgtgcttgctagctgcatgcattcttcttccaatggtggggtatgtgcatatacttccaaaatataaacagagggaaaatattttctttcagtcactttggacaattattaagttttggattacttagattaattcttcccttcccaagcatcttactgactgaaaatgtatatgttttcatgcattgaaattaatcaacaccccacaagtgtacacatttgaatctagaaatgattatattttggaatagatgaagtacatgttacctcactttgttgcactgtatatatttcaatacttgcaaagctgcagtatatttattctttttacctcactttgttgtagtgtgtactcttgatccacacatgcagccaagggattacttgtcctctttgttctcagtcagcatagacttatgcttaattatttgttgtgtagtagaatttgagccatatacatatttgtctgcatgtatatatgcatgtaaaagatatagtagtttgatcaaagttaagaatagcttgaacagcttcggattagtttatcatttgcattaagattgattatatttgttgaatatatgctagtgtacatacatacatacttaattaatactcactccactccaaaatatatgacgttactactaacataaagagttaaaagaccaagaaataattattatcaccccaataaatatagaggacttttacggtacaatatactgctagtatatatgatctaacagtgtagattgattggattttttagttaattagatagcagtataaagtttgaaagggtaattttatcttttcttcgttattctatcatcaaatcgtgctatcgtcacgtgcttcatcatcaaatggcgctcaagatgctcctcccctagtgcacgataagatccaggaccggctactcccaattaaattcaatctgaaccaaaaattactaaagtgttattttattttctatcaaattcttaacatgcccttctatatactgccagtatatactggtagtatgttgtaccgtaaaagttctctaaatataatgcatgtcctataatgcatgtccccactgggattagagatcaagagcatagagaatttttaaagaaatgaatttagaggagaaatactaattaattgtatgcatggatgcatatcttatattactattgaagaaatatagctacaccctatatttagaatggatggagtataacctgtagatggtgaattaacgggagtattttgtcgatgttaattaatgggagtatttttcgtactcctagctagctagatcgagagacaactcattcacacaagcacatgctatgagaattgaggtgccaaatttggtgccattatatagtacattagtacaacataacaactgttaatatacgtatagtacatcctacatacagtataattttaaagagtgatccaatcaactactccactaattaatcaattattaaatcatgcatgcatctccaataatttataccttttagttaagataaaaactgtagtgcaagccttgcacgccatgtactacgtgtagatctcctgcacacacatgttatatactaatatacatatttttgtttctgcaaggtactagtgtactacatgccagctatatattacaaattaattaatctgtattcattaaattttctaatgtatgtgtgcaatgcatgatcacacgatacacaatacgccagctaccagacaggtgatagaattcatttcacaggcatatgcatctcgctttcctagcttgttgctaaaattgtttgcttaattatatatatggtcaagacaatgctaataataattcaaaagcaatttcttaggaatcagacaaataaaaaactaaatacattttcattatatcaaatcaccaagacctttccatgcaagatccaaatgcttgacctgttgatactttgggagcagcatccatttacacatggccctggcttaattatcaaaattatcaaaatggtacaaaagctagctcatcaacaaattattacaaaatgagaatagcttagcaaaagactagaaagtactatgtatgattaagatctcaagtggtggttggctggcactagggacccgaaaaaaacttccaaaaatttaaatatggccctaaatgcatagactaaaatcatagagctcatgtggccaatattgtttatatatatgcatttatatccatgtatacagaaaatatattttagaaaccctaactgaaaggtggtggttagtgtgtgtttgacagtgacacagtgtattgcaaatttgcaatgggaccaccacattagttagttgttacatcaatctagctagagataactaagccgtattatatatatatccttcaaacatatatacacatatatataaccacctatatcaaagtgtgtactggtcggtcagagtaatttggagccactgctatataaagcctctcagagccttcttcttcctctcatatctctctctctctctctctctctctctctctctctctctctctcgtgtgtgtgtgtgtgtgtgtgaattttggctgtgtttagttcagtacaaagtttggattttggttgaaattagagatgatgtgactgaaaagttgtgtgtgtatgacaggttgatgtaatggaaaaggactgaagtttggatccaaactttagatctaaacacagccttgattgttgaggtgcaaccattaggagctgaagctgccagcatgatctgatgagtgcttattaggtgagggcagaattgactgccaaaacaaagatcagatcatgctgtgcagtttcatctgcttgtggctgcacaaaattaaagggccagattgtattcatatatatatgttggtgtgaggcttacatgcaaatttatatattcttctgtgtgcagattttaatcttgcaggatcgatcaaatcttagatgttttgtttgggagctgagcatccatgaattaattggagatcaaatgagcaagagtcaagaactgaggatgaaacaggtgtgaagatcacatgagctagcaagccaagatctgaagatgaacaggtgtgagagactaataaggagttctttctttgcatcatcaacatatataatgaatggttattatctaaaaatatatatataatgaatggttagtttcttccaacttcttaatttgtctttaattcaatcaataaaatctgatatccagttgtccaggtgttgtagggtgttcttgctagcttagcatgttcaggagaagctagctagctatatggagccaattaattatcatcagtctggagcagccagctagacaaatcttgggtctgatctctgcaagcttttgatgctagccaggataatgagaagtaacaaagtcataaataaatactaatcttgcaaatttctctcttgtttttatctcatactatagtatacaagattgcaacttgcaaggtttgtgatatgcatggcgaagtgaaccgcagatattttatcttactgaaattattacgagtaccgcctgaatgacatgtgggaccagtccacactatcgtcgtcactacggatgtattagttgggcaaattatgattgtgtaattatattactttatctctctttagatatattttttgagaccagattacactaatgtatgaccagatttgacgatacacatcagcagattttttggagtaactagctagaggggataattaattaattaattgattaaccgatgattgattgaatatcgattaaccatttgatttgagtgtacaatacattagattctatgtccctgtctattacagccgaaagttgggtgtacattcttaatttttttcccattatgccagtcctactcaattgcatgtgaagatctgtgtgagatgtgccactactcgtcgcatatatactatatataataaatagagctttcgcttattcatatatttatccaaatcgtatattaaaagacagaaatttatttatgagtaaacattattatccgaatcgtatattagcaaatgttgtaaaataaactacgatgaaaaaaaatcaattttaaaattcaaaatttaacttataagtaaaaacgtaagcaaaacaataagagccataactaacgagaggagaaaagatatagtaaaagaaaaggctagaagagaataatttaattgcggtaggggtagctcacgtacaggtacggctattgactacatccagttgtttatatacatcttaatcgaaaaaattgtggtgccgtaaaaacgtgtaattattgttggttcacacaataattaagctggaaaaagactaacagtcccatcgtttggatgtttggtgaaataagccaaacgacatatttgcaaataaaaaataatttgtgaataaaatttttatataaatgttctaaacgatctaaaagtaaaagctgaaaaataaactacgattaaaaaacctcaaaatcaaattcaaatttaaggttaagaatttaaattctggttgataagcataatcataagcgaaaagttgagttcctaaccgtcatatggtgttaggatggaaacatgttggggaagaagtacatgttccaattttaaactaattgttgtattattatgtcatgaataatgtagtcatgctggttccaaattcagcttataaatcacggctaattgtagaattaattttattttttttatcacttttgtgatccaattctctggcttttgagaccattatgagtagaagtatagaagtcttacctgacaattatttttattgctttggttatgtgtctttggcttttataacccatggccccaaaaataccttacaaaaggaatatttataaaatcatgtattcttagtatataactaaggaaaaaaaatactaatgtggtttacggatacatgggttgacctatttacatcgctgaacatgggtcgacggataatgtggtttagggttaaggccgtatgattttttccccaaccttataaatagaactcatccttgaaattcatgtgttctatctacaaatttcagtttatttctcacaggaatcaagattgctttttttttttgcatttttaatttatgcacaaggagtgttgaatatacaaacagtatgtacagcagcatgggctggcacaatttaaagctagctagctatatactccgtccaaaaaaaaaactcaacctaaaagcctgtctagattcgttatgctagattttatctcatccaagttttaagttgggtttttctttttaaaggacggagggactacatactagaaaaaactgacaaaaaggctagctagctggtcaagctaaccatttcgagctttctcgtgagctagtatagcactcatggagttattgtacaagtacatatttataactctactgaatgcgtacatgtgtcctgtcagaaaaataagtagaaatacggtgaaacgtacgtacatccatggacgattaaagtgtatacagctcaccagccatgccgtttgtttagggctcctttggaacaaaggaaaaatagaggatttttgtaggattagaaacccctggaaaattttcctttgtgctcctttggaagggtatttgagaatcctacaaaattcatatggagtggcttgattcattggaattttgaaggatttctaaaataaggttggacctcatcgggaactttgttatgtcaacctctctcctaaaatcctatacttttcctatggacccaaacagcaaattttaacaatccctatagattacaattccaaaggattcaattaacatgtcacctcgattcccacattttttttctattcatgtgtttttgtattcctacgttccaaaggaacccttagctgcatttgtagttaacgttgatatcttgtcaatctgcagtaaaatagtgtattgtcatcgactcttttttttttcttgggagaatagcatgtcccagctcaggttaatttagtcgctagccttttatattatccaaatgaaccgataaatttatcatgacacataatataaccctttgcgccatcgaaatcaccacggttatatcacattatcatctcccatacaaaatctatatatgatgggtccaatttacttcatttcatcatcatttttcgcatgggaggatatatggtacgcgcaagtggtcatttatgtgggcctaaggacgatattaggtcatatgataaatattaaacacttgtatggataatataaaaacgctaaggactagactaaccttggaatggaacttcaaggacaatattggccatttcccctcatttcttcattgcatgaaagacaaatacatatgcacacactctaccacgcacacaagcaaaagtggctcctttttaacatacactcaatatactaaggaaactaataaaatcgagaaattcttattgagaatgcatcgatgtcgcatttctaccaattttcagaagcataaaacttcagcttactatggatcacccactagaatgatgtgtttgtgaggttttgatcccattttcctataggaaatgagctgatatatgcaattccccccaaaatttccatggagttcctgtgttccaaatatagcctcgatgagaaaaatgaaactacgaggagagaaaatgcactggggtctacatatctatttaaggtcagttcatctcatccacctgaacctaaagtactttcttcgtcacctgtcagtcaccgctcctataattctgaaaggtgctccaaaacacatcaacataaatcacaacatttcaaagttccaaccataaaggcctacacaaacataaaaagaagaaaaaaaatgcagaagaaaacaaatgcatagatagcccctaaatttatccaacactacaaaacaaagtccatgcatgcatcaacgatcaatgcagccacttacacatcaggacgccccatgctggaaaataattggtgacaatcaagaggaatgtacacagacatccacagcaacccgtcggcgtcaggatgcattaacggttatacctaacgccatatgccaacagttatgcccatgtctggcatgcgcctgattgcccctcttggcttcaggaaatatatagtcggcgaattgaaatgaaatcacactgcaaagaacaagacaagacacatgttttttttttcatatctaaattattgtgtgccccggcaaacaagtttctgttccaacaatgacatcttaattgcagtgcaaagcagacaagcaacaagaaagcataatttataattatatcacagcgatggctaaatagcactatgattggcctatctattggtttcttattaggcagttattgatcgacttggaataggattgcaaaaacacaagacatgcgcatctacgggttgaatacatatcattgatgacgagacgcaatgtaatgctgactcctacaatttatctcttgaagtaagaaaaaagaaaaggaaagaaagaaagaaaaactacatattcagaagagggaagatcatgtcatgaatttattaagactagtaatatgctcgtgctaacgctatgacaacaatatatgataatatagattatacaatttaaaatacatcacgcacgtgttttttaagcttcatattagataccaaaatttaaagaatggcataaaataaatatcatttcttgttttccttcacaataccgaagttttagtcctaaaaagtgtgataatttacagacagaaatttatggatggtggcaccctcggcttccactgcccctacccgggattctcaaatctcaaagcttgggagcggaggctgggcgagacccggttgccgctgctcgggacttctaactgcctaaataatcagaaatttcggactgtagtctctaacaacaaatgaaggacactcagtggcaacacaaaaaaggagcttattgacctaatgaaaggactactgaataaaaggacaattttaggtacctgaaataaggtgtaccatcagaacagtaagaacaaacttgcatagattcaaaacctcaagctgcttttcatcatctggcaaaatagttggaatattcataaatggacagtaataaactgaatttcatgatcttagaggacataactaatgcatgtgtaaagtatttcagttaaaaatatattatgccgaaaggttaaagattttttttccggagcatctcacagcaacgcattcttataagacatggcaactcagagcaaatggtttcctattagtttatatggtttaaactgtaatagtggccttaaataaagtatctagaaatcatctgcttctaacgcattatactgattttgactgcaatttaagcctacttcatgcactaatcagtcatttaaggcatcccatggagaatgcgcttggttccaattttaaactgctactgattcagttttaaactgctactacagactatgttacattaatcatgaaagatgtggatcagcaacaattcatcaaagcaagaattattgaagcatgagtaccaaatgaaaatgataagcaccaaatctggatcggcatgagtaccaaatggaattgataatcaaagtaccactgtaacatagaaggtgaagtacagttccatgaccgaaatgaactattctagtctaatgatctctcgctagagcacattttgtgacgcatgattgatggggtgaggccgtgagggaggtgggagcgacctggggcatcggatctgtgggagacgatcctgaccgatcaatgaggaatgatgaatgtaacactgtgttggtgaactatagggtagatgacagaataacggagtactgctgaaaagattaactataagaattaatgctagtttacctctgtatcaagccatcaaccttccaggctgcaccagatggatctcacttgtacgaccagttggctggattggctttttcacctcatctaaggaagctagttctccaggggtggttgtgaagaagaaacctgatcaagttactgaggtttaacatggtaataaggagcagatacctaattataacaatacttgcagatcctattgcacgattggtagtgtgtaccttaaaggaatgtagagaggaagcgatccacaatccacaccctttaaaagattcaacagtgtcatttcactgataagattcagctcccagtaaaatgaaacgctatcattaccgtcctaaaagaagttgggactgatatactacttcatttgagtaccacttgcccatatatagggaccgagtcagttttttttttttggtgtgcgtgtttctttaacttgctaatggtacaacatatgtagtaggatacagggatgaaggcacattaccatttaccatacatgcataaaatattgagacatgataaaacaaaacgatgaaaattgctttaattatctctgctatgtcaaaatacagtactgctattagcaattacacaaaagattggcaatcttgaatttaaaagtaaaatgaaataatacttagctacaagcaagggtgtgcatggatttatgtaaccattaaccaagtgactggccaactggggacataggtgtcagtgttgtgtgtttgcataaatggtccagtcgaatcctaaatactaaaacggaggacatatcatggaagagttgactcacaaaattagtccattagttcaggctctcaacaccagctcgtaaattgaagataaataaacaatgaatgttaaacggcaggaaaccatgcactctgtttttattaagcatcgggacttgatatgggagggcaagaaccaagctgcttgaggttagctaatcagtactcaaatcatattttctcagcttgcaactcacatctttctaagttctaacatgcctcagaccaagttggcctgctcaaactacaaactcagaaggaactggttgtatacactgcttgttcctccaaattgtgtaaacaaaaaacacctatgctgtaaggctcattcatctgtagtgccgtcgttgctcattagagaacttgtatacttctacctttacctactttctctgcataatgtcaccaataatgtaaagtgatcaggcccattcgttagtgtgactgtgtgagtctgtgagaaccatcattggttactcaatatctcctatatgcccacaacattatgcaggcatgaatttacacaacattatgcaggcatgaattttccaaataactgtctgtcaagtaacatacatacttatgttctacatactacagtatcattaaattttctcatgataaatctatggagggataagcacaacaagggttcccaaactcatccacgtccactcccacatgttgacttttttggtggaataccagatttgtgttttcttaaaaaaaatacttgagaaaaatgatcaggatcagtatgaagtatgaattatccataatttggtacaaaccagaggcccatggatatcaactctagctaaacataccatggaataaccaggttatgagatccctagaagtgtttaggactatttattacataatgcaatgttcaactcacaagaggtaacacataatacaatatctaaatagcacaaatcacaagtgaagtgaagcaggttgtacctagtatgtagcaactgtacaaagatttctcaatcatctctgcttctccattttaatttagattcaagatccaaaaatttcaatccagatatcaccaaatctgcagtgacattcttcaaatgctcattcaacatatcctcataaacaatataattggcttctgaaataatattgcgatctctcatggtagatagtacttttcttgcctcagttgaacttgcatacttgcagaaaccataaataatagcagaatatataatttcttctatggaataacctaactcaatcatttcgtccaccactttgatgaccttctctgggctttttgattggcaagcttcaagaatagtcaaggtgtacttgaattccattggcccattttccacattcccaagacaatccttaacaagtgaaatagctgcatttatctctccttttttgcacaaccctttcacaagagcacaataggctgaaatgcttggtatccaaactgccttcatcatcaagttgtagcacgagcaagcctcttcaatatttccttcgtccacaaaacatgggatcatatggctatatgtacatgagtccggcttgcagtcatctgaactttgcatttcctcgaacaacacaagtgctttcttcctctccttgatcttcagcagattctcaatgagaatgttataaatgccaacactataatgcccccttcttctgaaagcattaaaaacttccacagccttcaattcattgccactcttgcatgcaaagagcttcaggaagtccactaaaatttcaactataggcaagcttagctccactagtttatcaaccaatccaaaaaacttaaccatctcgcccttatcggcataacgagccagcaatggtgaaacagtctcggagcttggtattagatcctcctgaacgacaatctgaaacatcttgtgtgctttatcctcccgctctatctcacatagcccgccaatcagtgtgttatagatccccaggtctgcacggtaaccagcatccaccatctctttcaacactctacaaccatcgctgacccttcctgtggagacatacccatcaatgagagacgcatacaccatcctgtccaccagcaaacccttcctcctcatctccccaaacaattcttctgccttctccaccattcccgcattgcatagcccagctatcattgtggtgtaagccattgtatctggatccacatgatcccttcttatctcctcccaaaccctgatgcaaccctccatatgcccccagcgaaccatcgtcttcaccagtgcggtgtacacaaacacatccggtctgcacacctcagcccgcatcctcccaatcatctccaggagtttatccgtcatccccgcccgcgccagcgcacgcaccatgatcgcgaatgtcaccggcataggccgcacactgcagtgcgacatttcgtcgaacagcttgagggtatcatcaacatgcccagccgcagccagcgctcccagcacgcggttgcaggcgtggacctcaggctgcacggagaactcgtggcggaagcggcggagggcgtggagcgcgcggagcgggcgacgcgcgccggtgtggagcctgacgaggaggttgagctgggaatgcgagaccggcttgccatgggctcgcatgaggtcgggaagctggtcggccgcggcggggagcccaacggcggaaaggagcgaggcgagcgcgtggaacgccgggaagcagtggcggaagcccttctgccgtcccgcccacaggaagaacgggagcgcgagcggcgggggcggcggcgggcgagcgctgaggacctcggcgacgagctcgggggccacgcggcggagcttggtgagttccgcgacgacgggcgggccccagcgctggtggcggtggagcgcgtcgaggaggaaccgcgcgagcggggagaggcggcgggcggccgcggtggcggaaggagaaggcgtggaggaggaggaggaggaggggtcccagtcggcgaggcggaatggggcggaggaggaggaggaggagggaggcctcggttgggagaaagcgccggtggtggccccgaggtcggagaatacgccgcctcggacggtggggcggtgcggagacggtcggcggtggccgtggtacaccgtcgtcctgcgccggcgagcctccgccgccggcgcccgctccggcggcggcgaggccatggtgagtttgagatgagatcactcgctgcactggctatagcgtaggattagcaggccgggttaagtcctaagtcgtgggcctatatggg

SEQ ID NO: 27870 - DNA, 1023 bp, Oryza sativa
  unsure (1)..(1023): unsure at all n locations
cctcttcttcttcttcctctgcttccctctcgacgccggtggctcgctgacagtagcagctcaccagcccccgcccaggtcgccgccgcgccgccgctcgctcgtagctccgcacgtgcgtcgctgcgccaccggccggccaccgtcgttgcggtgggggagaggaagggagcggaagagacagaaaacggcgtcggcgacgccggcggcgatgaggatcgaggaggtgcagtcgacgacgaagaagcagaggatcgcgacgcacacccacataaagggcctcggcctcgacgtgcgtccccgcgcttctcctgctcctccgctctctcccccaccttgctgctgctgctgctgctgctgcagtggggaaaggtttttctcctagggttttagagaaaattttctcatggcttggcttggtttggtggtctcgagcaggcgaatggggcggcgatagggttggcggcggggttcgtggggcagggggcggcgagggaggctgccgggctggtggtcgacatgattcgccagaagaagatggccgggcgcgcgctttgcttctcgccggcccgcccgccaccggcaagacggctctcgctcttggcatctcccaggagctcggtagtaaggttggttggtgcctccactccctcattctcctctcgaacaccctttgagcactgctctagatgatttgtacactctgctgtaaataaatttggaggttagattttaggcttcataatgaacaagccatgttattagcaacatatgctcaccgtaagcttgtacaaagtgttttgccttttggggatttttgctcttccgctcgtcaagaggtcgatgcgatggccctcagcgtggtgaaatggtggccgcacaaggttgtgaataccttggttttaagcctcatttcaacaacatattatacatgtgtgtgttcaagcctcacttctacatggagnnnnnnnnnnnnnnnnnnnnnnnnnnnnnnnnnnnnnnnnnnnnnnnnnnnnnnnnnnn

SEQ ID NO: 27871 - DNA, 710 bp, Oryza sativa
  unsure (1)..(710): unsure at all n locations
nnnnnnnnnnnnnnnnnnnnnnnnnnnnnnnnnnnnnnnnnnnnnnnnnnnnnnnctgttgaagatactactacatctcaaaatataagtgtttagagttttaaagaagcttaaattgatcgataatataataattatgattagttaatatgagaaaactattatgtgaacatttaacaatagatggttgtttagttgagatgacaaaagcatgcactactacagaaccacatatcggtgccggttgggacattgaaagcggcaatgattagtccgccgacaccaatgtcaatcttaaaaaccggcaccaatataaaatcaatgagccaaaaaaaaacggctcctcgagccgacgcaggagccgatacttcgatccgatgaactccacatgaatccacatgatgaataagaacaacacatcaattctcattaataaatctcagatgaactcacatcggcacatcaatttcaagaacatcatctcacatgagcaacaaatgaactttaataagaacaaatcacaaatcacaaagagagagggagggggagagatggattcaccgacgccgtcgaaccttctgtcgacgccaccgttcgaccaccttcccgagctgaggggcgcgggccggctgcctccaacggtgaggggcccaggctacctccattcaaccgtctcatgccgcttccgcagctgagggggcatgggccac

SEQ ID NO: 27872 - DNA, 999 bp, Oryza sativa
  unsure (1)..(999): unsure at all n locations
nnnnnnnnnnnnnnnnnnnnnnnnnnnnnnnnnnnnnnntcaccaattattttccagcatggggcgtcctgatgtgtaagtggctgcattgatcgttgatgcatgcatggactttgttttgtagtgttggataaatttaggggctatctatgcatttgttttcttctgcattttttttcttctttttatgtttgtgtaggcctttatggttggaactttgaaatgttgtgatttatgttgatgtgttttggagcacctttcagaattataggagcggtgactgacaggtgacgaagaaagtactttaggttcaggtggatgagatgaactgaccttaaatagatatgtagaccccagtgcattttctctcctcgtagtttcatttttctcatcgaggctatatttggaacacaggaactccatggaaattttggggggaattgcatatatcagctcatttcctataggaaaatgggatcaaaacctcacaaacacatcattctagtgggtgatccatagtaagctgaagttttatgcttctgaaaattggtagaaatgcgacatcgatgcattctcaataagaatttctcgattttattagtttccttagtatattgagtgtatgttaaaaaggagccacttttgcttgtgtgcgtggtagagtgtgtgcatatgtatttgtctttcatgcaatgaagaaatgaggggaaatggccaatattgtccttgaagttccattccaaggttagtctagtccttagcgtttttatattatccatacaagtgtttaatatttatcatatgacctaatatcgtccttaggcccacataaatgaccacttgcgcgtaccatatatcctcccatgcgaaaaatgatgatgaaatgaagtaaattggacccatcatatatagattttgtatgggagatgataatgtgatataaccgtggtgattnnnnnnnnnnnnnnnnnnnnnnnnnnnnnnnnnnnnnnnnnnnnn

SEQ ID NO: 27873 - DNA, 737 bp, Oryza sativa
  unsure (1)..(737): unsure at all n locations
ctaaatatcttaggctggtatttaatactttgtttgggctaagcacgcagtactggatggcaataactacacgttttcttgttggatcattgaatggtttacttggcccaataagagtatgattactgactgaatcagaactctattagatatttaaggatgttaagtttagtaacttgggtctttgatctttataggcttacactactgaagtttgtcggcctgagcatcaagctattggattgtcacttgtaagcatacaatattttatagaaatatgttttcactactcgctaatgcaacaactcaatttatgatgtttgttcctctccattattaggatagcacatcatgggcaatgggtcttattattggatcagttattggtggatatcttgcacaggtataaaaaatattagtgatataggaatttaatatgcacttatccactaatattattatgacactgttattttgtctgatagccaacggaaaaatatccaaagttatttcctggcaactcactattcggaaggtatttagtatcacatatgaatacggttataatacatttattaaaaaaaacagttacaatagacaagtggcttcaacttactgtttttaaaaattcttttcataggtacccgtacttattaccttccttatgtatatcggtnnnnnnnnnnnnnnnnnnnnnnnnnnnnnnnnnnnnnnnnnnnnnnnnnnnnnnnnnnnnn

SEQ ID NO: 27874 - DNA, 689 bp, Oryza sativa
  unsure (1)..(689): unsure at all n locations
nnnnnnnnnnnnnnnnnnnnnnnnnnnnnnnnnnnnnnnnntgccgccaccacattatcctttgtcggagtttctgccgccgccgtacttcggcgcataccatgaaccaactatcggatacgcaccccacagcgaatactatggatcaatggtcagccatgcacacccaggtatgtgagataaggaacacatcctctaccttaaaagataggtgactgagtcgcttacatgtgagaccactctactataggatcacatgtcagtgactcaaagtcatgtgacctaatagcagaggatccaatttggttagatatactaaaagttaagtttggtgaattgttatttaaaaaaatatatattgatattcagttatacataccctatatgggacacaccataagtttggtgcattctttcttttatttatttatactgattttctttgttatatgtaggagaagtttggtgtatttttttttaaaaaaaattatactgactttctttgtgatatgcaggatttgcctcttcagattaaacaagcaacttctagatgggataagccccaactcatctgttcgtccaatccaattcacgcaagaaatctatacctacttaaaaaatacttaaggctttcgatcgtccgcttcgtccgtcgtcgtcggttgagtctgagcccgtctttaaaaaaa

SEQ ID NO: 27875 - DNA, 614 bp, Oryza sativa
  unsure (1)..(614): unsure at all n locations
cnnnnnnnnnnnnnnnnnnnnnnnnnnnnnnnnnnnnnnnnnnnnnnnnnnnnnnnattccagtcgagtccatgtttgtttttcagatcccttaaatattgcctcatttttatttttgacggttcataaaaccaacaagggaacaaatgaagcaagctagagaacaaagcatgccatcagcacccacaacacaacatgaacacgaacattagaccattggagtgttcagtgcctaacatgtaacagaagcttaacacaacacaactttccctgtcattttgtctgacattgcttggcaacttggcatcaggtaacagttaaatgggcttggtcctttgggacaatctgttctttgatccacatggagacaggtaccagcacaagtaagaagcacagatcatttcgttttgttggcattgcttggcatcaggaaacagttaaattggttggtccttggggacaatctgatctttcatccacatgtagataggtaccagcacataataagaagcgcaaatcgtccccatgacgaagcggaagatgaaggtgaaaggattcactggtttctcaacatcttcagcctttggaccaagctgcaacaagaacaaaaggtg

SEQ ID NO: 27876 - DNA, 725 bp, Oryza sativa
  unsure (1)..(725): unsure at all n locations
aaatgtcatcaaagtgaacaggccctaaattttgtcgtaacgttaagcggtcccgcaaaccgggatgcaaacccaagaacagtggttgccagcacagtcgaactgtcaaggtttttgtttgaaagaaaattcatccaaaactcaagttgccactgattcaatcccgtgcaatttttgcaccagcacgagccaagactttttcctcaatcattgacggtaccagagtttggttaactagcaaactcgtttcagtcagtcatcacagtgattccaggattaaagcaatggcacgaccatattttcctcaactaacacaaccacaaaacagacaacattttcctcaccaaaagcaagataagattgaggctcgctcaacttgatttaggcttgctaggcatgcccactgaccagatttcacaacaaactcatctaaccaaaattgcaaatatgtttaagtaggctgaacactgtgaatggaatcagcgccatggtgaccgagtaagccatgagccctagaacaatatgatacagcgatacaagatcacagcatcaaaatacaggacatcacagagaacatggaagtgcatacataatttagatagctggtccaaaccacatactctatgttctcacgacagcacattaacaaaacagagaaaattgtctcaaannnnnnnnnnnnnnnnnnnnnnnnnnnnnnnnnnnnnnnnnnnnnnnnnnnnnnn

SEQ ID NO: 27877 - DNA, 740 bp, Oryza sativa
  unsure (1)..(740): unsure at all n locations
nnnnnnnnnnnnnnnnnnnnnnnnnnnnnnnnnnnnnnnnnnnnnnnnnnnnnnnagcagggctactggatcttgaactgctgctgcgcctgcggttatattttgagctcccctttttggcaggagcatctggtgatctggacttcgagggatcacggctcttcgacctggatcttgaccttcctctattgacaggagggctgctattacggtgatcagggccaccaccatcccgacctgatcgaagcctgtttcttacatctcgcctctggtgctccgctgggctgcggctgcggctgtgccttggactggggcggcgatatcctccacgctcacggtacctcaatggactgcgtgacctgctcctgctacggtctctccttgggtatctgggcaatggttcagagtttcttaaaaaaatgtatagctcattgctaaagtaacatggccttgcaatggtaaaaaagggaagcggataaaaaggaaatgtttggtgaatttgaatcacgcaagaaagctgattgatctaagcaaaatatactgtatctatgttaacatgtaacccagtttgaggtttgtccatgcatagcctctgctatctacctaagagaagaattggcatgaaatataaggcaatgaaagcaagttatgaacttgggtaatattcagattaactaaactcttgaaggcatcataatatagttatgagtaaatttataaagttttattaaacccactat

SEQ ID NO: 27878 - DNA, 1180 bp, Oryza sativa
  unsure (1)..(1180): unsure at all n locations
nnnnnnnnnnnnnnnnnnnnnnnnnnnnnnnnnnnnnnnnnnnnnnnnnnnnnnncatccgaacatcatatgtgttccgttatcagtggatacgtctctattaaaaaataattaaccgctgatacgagcattcctgtccttatcttttgtaaccaaccttaattagaacttctacaggtgtttatgatttgccatgaagggagtagatacttggtcagtcagtacccgtgaaaccattaaactcgcttttctgctgcactatcggagtacccgtagtcctagtccagtaccagtaactgctcctgttttggacagatagctgttaatattctttaccccgcctgatgtgaatcagcttgtacttgctgtactggcagcaagtacgctgtcccattttcttaatgtgcatcaggggagtaaataaaaataattaaggacgagtctggtcatgactacagtgcatactctctcagtaaaaaaagaaaaaaaaagtaagtctagaactcgatgtgacacattataatagagtgaatttacgatgtgtcatatttaatagtgctagattggtttttagggacggagggagtatatattaccatgcaaaacttttgcattactaagtttcgatagctttcttttttcaacaaagcaaactcatcctaactctactttgtaacttgtaattgaaacaagccgagctcgaggcaactcgcaaacaactcatttggcttggtggcttgtgtggcctacgtgtatttgctcaacaattatggttttcgagattgctaggtgtgaattaatgataataggcaatatatgtactaatataccttttgaggcagaatataccttttgaagcagctgggcaagtgttctagtatttggaaatggtcggtttataccgttataaaaaaaattgcagatgtatgacatatatgcgtcaatcagtccttctgccataaagtttctgagacttattattgcttcatatttgactttttagcggctttatgttaaaaaaaatagtttataataagtggttatagtttctttaaaatactagtagatacgtcgagcccattttgtgaggcctatatgtcagtgggtggtannnnnnnnnnnnnnnnnnnnnnnnnnnnnnnnnnnnnnnnnnnnnnnnnnnnnnnnnnnnnnnnnnnnn

SEQ ID NO: 27879 - DNA, 13713 bp, Oryza sativa
  unsure (1)..(13713): unsure at all n locations
catttacagaaaacacctccatttttcttttttcttttttttattctagaacaaattttggtttccacaaaagggaagtgcaaggagcagtagctgtgacagcttctaggccccctattgttgagaagaggatgaaaaatgaaagtatgaactagagatatgcaacattatctggttgcttaatcagatcttaatcactacttgtactagcgtgagtgtatcatatcacttggtatcatcagaggctcagagcaggcagtaggagcagtattaaaaaatatgcaagtatggagtactactagtagtgatgcatacttctaaaaaaacctgcagcgtaattatacttcactaaccactgctgcgaaaatatttggaattccaaattttcaaccactttgccacaaattagatagagcaagtaaaccaactataaacatacatatgtgaaaaagataacgagaagtgaaaaaaaaagagagctataaatttatagtcaaattatagacttctaataacaatagactttaacatgttgtttgtgtatgtgagagcttgtttgtgtatgtgagagcagactaaatattaatagtgtagtactacctctgttttttaatagataacgccgttgactttttctcatatcttttattcgtcttatttaaaaaatttaggaattataatttattttgttatgagttattttatcactcataatactttaagtgtgatttatatcttatacatttgcataaaatttttgaataagacgaatggccaaacatgtgagaaaaagttaacggcgtcatttattaaaaacggagggagtatatatttataggtaactaagggtattagcttactagattaattatagataatttgaagctaatagtagattgtattattaaacttgttcctagtccatatttgttctggagtactctattagtcctgaaaaaaacattctagaggatgaatctggataaaggtagtctaaattcatccttataaagggtcaggttggttttttttactagggagtaaagtttaatcttccactttgaccatgacagttacgcgcgggtgacggttacttttgcgagtggggcccaggtgtcatacaccgggggcagaggcagcggtggcccacgtgggccccaccggcgggcgtgcgggcagcagacgagccgtgcgggtgcactcgtgccgtctcgggagccgcgccggccgtcccatgacgatggcgtgcgtggctgcgcccccaccaactctttactctctctccctctctctgtggacttttctcacctcggttttttaccacccatcggtaaaaaaaaaaggaaaaaaaactgtgctccgaccgatgcttcataatttgcgatttcgcggttagagcaaaatatcccactactagctcttcaaatcacctataactaatataatagttaatttatataataattacttgctatactattatagctggtcctacctatcatacacacattacgtcttgaaatccgtactacagttggctatagatttatagctcactgctcttatcttttttttatctttttaaaatatgtttatactggctattgtatatgctcttaggttgagaaaattttacggtggccgaagaagaggcaggcagtttgatcggcgaatccaaggtgtgtggggggtggtaaaaagttaacgcgaggaacggtgaaataaaaaccaactgtagtgctgttttgcattgcgttgcgcctcgaccatggaagacgagctagcgtgtgcatcgtgcttggtaaatttatgttagctttggaagcaacgatcacgcctttacggtttgcgaaacacacgcccggggtcctcgatctacctcacccgctcctcaaactgtttctagcaacaatcatccaaatcaactgtttcttaacaagccggagtatgtcaattcgagtgcgggcataaaaaaggggtaaattaaatagtattagaaagttggcttagaaattctgatgatgttcgtttttaatcgcatcatttaattataggtttgaaaaacatgcctgtgataatccggtggtcattaccagggttcaccgaaccgttttgggtggggttatcgccaccccacggtttggtggttattgtagtaaaccgcacgaaaactatgagggattgtagtccagtttcatttaaaatttgtgacataaatatattaattttagaagttatacaaccaatcagactaaggtatatgtatttattggaccctacgatgtagaaatgacaatattaatgaggggcaccatattcatttcttttcactactaatttatttaagaattggtagaaataaagtgtttgttagatgaagtgagtaaaatagaagcaacttttatatttgaattttgtgccaaatacaagcatttcattttgtacctatcccatcaatcatcgttcattcaatttgtttctcatattatccctaaccatacttccaacttcaaacgtctcttatttatgtttttttttccggaacacaatatggacctaggtgttggataatgactcaaatatattattagtcctaggcactagtttaatatgtgcctatatataagggtcacccttatacatgtaatcctaaaccattatagttgattttgtcttccgtggtttttcctctttacattagaggggttttccgcgtaaaaattcgtctctttcgtatttttttcctaacactaatatttatatgtgtatacatactaccctctattagcatctccgaacatcatatgtgttccgttatcagtggatacgtctctattaaaaaataattaaccgctgatacgagcattcctgtccttatcttttgtaaccaaccttaattagaacttctacaggtgtttatgatttgccatgaagggagtagatacttggtcagtcagtacccgtgaaaccattaaactcgcttttctgctgcactatcggagtacccgtagtcctagtccagtaccagtaactgctcctgttttggacagatagctgttaatattctttaccccgcctgatgtgaatcagcttgtacttgctgtactggcagcaagtacgctgtcccatttttttaatgtgcatcaggggagtaaataaaaataattaaggacgagtctggtcatgactacagtgcatactctctcagtaaaaaagaaaaaaaaagtaagtctagaactcgatgtgacacattataatagagtgaattacgatgtgtcatatttaatagtgctagattggtttttagggacggagggagtatatattaccatgcaaaacttttgcattactaagtttcgatagctttcttttttcaacaaagcaaactcatcctaactctactttgtaacttgtaattgaaacaagccgagctcgaggcaactcgcaaacaactcatttggcttggtggcttgtgtggcctacgtgtatttgctcaacaattatggttttcgagattgctaggtgtgaattaatgataataggcaatatatgtactaatataccttttgaggcagaatataccttttgaagcagctgggcaagtgttctagtatttggaaatggtcggtttataccgttataaaaaaaattgcagatgtatgacatatatgcgtcaatcagtccttctgccataaagtttctgagacttattattgcttcatatttgactttttagcggctttatgttaaaaaaaatagtttataataagtggttatagtttctttaaaatactagtagatacgtcgagcccattttgtgaggcctatatgtcagtgggtggtaccaccacaagaaacattcaaatgagtaaagaaaatttatgtgttatttcattatcatttttttttaaaaaaatgcgtgagctgactcgagaaagagaattgagccaagacaacggccgagccggccagccagaacaacgcaacaaaggatctgtttatatctcatctcaaaattttacaccatatataaagtattaaatataggctaaaaaataactaattgcacagattgtgagtaatttgtgagacgaatcaatcttaaacctaattgctatatgatttaacaatatgatgctacagtaaacatttactaataacggattaattaggcttaataattcatctcgtggtttactgacggatttagtaattagtttttttaatagtgttcaaacaccctataaaatatccgatgtgacacgctaaaactttaccctagatctagacaccccccaagacagattctggtcctatactgggctttgaacatatccaaactatcaggcccacggcccatatatccttcaagcccacagcccattccacacacatgtctcgcccggctgacacgtggcatcaatcaggcttccacaatttgcactaatcgcagattagaacaggaaaaagcaaacaaaaataagtccattttaccctgaacccctaaactattttttaagttcaatttacctctaatactactaaaatggtttacttaacattatgtctcttctttgtttttctttatacgagtagtattttaaactaaaatttttgtagtgacatagatgtcaaccactatcaaagttctaaactattttttaaaattcatttattactatttacttgaaatttaaaactcggtatttaatttagtctcattgcttccgatctatgtaaacaataataataaaatttgagaggtaagttataacacatttatcaattctaccaaattttatggcaaaatataacttatacatggggaaaggaaaaggagaaataccatcagaggtgtaaaataagaaaaaaccaatacattactactttatccatttcatattataagttatttgactttattaattagtcaagattctttaggtttcgaccaagtttatagagaaaattagcaatatccatgacaccaaactagttttaataaatttagcattaaatatattttattacaatatttattttatattaaaaatattgctatattttactatcaactctgttaaaattgaagaattttgactaaaagaaaaaaaatcaaataaattataatatgaaacggttggaatagtttagaaggttaagtgaactaatgtaatataaaacaatttaaggtgtaaaatggattttctttccaatactaaaaaaacaagaaaacctccatttgaaacgatggattgacgaaataacgagagaagccaagccaagccatctccttcctcttggcctccgaccacctcgctcgcctcgcctagacgtctccttccctcccgcctccaagcaacccctctcgccggaggaggaaaccctcctccgcttccaatccccaaatccccatccgctatatcaacccgatcccctccccgatcgttcgatcgttcgatcgatctcgccctcgactccaagccgacgagaggagttgaggagttgaggccatttcggtgcgtgcgcggcgggcggaggtgatcggtggcgtttcgttccgttggcggcgggcggaggtgattgctcgcgcggcgtggagcggtggggggaggatccgagcgggagggagagcgcgcgcggatggggtggcggagtcgcgcttcgacggtggcggtgctgtggatgctccccgctgtggtggcggcggctgcgctggatcctgatcaggacgagctcgaacgcgcgtaagtgcgattcaccagaggcagcttctgattgtttgttttttttttcaatcgtatagcatcagactctgcttttggttgcattctgttgttgcctagcttaatggggttgagattacatggagattccggtgtgcatttttcgtgttcatctgtcgcacgcgatgctgtcatgctgcgaaattcaagttagtacggccgaattgcggctgttttttttcctatctcttaacgccacattggaaatgggcacttgagatgattgtgtgggaagtgggatattggaggggagcaggtagctgctgatgcatggttgaaatgagaaaccaagtggattattcatgtgagatgtggagtaggtagccggtgtgttgctacttgcatcaaccggactaattgagcgtggtgggtagatactttgttggttaatggatgtcaacttgctaagtttcacctacatatgtggataattaagaaagggaagacacatcttgaagatggaaaattttgaagtaattagagcaatagcaaacaaaatgatgacacattcccattattttcctaaaaaaaaaactgaagccgctttcgtgtcagcatagtgtgccccagttgaaccggctttggaactctcagatgatctaaccatatgaaaggcaccttcttaattgttttgatgaaagattgtagacttggttacttaacagaatcatcgtaggtctgcttcttcgacttaatgctgagtgaatgagagtacaacatgtatatggctggtactactagcatcatgcagtagttgtgtttcatttacttgttcatatggaaaacatcatttgctacaacgctcatatttatcaaatcagtggactgcaaagaaaaattattgtggttttggaagttcttttttttttaacaaagatagttgtgcaggtttccaatcgtcgaaccagatcatggtcacactaaactccgtcttgcaaaagaaggtttggaggcaattaaaagaatcgaaacaccaatagctgctgtcgctgtatgtttaaatgggctgtagctcacataaatacctgatagtttgcttttcccaactaatgccaaggcactatatttatttctttgtcgtggtgcatgctgagttatatgtctctgactctcaaatcaggttattgggccatatcgatctggaaaatcttttcttctcaatcagcttctctccctaacatgcaataaaggtacaatgagttcctgccttacatacataccatgctccaggaaagaggatacttggaatgatggattgataaattggctctgcaggttttggagttggacatatgcgagataccaaaacaaaaggtttggtggtgccaatgacaactttgtaatgttatcctaaatgattccatatcctaattgaaggattctaacactctgctccacatattgaaggtatatgggtctggggtactcccattgagttagatgtgaatggctccaaagtttctgtcctttacctggacactgagggatttgagagcatcggaaaatcaaatgtatatgatgataggtttgttgcttatagatgaaatgcatattaagtttgaattggaattttaaatggtgaaaaatggactgttagttcttttgtttttgttgcaggatatttgctctggccactgttttaagttctatccttatctacaatcttccagagacggtgtgtttctctggctcatgacatgctcacctccattctctcatttgatagctattaacttgacttatcttgatcatagattcgtgaagctgatatatctagactctcatttgctgttgaaattgctgaagaattctatggaaggtttgctttctgccattcctatttggagcttacaatttactaagtgcctccttaatgttctaacaaaatttccacttttctgtcggcatttgttgactccagagtgaaggtaatacttaaccttaagtgttagaattatttaaactagaaccactatgtcaaagttacagtgcttgtctctgtaggggcaagatgttgcttttgagccagcaaaactactgtggcttatccagagggatttcctccgtaagtttctgtttgcgttacatatgaacaattttattttgataatcaagtattcctttcagcatgttctgaatactagatgagaattagattttcataacaagaatagacaataaatcacaagtcggaccataaaaagttctaattgccttgtattaatgtttgtacattgtgaggtcggacttatgttgcggtacagactacagagggactagttaataacttgatatgtgctgtatattagcaatagtggaaatatacaggtctcgtgctttattttggtcaaatgtctattgttttgcatttcaccgtttgttgttgctgttttgtttttaggatattaaacttcttttaacattgttaactttcatgaggcagaaggaaaatctgtccagcaaatggttgatgaagctctccaacgggtgcctaacaacaatggttagttcaagttaccgtattaatggtttttatcatgatgatatttatttcctttctttcttcatgaaacaattgaagtggggatcttgaattaacctacttttgtgtattgctgcaggagacaaatatattgatgaggtacaattagttcgagctatatgctaataactggaagatatggcatactaatttgtttgaagaaacatggttttcatgttattttaggtcaaccgaatcagagactctttggcatttatgggcgataacagcactgcttttagcttaccccaggtttgtgaaaacatgatcatggtggggggaaaacatgagatatgttttttttagggaaaagtgatttgtgcatttaacatcattactatcacaattcataaaatttttggtattgagctaccttttaacatatatgctcattttgatgattatgtgctgtgatctttacatcactaagttattacattatgaacttttttgccagcctcatcttcaaagaacaaagctatgtgacatggacgatcaagaactggacccattatatatagaaaggagagatgagttgaagcaaattgttacttccatgataaaaccaaaacttttgcagggtagaactctaaatggaaaggagtttgtatctttcctaaggcaggtaatacctcttggcttgtttttttttatgcatcttaggcaggtaatcttgaaactcttgtgagctgttatctgaagttgcttacctttattttagatacttgaggcgttgaataaaggtgaaattccatcaacaggatcacttgtagaagtattcaataaggcaattcttgagcgctgcttaaagttgtataatgaaagaatggaaagagtgggtctaccagtatcagtggataaacttcagctgattcacaatttggcagaagatgaagctagaaagctctttgacaagcagcattttggtaaacatcatactacccgatccatcctcaagcttgatgaagagatgagaaaggtttgcctgacaataaatattcatgcgtgtttaatgttgtcttccattttcagataataaaacgacgtcattgatgcaatttttatgttgtaatgaatatgaatatggattgaagtatatgttataaacattatatcgaactgagatgctatggtcttcagttcttcacataagaaacacttgattcttcatattctgtcataaaattctattattaattactaatagccataaatcaagtttgatagttcattgtgtagtggtagtacatcttttgtgtagcaacaagttggatttctttccatgccttttgtgcttggatgctttgttttgaacacgaacgaattttttctttcagattttatagggtatctctggtgagattcttacatttgaagcattccatttaggaataaaactcgtttgttgcttacaacctatgcaaaatggataatatatcttcaatgtgtttaactgggtattctttttaggtcttcggaaactttggttttgccaatgagtaccagtcatcgaagctgtgcaaagcaaagttttcagagtgtgaagataaaatggaacaccttcaatccttgaagcttccttcgatggcaaaatttaatgctggatttcttcgctgtaaccagagttttgaaatggagtgtgtggggcctgccaaggaaagctatgaacgtaggatgtcaaaggtccgtctcttttaacttgagacatcttctatgatgggaaagaacaaatggattttgtacccacttaaaattcagatcaatttagggataatgcagtaatacatggagttgttaggtgtatccagttacaaaagtagcatatcacttttgactatcagattttgcatcaagtttttcaatactccctccgttcctatatactaattatcaccattgatcaattctgttgcaactttgaccagtagttcttatgacagagtaggtagtttttctctgctacttatgtgagcatttttagaagtcaaatcgagtcaaggtttcatgtagtaggtaccatttcacccattatgaatagcaaaagggaaaagcagagatgattgtccatatgtagaattcgaaagtaaaacatctttattcaccttccttcctcttttttttttcctggtaaatacaccagcacgttctgatatgttgtaagttttacctgaaactcattttttgtccaactatgttctttattacttgtgttgtgtattcctgcaccaatctttcttgaactgatatactccttgatgataaccttatctctgcatggtcacagatgctcgcaaggtctcgtgctcttttcatcaaggagtacaacaacaaactattcaattggctggtgacgttctccttggtcatgattgtgattgcgcgctttgtgatcaagttctttttactcgaagttgctgcatgggtgatattcatcttcttagagacatacacgagattattctggtcgtcagaattgttgtactacaatcccatctggcacatgatcgtctcttcatgggaaaccattgtgtataacccagttcttgatattgacaggcaagtttcttctctctgtgaagtgcacaacatgaatgtaatctctattttgccttccttactgttacgatgcttgtcttgtgcagatgggtgatcccaattgttgttgtgctatcatttttagctgtttactggcgttgcctcggtgtcaggaaacgaataggaagatcattgcttcctttgtacagaggttcttacggaagctccagtcgcccaagaacagattaatccaggtctagaaatggtgatgaatgatgcaaatcgctgggaaaatccatgaaaatatccttttgccgtgtgatggatagtggacggcaaaaggatgttggctctatgcacacgctgcaagaagcttctcttgcaatccaagaagggaatatttaggctcagctcacggctcttagtcttactgacccaccaagcaaagcaaacgctaacgtatgaatgataatcaatctttgttctatatcgaaatgcttatagtaacaaagaaatataaccatactttatttcaatgtaaagatcattctttgtatattatggcacactagataataacaaagaagatctggtagtgtacaggccagagcagctgaaatttcatgaaccatcagaagaaaccggtctctaaatttcatgaatcaccaggggaacagaacgaagttattgatgaagctactactgtgtttcttacagattttacataagttgggtttatttcaaatcttacagcaacaagatcatacagtcacatattgataaaaacagtcagctggtcttcacttttctgagcttcctcttggactcacggtttcgtcacaaatagcgggagtccgaagtgatcatggtccatgtatttattgttgttgttgcctctttcgagctatcttgcgagccctttcacgaagttcttcaggaggtggtggacgtggaccttcgggaggatataccacgtattcacgctgcagtggaagaatacagagcattagctcagacttctatatatcaccattgagaagcaaagtgatagaaacatataaaatgggtcacatgaaaatgattggcagatagatcttctcttttaattttgtgatgcaacaaacatgaagaaaatgtaagtattcatcaggaaaaaagaacatcataacacgataatctgtgaatgaaccacatataagcagatatatgcctacacaccctcacaacattagcattgctgcctacaaattgagcaaagtttcagtggcagataaatatggtcagtgagttgacatgcttgacaccacaaagcttagctctctaaatcgcttaatagcaacagcgcgaacaagctacaaacaaaacccgcaccagaaagggaatagccatccaacaaggcatatgcattgttcatcagcacgattctggaagaatcaggatccaatggcttcttcatcttacgaaacggcgtaggaatgaattcaagctcaaatgtagatatctccgcttccgtctgcagcgccatcggtcaccaccaatgccaaaattcagctcaaggtcgagtgccactctccactctctactaatgcaattctcatttcttccctcttcttaagatcgaaccccaaaatgcgcctaaaatcctagcatgaatttcaatcctcaaattggatagtgctactttacgcggtggtgggacgattgggatatatgctaccaaaacctaatcaaaagggggcaaaatcctcacccccatccagcgaccaatcctgatcttagagagccgaacagaagagaagggggaatcaagacgagagggagagagagagagagattacgaggcccatgagcttcttgagggtcttggagtcggtggcgacgaggtaggtgagcgcgacggggacggagacgtacaccccgaacttggcgatctccaggacccccttcgacgtcccaatcgacgacatggccggcgccggccgcgaggaagaagaagagatcccctctctctctctctctctctctctcctcctcactccgaacacctctctccgtcactcgatgaatcggcggcggcggtggcggcggcggcggcccgcgggtttgcggagaggcggattgattggtgagtgtgggttcgacgtcacctggtttagctgcgggcgaacgaggattagcggggccagacaagtggggcccacatggcagtgagaagcccggacatttgcatcgtggacatcaacgtaacttgagaaaacgtacaatatgccactccacaggagtgcaaaagataacattccacttattaaagtgcaaaggataaaatgtcactcaataggttatcttcagtatattttgccactttggggagttttgagaccaaaatgcccccactctggagagagagggagagaggagcaacgacggccgtgctcatcgccgtcaggcagggtccggccatttgcacaccatcaagatggcaacactcgctccggaatcgtcgcgttggttgctgcgtgtggctctgcttgccgctccacttgctgctctgcttcaaaatgcgtgtggctctgcttgctgctccatttgcacgccatcaagacgccgtgagcagcaagcgcttgcacgcgcgcaggaagtgctagaggcggcgagcgcgcgtgggtgccaccgccttgtcctcctcctctcatcagcaacgcgccagcgccgctccttccctccgtcggcgccctcccctggtcggccgcgccgtcctccttccccctgtcggcgccctcctccctcgattggcggcgctgtcctccnnnnnnnnnnnnnnnnnnnnnnnnnnnnnnnnnnnnnnncttc

SEQ ID NO: 27880 - DNA, 4068 bp, Oryza sativa
gcgctcgctgcccgccggcgacgagtcgcggccgccatcgctcctttctcccttcctctcttcacattagagggtattttggtctcaaaactgctcaaagtggcaaagtatactaatgataacgtattgagtggcattttatcctttgcaatcttgtggagtggcatattatccgttttctcaatcaaacataccaaatgcccagccccggttttaggtgggcaatccttttttttatgaattgtttttcaatttaattttaggggctttcctagttgctttagggcctgtttgagggagcttctagctactgcagcttctcaaagaatcagaagctcccccaaacaatccagcttttgatccagattctgataagttgtagttgtagaatccagaaaatgaattagaagccataagctggaaaacccaatttttctagattctaagaagctggctatcaaccagctgcttctcagaatcttaagctccgcaagcaggccctaagggttttcctagttgctttttcacggctctccttttttcagtggttgctacttagacgttttaagtttgagtaaatttattgaaaaatttagcgatatctaaaacaccaaattaattttattaaatctaatattgaatatatttagataatatgttttggaaatactattatattttatataaattttgtcaaactataaaaaaaatcaaaacggcttataaaacggagggagtaagaagataactaaagcaaatatatgaatagacctattccaaaagaaaatcaagctacaaaattcatttgttttggactgtaatctaaaactagggccaacagggctctgaccattctaaaactaaggtatggcaaatttctgccataggcactcggttttttttcttttcaacttgtatcttcactaagaaatcaacagggatatttaagattatttttgcacatgtggacccaaaatatgtgtataataagctttcataaaagctcagcaattgccaatcaacttatgttcgtactaactttttttaaaaaaaactatcaagtaaaatttggcaaattcgattctaacagttttaaaagctattttcgcaacatgcgttccagccaacaagttaaacattcaaaatggagacaaacacaataccccatattccaaccatttttcgctatattaagggagaccaccatgtcccattgtccctcattttctcaatttgaaacaacaacagccgcagatgttcctcagcaagtccaaaatccatagaaactacagtttcagacaaaaacagcgacaacaactactactacaaaacagcatttgcaggttgcaaatttgcacctccaaatgctctcatcatgttgttaggatatgctcctactactgaagctccatgttgacaagctcatttgcatccatcagagacgatccccatgctgtatattcattcgaacttgcgccgccaccacaagctctattctgaagatgctgcaagctcgccatctgttgctgctgcagctgcactggatctgttgggtcaatcttctcgacagaatccacaatctggaacgctggagaaacctggtgcatgaagctgttaacaccggcattgttagcgttggagaagtagttcattgggttgttgttctggatcggcacagaagcatcagagttgacattgaggggagattgcatgtcaggaatggcctggtgaagttgtctagcccctgtaaccatcttcacactctcctctgccatcctcacctgcaatcatgtcaagatgttagctaacccacatcgcatggttcatgaattttcagttgtggtctagaagcatatggctataagatacgacaccgcagtagtgtagtgtagctcaggttctttgttaaaattgattgtgatccattgtgtgaattggttatcaccattcggcaagcgattatttacacctggtacgttgcaggaaaaagaaaagtagttacacccggttgtttcaagacaaaacaagtgagtctaattgttgcaggttataatagatggcaaacaacttaatccttcgaatggagcaagaggacaacatttgcaatatctcctgtaccaaattttaagaacaaatgctagaagttcgtttcattccaagaaaatttggtatatgtttgatatgtagaatattccggttttctacaccatgaaagatgcacaatactgaccagaatcaatgcacatggataattggatacctatttgaaagagaggttcagttcatacagaggactaaaaggcacttaaacagttgcatacctttgctcttagggcttcaatgtctgccattagtaccctattgtcaatagcagcagcactgtacttctgatttgcatcagcaagacgcctcaacagagaagagttttcaacccttaatagtgatacctgcaatgatttagcaacaattacacttgttacttacatattccaaaactttgttgtgcagtcaaatggaatagtgtaaaacacaaaacctgctcctccaggtcttttaggcgagctgcctttctgcttcttgagcgtctagctgactcccggttggattccttcctgaaattggacaagaacacaagctcaaatctcaaatatccggctgtatttattacacaaaaaaaggcgacatgaatgtctgactgctgcgaaaaaaaagaccacagtagataaactcaatttttcatatgtagaaaaagcaactagacacaacaggacatgatattcccagcatgttatgaaaagcaagaagcaaatgcctcctaaattgttctaatcatacacgttgcatttttccttttttgcatgaatagctgcttgcacggaaacaataattatccttaatgcaccagcttgtaacaagcattaccaaaattcagtcaggtatataaagcattgaaacacctagcaagcattagctcaagcatttctaagaaaaaagtgagaatgttgtatataatcaaatacatccagtacaaacatgaaacacctagaaagaaactaaggatccattatcttgataatctaaagcatattacttaaaagctatttctaagaaaaaaggaaatcaatagatgtaaaagtcccctaatttctaatgctaatgctcagtgtttactctttgtatgtgttgaattgaaaaataaaaatacacaagcaaaagaatacatattaccttttcttcactttatcttcttcatcaaggatcatatttcccattgcctctgcatctccttccatatcatcatcctctgatggtgatggctcccttgaggaaccactcgtagcttgcttggcatgagcatctgtattttgatttacatatgggcctgatcctccatttgggccaggacttaacttggtctgcactagtatcccgttacctgaatgtgtcgaaatagggggaaaatccaatcagatatatataatatgaaaactacattacgcaaaaattagatttgcttacaacattagagattactcataagtcataactcataggtactgagaagatttaactaagcacatatgcataatagaataccttcaatgcacttctgtgaactcaggatggaaccaactatactcagtgatgttttattgcctagaggactctcagaatgtattgcaccagaggcctgtggatggatggacatgccaaaaattgaagtcagaatgcaaagggacttaataactatcggagctaaacacacactctcatagttaattagttctaatggcattataatcttatatagggaaccgtttcacattgtaaactgaaatcaactagcaaaagctcagatcaacatgttctgtagtcatttgtaaactgaacccacataatgagttcaaagtatgatatccaattgcaaaaattatataccccacttagaaaactaacataaaaagaagatattttctccggtccaacaaaaagtacctcgaggtaccggtacctcacggtaccaaatcattttcgatcgttggatctaattaggcaggatgtgcattg

SEQ ID NO: 27881 - DNA, 2073 bp, Oryza sativa
  unsure (1)..(2073): unsure at all n locations
cgagctcggtaccccagtacctcgaggtactttttgttggagcggagcaaatctctaaaaagaaagctctgcttccccatctacaatcgactggtgagaatttctaggtccaaatttaccagattccaatataacagtttctttttttctactaaaataatttcatcttccaagggtatgtgacctaataattccttcaaacaacaataataagaaaagtaatgcaaatatggtaaaatacagaatttccaaaaaatattccatgaatcataccgcctaggaccacccaaaataagtgcaatgacctatgatctatacatcatttttgcaacatgtaaccaaattgttaactttgcactcaagcaatgcacggctccaagaagtcacataaagtctctacacctccatgcaatcctaatccatattactcctaaatctatacacggaaataatataaatattataccacaccccgacaatattaaagtttgtctcatcccactctgacaatattaaagtatggataagaaagcacacacgtgagtagtgcctgggcttacgatgcggatatcgacatcaacgcgtgctcttataaaattaatttatactccctccttataatataagagatttagagggatgtgacacatctagtactatgaatctggacagagagccggtccagattcatagtaacagctaggatatgtcacatctatgctaaattgcgaccatctagccacagtaatcacaggaaatgccctaaaaattgcacttaattacgccacagccatcccatcaccaccaccccaaatggtgaacccaccagtacaactgtacaagccatgaagcaagcaaagcaagcagcgatcgagatgagagagagtaccctccacatggcgacggtggcgaggtcctcgtccagcttccgcttcagcatcgcgttgtactccacggggtccatcgccgcgctcgccggcgccgccggaagcgcggccgcgggcatgggcatcacccccaccgcctcacgatcgccgtagcccctactccagcgcgccgccgcctccgccgccgccgccggcatcgggctagggtaaatcgccgcgccgtccgggctcgccgccggtgcagggacgccgtcgagctcctccagaaacctctcgaggttccaccccgacgggcaccgctccagcaacccgccgccgctcaccgcgccgacgtcatctactccggcggccgccgccggctgcaccggcggcggcggagcccacagcgggtcggggatctcgtcgacggcgaacacgtgctccattgcgctctcggacgagtttgaaatgaattcgcgaggggttttcgaaccgaaatcggggcgaaattgaaaacgctggaaaagtttgggagaaattcgatcaaatgctttggaatttggtttcgcgggaggaagcggagaggaggaggcttcggagagaaggaaatggtgggaaagctacggctacgcaacccatgggtttttttttcttctctttttttttcttttttttttcaattttgaactgagttgagagggtgctctcctctcctatttatataggtttgtcccctctttagaagcttcaagaaacgtaaaaagcaaaacaacccgcacgatcttgagtgataataccgatataaataatttggacgtgttaacagaggtttcaacggatataaagtgaaacccacacgatcaaagcgataacaacgatacggacgaatacgtttttattaggaaaaagggttaacagaaagcgtgcaagtaagctacgatggtatggtgttcctagcacaggtgtagcataattttgacaaggttctataaaggcatggatttatttgtttttatcttatcaaagtttttgagtgagggtgtagattacgcatccttaatttgacaatgataatataaggacaaatggctttctacagaaaaagaggaaaagtataacagaaagggtagcaaagacattcgtgaataagagtagtgatgctacttaagnnnnnnnnnnnnnnnnnnnnnnnnnnnnnnnnnnnnnn

SEQ ID NO: 27882 - DNA, 2491 bp, Oryza sativa
  unsure (1)..(2491): unsure at all n locations
gcatatatgtatgacatgtgggcccggaatgtcagtaacagggaatcccgaaaaaattgcagctatgtgataatttctaacactaatgttgcagttttctgaaaagtggcgcaaaggttgcagcaaagtaatagtttagtcaataaaagtgcagttttctgaatttactcaaaaaactaatatttatgtttttactctgtaaggaaacaagaaatgttgtatctaaataaccgatatatctgatatctatccctaattaataattattaatatgtctcttgcaatcatggtgattactcaatttaataaacccacgcaacgagcatacggcatatttggaatctttcgaggacagaatacgacacttatccgataagggttttgtgaccaaagccaagacatagatctctaaattctccctcttttgcacttcatgttttttgaaaaggggaatatcattgcttactcctggccttctgtggtggagtgtgaggagaacctcctcctttcccctgtgatgtccccctatccaagaactaaaaggcaggataaagccaatggttcctttctcttgacaaagatttgtgcaaatcaaatctttctaccacctgtcctaactcctcagccttcctcaggtttgtggtgggttgtgagtaggaactagcatggaaaaaaatattcttatatttgtacttcaataccatcttggttttgtcatgttcatgtatgtgtttgggatcatgtgtaacctttggcataaaccttatgatattctctcgagggctttcttgtcattccacgcgttaataacagtaggaagaacagagatgcaaaatagaagtttgctttgcaacacatagatttactaatatatgtcaaagcatggacttttgctttgctttgttggaagttcagggatcgccacaaatccaaggttttacttgacaagttattgacttttcaattgactacagagctggttggtataatctgcttagattgtctagatttttattaaattcagcaagtaatgtaattggcatccaattacagtaagcacataaaacagaggtaggagatatcatctgatacgtgggctgcagctgaacaatccaaagtgcctgtagactgtagtgcagggcctcagaaaatgtacatttcagtttcagccaagtcatgttgacttggtaattcagataaaatgataacgcaatcttcgaaagaaaatggcaaacacgatggagtatttgtgaaaataaattgatacttggacttggtattagacaaactacagccaagagcaacgtcattttcagaaccaatgtcgtgccgcctcatccattgacagaatgggctcatatcgttatatagctgggtttcagaatgacatgaatcagtcaggtaaaccataggtgaattacgacattattttctccgtttatatccgctcttcgatatttgcaccaacgacaaagcgaaaacagtgttaggcccttttcgcaacatttagtatcattcttaccttgatttattcgttcaagcaactaacacaatgacttaattattttcaacagacaacagtaaccccgaaaaccccaatagcaaaagtcatgctcccaatactatgcttcaaacctgactacaaaaaaatggactgtattttctttcctcatggaactgattgtttcagggcaatgcagccttcaggctcttggctagctcttctagcttcttcaatccttcttcgggtgaagcagcttcgcccaattgcctcaccatagcgctcccaatgatcacaccatctgcgccccatcccgcaatctgttacaaggaatgaagcgacaaaggtcatgcaatgaattggggggaattaaacgtatactgttttgaacataagttcttgagtatgatttacctgcttcacatgctctggagtcgatataccgaacccaacagccacagctttgtccgtgacctagaaaagaacaagagattctatgagcatccttgaatgttatataaatgttttggagatgccaacaccaattcactgacgatgaatgatgcatacctgcttgatatcctggagaagagattgcaccttgccactgacatttgcacgtgcacctgtaactccaacagtgcttacctgaataacataggagttagcaacaagccccatcataaatctagttcgctatcatcaaacagattcttgagatttgataataacaaatttccagcagtgcactgtgattacaagcattcagtttaattttagaacgttgaggtctatgaggtgcaaaattactgactggccatcaggaatatatgctatatgagaacagggtcattagatttcgtaaataagttaaaaaaagatatagaagctcacaagataaataaatccttnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27883 - DNA, 741 bp, Oryza sativa
  unsure (1)..(741): unsure at all n locations
taggtacccgtacttattaccttccttatgtatatcggtcctctgctttataatctttataagctgcatgtggctcccggtatgtgcaacctttctatgttatttcgctaaatattcgatgtgatgcacacttatgtatgtttttgcaaatatataaaatagtattactttttctacttgaaaatccataagaagatatatagaattacaatggaaaacaaatgtttgaatatttaagcacgaattttgcaattaacaggagctgttgggtgattaagcaatgaaatgtcacatgtggagtggttgtttgagtatggcatatttttaacttgtatgctttcatcgaagattggaagcataaacaatatatggattagttattaaaagaaattgcatgacataatatttcaggagacactgcatgatctcaaagtccacaaaaaggacgatggaccaattgaatctccggttgcacattttgccaaatctgaagaacttcttgagcaacatattactccaactataaataagaatttgtttaagaattggccattgatgtcatctatcattctctactgtatcatctgctttgatgatatggcatatacagaggtgtgtatttaactactttttagcaataatatctatggtggtgcttttaaaatatatggattnnnnnnnnnnnnnnnnnnnnnnnnnnnnnnnnnnnnnnnnnnnnnnnnnnnnnnnnnnnnnnnnnnn

SEQ ID NO: 27884 - DNA, 5323 bp, Oryza sativa
  unsure (1)..(5323): unsure at all n locations
aaaataactatattgcacaaattgcgactaatttgcgagacgaatcttttaagcctaattgctccatgatttgataatgcggtgctacagtaaacatttgctaataacggattaattaggcttaataaattcgtctgactgaataactgaataatttaaggtacaaacaaattaattaactattatagaattgaaaataaatttaaaacaatgttttaagaaatttatatatataaggtttcttttaaagtgaaccatttagaagtctaggaagcttgtatattattattctatttatttttcccatagttgcttattggtttgctatcacaaactctgcttaagtgcttagtatttgctctccctcccggtttctcacttaatcacaaatcaaatgacatcgagtttcgttttgctttatactctttctttttactataacactaatatgtcaataatatacataaattagtggttgaaggattcttaattgtagaattatctttttattagggaaggttagtttcaaaactgcaattatgtagaaacttcaggtggtgaaaatgatatggtgtcctatttggtgatggatggatgagttagccaagtcctcatgtatatacgttaatatttttgtcctctttggtataactctggatccaatattctttggagctaggtatttttagctctacaaatccatagatctagattaatgattacagtggtactattttgataaattattttgttcccagtttatatgaattttaaaattttagatcacaattttacatataaactacaaatctatggtggatctgagatctgtagttatgccaaagaatacctcatattgctgatcctttctcgtatgctttctaatggagctagtatctgcagctgtattatcagaaatacatttaaatgagatatgttttgtatgacccagttgacggcctcacaaaccctaaacaggagggaaccaagcctgagctctaggcttggctcctaaatcccattcaaatattcttaaaaaaatcacatatttcttttttttaaaaaaaatagtaggatgattaggccgaatatgtcagttgagccttaggcgtggagaattttaatttggctctgtcaccaccatcaggaattgaagcagggaaatgagagctataaccgttgaataacctctcaaaaaatccctgaattttagctgcatgagcagcttaaatgtgggatcaatattcattaagctcaagttactaacttgaaaaatatacagcatgtgtgtgttgttttgaactctaaaaatacctagacggagttatgcattattgaaaacataacatatgaatgcaaacttatactagaaaaacccatgaattctaaccttagtggtttttcaccaatatttctaataaggggtcaacctttggaagatgagaactctaccatttgaacacatgaatagtgaaaaatcaaactattaaagcttgacgggctagggccataactgagcattgccacgtcagattattgtacaattatactactctagcagtacatacactcttggctgtgtactgttgtacgaaacggagagtccaaagtagtagactgtccatatagttcagtttgatggatttcacccggagatacaccgtacgatttaattgtaataatacatagaaccatttgttttttttttgaactgaagaaccatttgtttttcatttacttttactttaaaacatggacaatgaatttgtttttgaacagggcttgaaactcttaactccgagcaaatgaaaattcaaacagcagtggattcaatattcaactcgaaacccctcctttttttcaactaaaaagtccgcaaaacttcccaataattaaaccgtgaaatttcagcgagacctgtatttaaaaatatgggccaaattcaaaatccaaagcaataaacaactgggctacacacaacatgcgacggcccatctcatcaagcaacaaggcccagcccactcgacacccaccgaatccacgccgctcaatcgaaaccgacggtccagatctcgccgcgccaaccccatcacacaaaccctagcaaccccccacctatataacctctctccctcacgccccgcctccattcgcacgcccgcgccaccacaaaaccctagccgccgccgccgccgccgccgccgccgccatggccacccaaacccgccccctcgtctccgtcaaggccctggagggcgacatggccaccgacaacagcagcagcctcgccctcgccgaggtgttccgcgcgccgctccgccccgacgtggtccgcttcgtccacaggctgctctcctgcaacaagcgccagccctacgccgtgtcccgccgcgccggccaccagacctcggcggagtcgtggggcacggggcgcgccgtgtcgcgtatcccccgcgtccccggcggcgggacgcaccgcgccgggcagggagccttcggcaacatgtgccgcggcgggcgcatgttcgcgccgaccaagacatggcgcaagtggcaccgccgcgtcaacgtccacctccgccgcgtcgccgtcgcctccgccctcgccgccacctccgtcccgtccctcgtcctcgcccgcggccaccgcatcgagaccgtccccgagctccccctcgtcatttccgactccgccgagtccatcgagaagacctcccaggccatcaagatcctgaagcaggtcggcgcctacgccgacgccgagaaggccaaggactccgtcggcatccgccccggcaagggtaagatgcgcaaccgccgctacatcaaccgcaagggccccctcatcgtctacggcaccgagggatccaagatcgtcaaggccttccgcaacctccccggcgtggatgtcgccaacgtcgagcgcctcaacctgcttgacctcgcacccggtggtcacctcgggcgcttcgtgatctggaccgagagcgccttcaataagcttgaggaggtgtatggcaccttcgaggcgccgtcgctgaagaagaaggggttcatcctgccgaggcccaagatggccaatgctgatcttggcaggatcatcaactctgatgaggtgcagtctgtggtgaagccgctcaacaaggaggtcaagcgcagggagaagaggaagaacccgctcaagaatgtcgccgctgtgctcaagctcaacccctacttcggcactgcacgcaagatggccacccttgctgaggctgcccgcatcaaggccaggaaggagaagcttgactccaagaggaccaagcttagcccggtataacttactctcctctcaattttgttgattcagttattataaaatgatgactaggttgtagaataatccgattagctatgtagatctatagttgactctcatggtaacaagaacaaccatttggatgcttgtctaatgtgttagctggtactgctttggatgatctatttgtttagatgacattctagtttacttagttagcctgcacttgctgtttgtgctgctatgttgcttcatgggctgttaatttgttagtattgctcggaattgatactacctggtgttaattcttgctgttattaggtacattcgtttctatattcatgcttctaatgtgccattttctccatgtttagttgagtagtattttgttctatgatctctctggtaagccaaggttgtattacttgttataagttattgacctcattgttgtagctcagtgtctgtcttatttctacattgtgttcctagaagcctttgaatgtgttaattgattcatgataacatacagttgtgcaaggtcatttagttatttttcttaaattatgtctctatgcattcaagtttaggtttcatgtaatgttaatattctagattggctccttgtccttggtgaaatggtggctgagttcttggcattagaaggtcatttatttggctgtgttttatatttatcatagcatgtgtggtttgttgttgacttgtcgtagctgtttatttacactgatcttaggttctactatcattttttgtctggtttattctgccattgatatttcatttgctgtattgcccttagtgtttttagtgggatacttgtttagtcctcaaccatttggagacttcaatctcttggtgccttttgttctaactgaaaattcctgttgattcattgtaggaggaggctgctaaggttaaggctgcaggaaaggcatggtacaagaccatgatctcagacagtgactatgctgagttcgacaacttctcgaagtggctcggagtgacgcagtgagcgttgtcttgttttaagttttgagtagcagcgttaccggatcttatctcaaggatttatcaatctgtttttacctgaacatctccataagaagttatctgtgggattttgagactagtttctctgttttgttaatgtgctgtcgtgagaacatagagtatgtggtttggaccagctatctaaattatgtatgcacttccatgttctctgtgatgtcctgtattttgatgctgtgatcttgtatcgctgtatcatattgttctagggctcatggcttactcggtcaccatggcgctgattccattcacagtgttcagcctacttaaacatatttgcaattttggttagatgagtttgttgtgaaatctggtcagtgggcatgcctagcaagcctaaatcaagttgagcgagcctcaatcttatcttgcttttggtgaggaaaatgttgtctgttttgtggttgtgttagttgaggaaaatatggtcgtgccattgctttaatcctggaatcactgtgatgactgactgaaacgagtttgctagttaaccaaactctgttaccgtcaatgattgaggaagaagtcttggctcgtgctgttgcagaaattgcacgggattgaatcagtggcaacttgagttctggatgaattttcttccaaacaaaacctcgacagttcgactgtgctggcaaccactgttccttggtttgcattctgttttgcgggaccgcttagcgttacgacaaatttagggcctgttcactttgatgacattttcaaccttaccaaattttggtaaagttgccaaaaaagtggctacatttagtttgctaccaaattttggtaactaatgaaatcttgccaaaattttggcatagttgtcaaaatttcagcaataccaaaatttagtaaggattttttttaagtatcaaagtgaacatgcccttagcaaaacactgaaannnnnnnnnnnnnnnnnnnnnnnnnnnnnnn

SEQ ID NO: 27885 - DNA, 3521 bp, Oryza sativa
  unsure (1)..(3521): unsure at all n locations
aagctcgtctgcaccgtggggcccgccacctgcggcgccgacgagctgnaggcgctcgccgtcggcgggatgaacgtcgcgcgcgtcaacatgtgccacggggaccgggagtggcaccggggcgtcatccgcgcggtgcggaggctcaacgaggagaaggggttcgccgtcgccgtcatgatggacaccgaggggagcgagatccacatgggggacctcggcggcgccgccgccgccaaggcggaggtgagcttagctgccgctggattctgcctttggcattgccgccttgctaatttgctttcatgcgttcgatggaattcggcgagtaccgcgtgcgtggtgctagcaagtacgtgaattcatactactagtgagtaggaatgcgtgctttattcgacttggaattcggataaagaagatgtcctgacaccgtgactcggtagatctagatttgagctcaggttcatgtttgcacagtgaaggggaacactagtattgttatggaatattcttccatgaaatgctactagcacccaacattccctggagtggggataccagtttggattttgcgcaactttatcgcaagttgggtgataacatgaatccagattctactgcagagaatataagagatgctcaggtagatgcaaaagagagagccacatcataatctcacttgagcaagtgctccagccccttctgggactaccatgttatagacctgtcaacaagctaaattaaccacctatttaagcgtgtaaccattccaagtgctggcctccttgttaactattgaatactctgcaacttttcatgctattgtccacgctggtagagaaacacagttagtttggcctaattgtcagctatgtatgtgttttgtacatggcccaacaggctcttgttcctgtaatgtcagcctatagtgtaaatcttgctttccagctgaaaaaggaacaccgcatctgaattttgtttattagattcagcagaagcatgcaggcatctgtagtttgagttttattgacttggtttggcagtcataagctctgttcttgctctagtaaagaattgaagtttcacattaaaaaaagggtaaagaaattgaagttaacaatatctgatgctccaaagtttctgtatcacctatgtcaatgaaccatgacataatcttagagattaatgaattctctcatatgactggctcaccactctcaaaaataagattcttgcataatttttttcatttgaaacatattacaagtggcttgaccgctatctagcactccctcctagtcatatccaatgataactactttactttttctagccatgccttttattggttctttttgggttttcctagtggcaatatgcccctctaatagttatttattttaatcctttttttttcttttgttggatttcacaggatggagaaatatggacatttagcgtaagatcctttgaggcacctcccccagaacgaactattcatgtgaactacgaaggcttcgctgaaggttattttcaagcagatctcttctgttggtcttatttatatttctattcccctctgtaatgtgttttttgaacactacacagatgtgagagttggtgatgagcttcttgttgatggtggcatggctcggtttgaggtggttgagaaattaggaccagatgtcaagtgccgttgcacagatcctggtttgttgctgccacgtgccaatcttacattttggcgggatggtagtattgtccgtgagaggaacgctatgctacctaccatttcatcaaaggtaaattcactagcatggcaaatttgttgctgcaagcctgtaatcaaaaagtaggctgaatggttatgtcattttgttgcacaaacagttcatgttttacatgttactactgaggtcagcccaaatgaattacctggtttactcaaaccattgtgttgtaatagtgaataatatctgcatatattcgaaaaagtccaccatccatttcttagaaagctttatgtggactgttaccaagagttattgttgttgagaaatgatgattcttatttctgtgcaacttctgcaggattggcttgacatagactttggaatttctgaaggcgtagattttattgcagtttcgtttgtcaaatctgcagaagtaattaaccatctgaaaagctatatagctgcaaggagccgtggcaggtaagatgagtataaatactctcttcttgattgagctcatacctccatgaagctaagtacatggtttgatggttgaactgatggcaccatatgtatgactaatactgtaactatccaactcttgtgcatttgctgcttttggttcttgtccaattctgtggtaccagttgggtaagcttttcagtcagctacccctcagatgatcagcttagtatgaacgcactgtttttaactagttattacttaaatgttgagttagccataacttgctatagtgtcaactcttttgcaccaacaatcttggtttttattaggacatggtctctttgttgttagtttctccaatcaattttttcgatttgtagtagagccaagtggactatggcagtaagttctgatgtgttgaagattgtcttggttgctccatacctgttcaaacaaaaaaactgatcaatatattattttgtactgtttctagtttagatttgcagtagtgtagtaattcacttttaggttgctttacgtgtattcttttatttctagaagagtgaacatgattaataaaatgcatgaatttagatggcttaagaaaatggaccatacaaatatatcggtatagtgtatagtgtttatatgtcccaaagaaccaagaaatattacatatatttctattaaaaaagctaggcattgcattcccgaaatattagtttcctttttgctaacctttatggttattgtatattgtcactcatcagcgatatagcagtcattgccaagatcgagagcattgactctttgaagaacttggaggagataatccgtgcttcagatggtgccatggtagcccgaggggatatgggtgcacaaattcccttggagcaagtcccctcagtacaacaaaagatagttaaactgtgcaggcagctcaacaagccagtcattgttgcgtcgcagcttcttgaatcgatgattgagtatcctacgcccaccagggccgaggttgctgatgtttctgaagcagttcgtcagcgtgcagatgcgcttatgctttcaggtgagtcagcaatggggagatatccagagaaagctcttagtgtcctccggagtgttagcctaaggattgagaagtggtggagagaggagaagcgccatgaggaactggaacttaaagatgtttcatcttccttctctgacaaaatatcagaagaaatctgcatttcggccgctaaaatgggtaaccactgccaactctacttctattgttggactgctgctgtatatatgaatcgttttttcgctgttact

SEQ ID NO: 27886 - DNA, 34826 bp, Oryza sativa
gtcatcgcgctctccgacatgctgcagtccatccaggtcatgaacgtaccttgagaatcatcatgctcccctctcgtgtttgtttgttctgcccaaaacgtaacacggctttagttgacatcatcttaagggcggttttctggtttgaaatttattcgtttgttctccattgtgttagacgacagaaccagagaatgttacaacaataatgctgcaacttccagcgcgttgtaaactctatgctatttagcctgatgtataaggccatgaactgttttgtcgcttactatgataggctatgtatttaccaataaacccttctatttaagctatgtaagaattttcctcatcagaaattactccttgctagagcccagtaaagattctttaaaaactccttgcacatcaaattagaactgagtagttttactttcatatggactttggccaaactagtcactaaccttttgagtgaaatttttaccttttttttttggacatgtatgtatgcagggtattagttgacctgatgtagccatgaatagtttttgcattggtacgtttgtttgaatagtttttgcattggtacgtttgtttggcatctgtcacaacccacaagtaggacgctagcaacgacataaaaatattttattggggcgtgaaaaatgggagaattatgttcgcaagagggtttgaccaggtagtcatgacattcttatgctaatctcaagtctcagccatatatcaaacatcttaatgcacactgcaacgtgttacgtgagtctcctgctaccgctagtctcccaagtctaccaaatacttgacccgtttttaaatacactcagtttgaaaccctccgttctaaattaagatgtttttgtttttttaccaagtcaagctttttttagtttgaccatatttatagaaaacataactgcgtttttagcacaaaaacaagtgtactataaatatagccagtaatggatttaatgaatttggtgtgttactacgtatttctatgagcttgctgaagaaatctgacttagaacaaaagactaaaacatcttacaacctagaaagtagaaagagtacttattagcatattctttccaaaatcaaaatttaacaccgccgcaaattttgaacatgatattctgtcaaaatattgtatttccaatttttttttcatggccaaattcaaaataacattgaaggtactaacaagtaaatgagaacgagatagtaaatatattattaggggcgtgaataaaaaagttgaacacagggttaccctactgttgtttgggggttaccgctaccccgtggttggcggttaccgtagtaaccacaaaaaaccgtgtaaaatttacctcaaaaaatttgaattaaaaaatcggttgttttggcacagttactgcatggtttctagcgataaccacaatattcacatggttattgccggttgtatagcagaacacatcttaactagtgaaaactaaatcacacgatgcatcaaggaatgtgccacgccttcaaaatagtggctctgttcggttgcaatttttattactatactgcagtcaataggaacagtgtttgtactgcagtcaataggaacaatgttttgtattggcagctgcagcagtgcagccgctgcatataacagccgaacagactcaatattaattgtcagatatgctaatagtgaaacgacatatgtcgttggataaacatagattacaaaactacaggtgctggtaaatcttcatgaggcttccagagtctccaaatccaaactgagataaatcggtgaggagagagatgtgcaatactgtaagctgaggacatatgtcaatgcaattttgtaatttgatccttccataaaattcattatatatataagctcttaatttaatatatctttgatttcttgaaatggtcgcattgtactaccttctcaacatataagaagtttaggattcaatacggatatttaaaaaataggtaaaattcaatgatagtagattacgattgattgaaatgaggaaaactggtggaatgttgtaattggttatttactcaattttttatggattttttttacaatttttgaccatgtataataggcgggtttgagtcacgcgaatgcgtgacttcgtagcctagtgaaattgaaatttcactagaaaaaattcgaaaaaaacacttaaatgtgtgcataaattggggataattggaataatatatctaacttttggggtgtaaaatacaaaaattcggcattaatttttctatattatggacttcaaagcaattcaacattttatagcataatagcattacttgcatattgctaccatatttcacacgagcaacaaatgacccattattattacaataaatatccatccctaaacatgagcatatctactcacccaacaaataacatatcacctctacaaaaccattttccgcatcactagcaaaccatttttcacctattcacaaaatttcaaatctcaacaaacatcaatctttcacaatgtatttgacctaaacccaatacattttttctttttctaatttctaaactatttttgattttgccctcaaatttcaatttatattactctatttccaaaaacttcttcaccatctgccactaaaaatcaagaactacatccatgaattcttttgattttttttggaattttcaatttgctcgaatttcattcaaaccatatcgcggaaaaccgttactgtgccccgacggtaaccgcaattattgcgcgataaggtaaactctgattgaacgatgtagtatgaaatctgatactccatccatcataaaaatataacacatatataaggtagagtctctctacctttttgcttaaaaaatataacacatatatctctataagtgaatggtgaatcccaagaattaactaggatgagccacataatcaacaaaataatagccactggatccacatgaagacaaaatagaaagaagaaatctgagccattggattcactttatctagaaacttccttaacctactaaaaaactagtaaggttatggatatgattttacaatgtacacttttatttaaaaaactattttgcaaatataccctattactctatctatgcaactttcctttgaggaaaaaaatacaaatagatcattgacctatatttagaaatattcaacaaatgttgtgcatataattttacaactctcacggtttacaaataaacctcattttttaataaagattaatatgatccaactaagctttatatcattcaaagttatatatattagtgatgagcatatatatgtgtgtgtgatatgctgatgtaactattagttatgcacccattaaagatgttatgattaatcatcattacaaatttaagcttattattgctaccacaatctatagacatatttaatagagagggagtttatagttgcacaatgcacaacttaatataggatgaaccacataatcaacaaaataatagccactggatccacatgaagacaaaatagcaagaagaaatccgagccattgtattcactttatctagaaacttccttaacctactaagaaaaaacagtaaggttatggatataattttacaatgtacacttttaattaaaaaactattttacaaatataccctcttattctatctatgcaactttcctttgaggaaaaaaaatttacaaatagatcattgacctatatttagaaagatccaacaaatgctgtgtatataattttacaactcacacggtttacaaataaacctcatcttttaataaagattaatatgatccgactaagctttatatcattcaaagttatatatattagtgatgagcatatatatatgtgtgtgtgtgtgtgtgtgtgtgtgtgttgtgtgtgtgtgtgttgtgtgtgtgtgtgatatgctgatgtaactatcagctatgcacctattaaaaatgttatgattaatcatcattacaaatttaagcttattattgctaccacaatatatagacagtatttaaaagagaggtagcttatagttacgtgatgcacaacttaatatactagtatacttgagtagatacaacctaataaaagatttggtactatatttttttatagtactatatggtatatatcactatattttattttatgttggaggaagtattcataggaggatatttcatctcgaacctatattaatgaattgacctgcagccggtctgagtcgaaggaggtattcgtcatggactatgactccttctacgagtctcctgcaaatctcgagtctcagccgtctaaccaaacatattaatgcacactgcaattgacttctgttgctagtcccctctagtcgtctcgcccgtccaccatattagtgcacacgctcatcatgagtaatgacaattgatccattgaaccaggggttagctagacgtgtttttttttctcaaaacggattaggaatcatgcttctcatcttaatttgttcatcggcatttcttaaaaaaatattttctaaatcgacttttcaaaatttaaaatatatttcttttgtttgttccttcaaattaatttctacaacagaaaattataaaactttatagttattttgggttggtaatcatcctatataataaagaacgatccaacggctatggtattcttgatgatgtgtctacatgtaattgcagataaatgaggctaacttgtataggaatagtatatttggtcaagctaaaagaagtgacacgtgaaaatataaaatttagatatggaacaaaaggattggaagattattcagagctgagaaaaaactacaataacccgatggtgaaatttttaattaatattttaacatcttgaaaagtttgcttatagattcagatggtggtaactcgaagctaataaacacaggagtgagtgcaattcactggtttaacatataaaatgttacatacacgtggtttatttgcctattaaagaaagttgaaaaaatacctaaaagtttcaaagcaatttaaatttacagaagagttgagatttgctaaaaccacatacatgtagaattggaggaactattaactttgcatggaagtgcatgcatgtgggctggggatacattaatgcctacaccctctattttgcaagttataaacattcatggaaattttagcagaaattaagactaaagtgagaaataattgtgattgcttgaaatgagaatgtaaattaattaatttaacaagaaataattataattggatgagacaaacgagtagatggagaaatgtgaaatcctataacacttatatttaaaaatggaggaaataaatttatcaatggtgtacatgtcctttgtacgtggaagccagaacagaagtagagccacaagcagacaagctaacagcaatttgcaccagtccagaactgagaatgcgttgaataagccaagacttgggccgagtttagttccaaactttttcttcaaacttttaactttttcatcacattaaaacttttctacacacacaaactttcaactttttcatcacatcatttcaatttcaatcaaacttctaattttaacgtgaaataaacacacccttctcgagcgggttctaggtctttgggtcatagattaatttgagaatgtgtcggcttctaatttcgtccaaggcatgagtcaagtcgtctcctatcataatccatgaaaaatcagtatataattaagtgtcagtgtcaaacactggactaaatttaatttcaataggtgtcaatgtaatgagttgactaaatacgagataaatccaataacacataagtatatactaagtatatatgaaagatcaggaaaaaaaactaattatattgtaatcatttagctcttttctatatagcaaacatgaacatatgtcgaactgaaacatgcatgtgccctaactgttgggtgtgtgtgtgtgctgctgggatcgccactgatcggtgttcaatgtttcttaattatgctttccattaatacattatgacaatataatgatcagaactccagaagagtacttggctagcttgccacttgaattgttgtaatgtgaaagatcatctgtgctatatttatcatcaccaggattcaaaatgttggcctgtaactatatagaaccagagacccattacgtaaatttaaattaattgttcaaattttgaatttatatttaaagcttatttttccacacctttttataggggggtaattaacctcctagttgctgataattttctttttcaaaatttcagtttgcaatttcgtccctgtaaatttccggtaaccagcactccagcagtaattaattagccagttaccggtctgtgttttcttttttgttaattaaagactgtcatggtcgggattacgtacaagcgatgaagccagagaatagtgacaatgatcgattccatttgttttgattcagtttgtcacttgtcagcttgttatccttgagaagaccagtagcagggccgtcccgtcaaattcggaggtcctgtgcaaagttgaaggataacaacttaattgatgatataatatgaaaataatttatactctgtaatatatttcatagcaatctagaatgacctaaaatgataatccaaaattagggattaccggattagaaattatcagaaagaattagataggggcgcggcaggcgtcaggtggcacgaccgcacgagagaaagaggtgaggcgtcgtttactcctctcgttcgttgtgattggcaattggcgaggttcacagtgggaggcgattcaagattgtgaaccggtgcaactgtgcgaaccggcaaaggcgtaatcgaagccgaaacgacgagaaaaataacagattttcggaactagctgggctaccaatttacttattgagttgtatatctagtgttgaagttttgggcctaggggccttaaaaattgggggccctctgcgggcgagctggccgcacacccctacggcttgtttggcaacttgaaggaaggggattgtgagtttacacgagggaattgatggttagattaagatgggaatttgatttttaatcccagtatcttatttggtagatgttgtggaaattgatagggagtttagttggagattaggtcattaatgaaaacggatggctgagatttgtttagacaaaataaatgaggaattccctcctaattaccatcccctacccaggtattgaaaaggagggagttcctccctcaattccccatctccatcccaccaaaaatcctatgtatcccattcaaacaaagcagttaatagcctaatccctctaaactcccaattccttctaaaaactccctccaaccaaacggacggggacggccctgaccagtagcaaaacaaatggaattggttgttgctaacaaatcctgtaattgaagtacaaatgcgaatacacctagatgtacccaccttttatatgaacacatacatatacattaccaatgaatacacatctaaaagactaagccggtatattgaaaatatattgaaagtaacgaagtaataagagctttgttgtagtttggcacatatctacattagtgaaaagtaaatttcaagatttcatcacaatgagccacgtcacatattgattcagggccattggatcagaagcaaagaaaaggtgaaatgaatattaaccgtccgatgtacagagagaaaggcaatcaaaaagtgggattctagacaattccacgataccttacccagcgggagaacaaaataatctactactacttaaaaaataagaggtgcttccatcgtccgtcaaaaaaaccgggtaaaaaaaaccgggcagaaaaaaccaagtttgtccgataaaaaaaccggacgaaaaaaagtccgatccaaaaaaaaagtgaaaaaaaaaccgggcgaaaaaaacacccgtccctggtaaaaaaacacccgatcccttaaaaagggaaaaaaaaagtccgagagacaaaccgtttaatgaataaaaaaagcgaaaaaaaagagtccgattccctggagaaaaaaaatctgatttccctgaaagagatccgatctgtattggattggagaaaagaaaaaaaacacttctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcatggagcaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaaatttgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccaggcaaaaaaaaatctgtccgatccaaaaaaagggaaaaaatcaaaacgattccgactccgttgacgcgataaaaaagggcgaaaaaattgtctgtttctaaagaaaaaggaattatacgtgatgcggtaaaaaaatcgaatcctattatatcttgaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgtgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtaataataaaaaaaagagagagaaaaaaacagctacaacaacgaagcgaaaaggcggaatacggaagcgtggagggcggaggggtgatgggctgatggcagatgtaactaccttattacaatttagtcctacgataaaaaggattttaaaaactagcctcataagtacaaaatgtatatccatgttaattaaataattagccctatgctagggatataaatttatagctaacaactttagtacctctacatatgtgaaacaacaagcgttttaaaaggaggatgagctacatcatctacaatgatatggaccgttcgatgaactggtaaatgaaaatacaccattggatcatcatgctcatctatgactgtggaaacacgttgaaccaatccggatgattccagatcatcatgctcatctcaaaaagcagagaactcatgtgcttagtctatttaacaataccgttcaaaaatagtctttttaacactatacatatgtttaattaatctcctgactaaataaaggaaaaaacatatgacgtcttagctgtaaatttatattgaatttatatgcaaatttatatctataatgtacgagagtgtacacacaaatgctatgttatactactttttgcttggcattggaacaacacacaacaactaagtagcatccactacgtaccaattttattttaaaatagtccatacgaatgcacacacgcacaccctacagttaggagcacttagtgttattactgtctccactctaaaatataggtgcctttaacattcaaaatttatcctaacattcaaaatttatcctaaaatatagctatttcttcttctactccctcatcttaaccaacatagtcatatcctatttaatttcttcgcctattttctaatgtcaatcaattacaacgttcctccatttacatctctagctactgcatcattcccaaaataagtatttctataattcaaattttatatacaaatataaacatttctaagacactaatttcaatacatattggagtagctcgtgttcggaaaaagccaattggagtagctcaaattaaatttgatagtaagtgaaaaaagagatcattcctccttaatcttactctttactaaacaaactagaaatacttatatatagaaattaatgaagtatattagagaacaaagaaaataacgtacttacgaaaccagtcccttcaattaatatcaggatcaatggtctaattatataggtaggttatgctaacactcagagtcgcgcaaaacgcgactaagtagctagtctataattgaaaactaaatctagaactcaaactttcaaacttaattagataaaattatttcaccattaaaaaaaaatctaaccttcgatttgtactacgtacgtacataatccggatcatgagacaaaggtggtgttcttttcttctaaagatgaagatgaagattaagttttttatgcaaaacgatttggtattaacgtatgattaattgagttttaattattacaaacttgaaaaatagattaatatgatattttagagcaactttcatatataaagttttcgcacgaaacacaccgtttagcagtttgaaaagcgtaccacagaaattttaatcttcatccaagtcttgttggagaaaagaacgaggccaaagcctgttttctaaacattaatcatcaaaccatgtttttttttttgctaaaaccagtttcaaaaaccttgatcatcacaccgtccaacatgcttttccaagtttccagcgtctagtcaactttccgggttacacaaatcaaacaagcttttattattattttttgtcaccagtttatacagctcagtaatttacacaaatcaaacaagctttgaaaggatcaaagctcacagttaagcatttacactcgtctaatttggtccatttcttcaatccccgccattaatacctttgacttttttttaaaaaaaaatagacttcatccttgatagtactttttaataaatcactggagggatgagattcctcacaataattttccattacaaaggattgaagagaaacaggattctttgaaacaatataatttttttaaacaccaccataattgattggccgcgttataataagaagagtgcttcattttagagaaaaaacaataccaaaccttacaataaatagttgataacaggaaaactgtgctaaaaccccagacacgacctagctttcctaaccaccaagataggactagcaccatccaattggacgactccgacttccccagaaaaatcaagggaacaagatgtcaatagcccgaccgataccaacttctaactccctggacttaggaactgctccctccatccataaatatttgacgccgttgactttcttaaacatgtttaactgttcgtcttattaaaaacttttgtgaaatatgtaaaactatatatatacataaaaatatatttaacaatgaatcaaatgataggaaaagaattaataattacttaaattttttaaataagacgaacggtcaaacatgtttaaaaaagtcaacggcgttaaatatttagggacggagggagtacatccctatgtctatcagggtttaactgaacatgacaggtcgtgtacaaattcaagatgagaaatgaggacccaagtaaatgttggactagttcaagagatgtacattcctcttttaatgcctacactatcgcagcaagagcacatcgtaccaagttgaacaaaaaacaagtggcagagctctataagttcttaagtactccttgtcatgatgcatgcccccttcaatctcgatctgttaattaaatccatagaagagtgaagcctttatttttctcctttttcgaggagaagagtgaagcctttcaatctcccgttggtacgcttctccgaactctagctacgtcgaaaaagtaatgcttatcatttgattgatctcttattttgtacttgttgtgtatcacctcatgcaaaacgatatatcttggcctcaaaaatagttctttcgcatagaaaggctttatttgccaaggcaaatacctgattcttttacatttacagttataaaactgtcacgatagcggcattagtagacggcataacgctattgaagattcaaacttgacaatactgagacaatttgttaacaagatttagccaaaatctacaacccgaacttgataattataatatataaggaatcaacgagccttaggcctcccagtcgttctcttgtctagccatgcaatcatctcagatggtgcatctcttgtttaaaatagtctaaaataagagtttagctacaaatccaatcactaactgacaatgtaaacatatttaatacaaactctaccttggcgagtatgctacaccaatttgaattagttccgtgtacatttgaatctccgtgcacctgggcttaagctcattcattgctcatgcggagctatctgataagccttcaccaggtcgttcataactagacaaattattttgtggatttgctctaaattggttttttccaattttcctagcaaaactatagttaaaatttgtttgtgttcgtatattgtgaattgtccattttttctcatgtaattcaataaggtatgagagttagatgttttaagttcaagtcctaggtagcacaattaaataaaatcgtataactcatgtatattatattcgacgtttgagatataagggaccattgactaaggaagccttgagcgaggggaagttttccaatatagtgtggggggagtgttggaatataagtattcgctcgtcaatttaattaagcttttagattgaattgattggtgtccgcaactcaatattctcaatatatgccgcagatcacacctagacaatggaggttagcatcggcaagccagatgacgggcaatcgcttcttgctaatgttgaggcctccgatgaccatgccgcctttgatgccatggccacaagctcgcgccgtccacctagcttgcgccctctgcggcaccccaatgtgacatcccttgcaccagtaagtcacctcatactcaaacttattgatccattaattctgccatagcagacatgaacatgaaagggtgggtgagaccgtgtttagatgggactaatcttttaagtccctatcacatcggatgtttgacactaattataaatattaaacgtagactattaataaaacccatccataatcttggactaatttgcgagacgaatctattgagcctaattaatccatgattagcctatgtgatgttacagtaaacattctctaattatggattacttaggcttaaaaaatttgtctcgcgaatcagctttcatttatgtaattagttttgtaactagtctatatttaatactctaaattagtatctaaatacagaaactaaagttaaagtccctggatgcaaacaccacccgagtcattgtcgtttgtcttctttacagttgccaccactccatcgctgtgtaccacgacaaaccgaggtgatattcccgccacttgactcaccggactcctccgagctgaagaaggttatgtccatcagcctgccagcaacaccaaccggctttgccgcacctgttgccggtgccagcgactcgtcgggcatagatctccggaggcaagccatggcgtcgaacatgacacaaaggctacagcagcgctcgccaacgtcgcagagcaacaacggccggcggctcacagacgagacaacagcgttccagtcacccccgcctacccccggtggcggccggtcgtcgatgagccgggacaaacgctatgattcattcaagacgtggtcggggagactcgagaggcagatcagccacctggcgggcatcgggccggacatcccttcacctgcagggcaagtcgtggatgccgccatggatagtcaccaccattctcacactgtgtccacgcccgaggttggccgcttctttgccgcactggaaggccccgaactagaccaactcagggtaagctatagaaaaataaatgaaacaaccaaaaaataattcatatatatattagcggtttaaaagccaatgctgaaaaataagctacaactcgtatagtcggaggaggagctggtgctgccggtggataggacatggccattcctgctgcggttcccggtgtcggcgttcgggatctgccttgggatgggcagccaggcgatcctgtggaagaggatcgcggagtcgccgccgacgacgaggtacctgcacgtcgccgccgacgtgaacctcgtgctgtggtggctctccgtcgcgctcacctgcgccgtctccgccgtctacgcctgcaaggtggtcttcttcttcgaggccgtccgccgcgagtacctccacccggtcagggtgaacttcttcttcgcgccgctgatcgcctgcctcttcctcgccatcggcgtgccgcggtccgtcgcgccgtcgacggcggcgctcccggcgtggctctggtacgcgctcatggcgccgatgctgtgcctggagctcaagatctatgggcagtggatgtcgagcgggcagaggcggctgtccatggtggcgaacccgtcgaaccacctgtccgtcgtgggcaacttcgtcggcgcgctgctgggcgcgtccatggggatcagggagggcgccgtgttcttcttcgccgtcggcgtggcgcactacgtcgtgctgttcgtgacgctgtaccagcggctgccgacgaacgaggcgctgccgcgggagctgcacccggtgttcttcctcttcgtggcgacgccgagcgtggcgtccgtggcgtgggcggccatcgccggcgagttcgcgctcggcgcgaggctcgcctacttcgtcgccatgttcctgtacgcgtcgctcgccgcgcgcgccgtcagcctcttcggcggggtcaggttctcgctggcgtggtgggcgtacacgttcccgatgaccagcgccgccgccgccaccatccgctacgcggcggaggtggaggacacccgcctcgccagggcgctatgcgtcgcgctcgccgccgccgccacgctcaccgtcggctgcctcttcgccaccaccgtcgtgcacgccgtcgtgctccgcagcctcttccccaacgacgtcgccattgccatcaccgaccaccgcaaggtgaagcccaagcccaagcccaagaccaccatggaggtgcactacaagatggatggcaatggcgacatcgagggcggtgctcctgccatgacgccatcgccatgcatgccgatggcgacggcagcttagaggatttcttttcttttctttttgacctgccaagccaacgcgtccacatgcacatgcatggttttagcggtttgaatttgataagatgaatatttgaaatacaaagtgcctatgaaaatttatattgttaatattttttgagtaagttgaactttatgtatctactagaagatggtatgtgctttactgttaaatactccatccgtttcaaaatatttgacgccgttaactttttctcacatgtttgaccgttcgtcttattcagaaaaaattatgaaatatgtaaaactatatgtgtacatgaaagtatatttaacaataaatcaaatgatatgaaaataataaataattacttaatttttttaataagacgaatggtcaaacatatactaaaaagttaacggtgtcaaacattttaaaacggagggagtatatggattagatgactatatattaaatgttatagaaatgataggtaaaatttagtttaatatatcgtgaaaataatgtaagtaatgatgatttagcatgtttttatgttgaactttaaaagataataaatcataaatataatattatagttttaggtgtttaatgggtaggaactttagagtaggtataagtttggttacatactttgagcctgtgacgccctagaataatcggggaaaaaaaaagatggagcaggcagcagcagctagctagctgtagctggcggcccattttgctggtggccttgggcccatttgcaataagcataaataaagcggaaaaagttcacttcagttccttcatctgtcatcaagcttcaaaccgttcctaaaccggaatactaaatataatacatccattatctttcaaaaccgagtcacactaaaggtgtgtttagttctaaagttttttttttccaaactttcaacttttcatcacatcaaaccttacttttcagtcacatcgtctccaacttcaaccaaattccaatctaaacacagcctaggtagtaaggcaatgttgcttccggttttaacagacgtagcactcttaaagcaaaaattaaaaaaaacataaaaaaccacgtgggatccgcatgtcagtgaagctttagacggttgacttaagtgaacgagctcctgctcgcgcatcggcctggcgcgcctctcctgctctgttggaccgccgcgcccagagcgctcgaccagtcggcgggcgatggtccccgaggtgggcgaggaggcgggcaccgcggcggaatcgcatcgggagcggaacgccatcgccagccgcatccgccgcgccgacgccaccgcagcgcgttgcccctacattaagtgcaacaactgcggtgatgtccgcatcgtcaagtgtgaccgcgccctctcgacgactggctccgggacgacttccccaaccaccaactctgcaaggtgcttggccccgatcgatcgagctctttttctcgccgctcctctacgtctaggtacagaacaggcctccatccatcgatcaacagtttattcagcgcatatgtttttgacccaaactcatctacgtgtgaaaattgaaaatcgaactactgattagctgatagttggagagcctatggggattcttggtgaaaatctatgcaagcttgtgtggtacgtcgcaggtgctcaacgtcgcctgaggcggccacccggggcgcgtcctaccgagcacaccgctgcacgagtggttctcgcggagtcgctcgacggcgaggataaccagctgatggtgaacagctaccactgcaccaccagggagggcgtgcaggcggcggctggcggagcggttcgtgccgatggcgttcgatctgcgctccggatgcgattctgccgccgcggcgcgggcctcccgccacctccgcgcccatcgccgcggcggtcgagcggctgctgccgtagtcctcagcggtgcgctaggccgatgcgtggccaggagtgagttcgttgaagccaaccggctaaagctccactggcatgtgggttctatgtagttttaattttttttaatttttgtttttagtgccacatcagttaaaaccaggagcttaaccacttaaccactcggatgctatactaagatgaaataattggcctcactctcctttttttttttactatggtttagctaaagggccatgcattgcaatggatactataagagataaaagaaagtaaaattacaagtttatagtattggtatatttttagaggggttgtataggtagttaattagtcatataatgtcatatccaaaataaaattattcacgtgtgagaattttatgctgttagcttataatgtcagagacagatccgaacatcatcactaacattatttaagatagtatagctaccgagagtctgtgagtcttgactagcttgtgagtaatttttagagaaagtaaatcaatttactaggctgtgaaaaaaaaacgagcaagttaacagaaagtacacgcacgaggcgtcgacatacacggacgtatatacgtagacgtcgcggtcgtatggccgtacgtctctctgtattgcttctagaagcatcctcaagattggtcagctgctcgtctcaaccgctgctaaacgccgccaagctcttgactttcgaatagccgtactccctccgtccttaaaaaaagcaaaccctggttttcgtgtccaactttgactgtccgtcttatatgaaatttttttataattcgtattttcattgttgttagatgataaaacatgattaatattttatgcatgacttgtctttttaatttttttcataattttttcaaataagacggacggtcaaacgttggatacgaaaaccagggtttgtcttttttttgggacggaaggagtatagtatatgatcattggtcttttctatcaatcgattcagattttttttattgtacttaattattgtttttgtgattgtacgacgtcgtcctagccattattttaaacagttttttaatcctactgcctctacttaaaaacaaacttcattcgtggctataaatctaaataagcacttgtccaaattcctatccatattcacgtaagtacaagaatcgatctaagtattgaagagaagagcggaaaacctgagtaggtcttatatgtagacaaatgacattagtacattataagaagttctgagtatcatgacagagtcaaaattgtgaagataatttaaggctcctttgaaatgtgggattgaaaaaaaaacggagaaataaaaaaaacactgagttttgactgaaatgcatgcaagtataagatagagattgtaaacacacgtgaaaaatataaaagtagttgtccgattaagccacatgaaaatattaggaattggatgaaagagttaaaagaagttagagctcttcctaactctccttcaaaatcttgagatgattgtgcattccacaagaattttaaacaaaaggttagggttcaaatctttgtttttaatagggattttattttcgattatggttaaaatacaccaaatttcctttttcttttacaaatcaaaggtggcctaagtgccgggacaattgaatttggatagtggtatatacatatactgtaaactaggaaatcataatgttttagcacttcctgaagattgatcagattttttttatggtctctgttcatctctcgaccattaattattcgttggtcgtcccaatctaaaagagacgtcaatattgaagttctcgagccccttaaaatgtccctaaacaataaatagtgtttcttataaatgtagtatattattccttggaaaatatgactaacttagttagaaatttttttaaaaggagagatatcattataaacgaggtaaattgaacgttaccaatcattagaggtataaaataagccaaaatagtttggggttgcttcgagggaataaaatgaatttttcttacaaaaacaaatcaaaacagaaatcctttagaaaacttaattatttcaggtcggcagtgacaatgcaaagcatacaacaaacagctgtctgcagcgacagtcaaaattttggcttttttagaaaaaaaaaaacgtgttcctttaattttgagtggtaagagtcatgggccctgtttggttccatgggctaaacattagcccccaccttttagccatgaattggccctcaagtatccaaacatgtgggctaatttttggttaaagtgaattagcctccctccaaacattagcccctccaaggggtgctaatggggctaattttgcatggggaccataaaaaggcagccctctctctccttctctctcctctctttttactctctctccaccttttagtcttgaattagcccatggatccaaacataccactctgggctaatgtttagcctaccaattcatgactaaacattagctctcaaaattagccatgggctaatcttccaaacaagcccatggaatagaagcttctttgccggcaaattaaatggtcgttttcgcacacgtgcaaacgatgaatcacgtatagtttataagttaattactttcttggaggtatgaattaattattgcataggatcgatggcgtggtcgttgttcatgagaactgagaaagtatgtgggagcttaagatgtgtctagcgtgttacacaggcacaaaaggtatcgtttttggcattgtaaagtaagtaagtcataatttatattatgacacctaatgtttgtaccaacatccaaaaactattgcataaggacaagggttagcctctaccaaaatttaaattttaaaagtaatatattttatggtattttcaacgtagattatttttactttggatttttaagttgctaagtactcctacctatagaaaagtttaactcataaattattatttaagtcattaataagtcgtttatttataatcggctcatggacaaccaataggctctaagaaagaaaactccattttacttcctcaatctattcaattaaattatttaaccctttcaactaattaccccctaaacagttgaaaacacaattcactttactcttaataacatttctctttctcttacttttcctctttatactagtcatatataagctgaaattttgagagccgtagatgacaccatattatcaaagctcaaaagtatttcaatttttcatgactgattgctttttaaaaaatatcattgtttgaattagtctttggttctttcaacctatataaacagtgataataaatttataaaatgttgtgatgcgagttataatgcacctatgatcgtaccaaatttcagtgcaaactatgatttatatagaaagagaaaaaaatggaaaatacaactatggagtaaaatgaattgttttgaatggtttgggtgtaaaatgagccaaaaatagttttggggttaagaatattttgagagagtaaaatatactttttttccaaggacaatacctttttcatatgaatctttttgttataacaaacttggctactttctatattaaggatagactctgcaataaataggggcaaacaaggaaaaccatatataaattggtatgcatgctttatatttgaaacaagatgagaaaaactatatgccttatagaaagaaacagatggggtacatacatttgataatgttttttttatgacttggacgagtagtggctaagctattttgttatttagttgctaacctttcaataaagcatgcaaaaagggtagttgcttgagatagcgtaccatgattaatttatgtatatgttttttagcatatttaaaggcaaaaaattttcatgcatttgtgtacgtaaaaatcgcaatgttatccatgtcatttcacaatgtttatccctaggcaatgtcggaagtatagcaatattactaatactccctccgtttcatattataagactttctagcattgcccacatttatatagatgtcaatgaatctaaacacatatatatagctagattcattaacatctatatgaatataggtaatgctagaaagtcttataatatgaaacggatgaagtagttgtaatatgcatatgctgaggaaaactacaaattgtactgtgagatttatgttccttgatggcatatcaattaattaaacttagctatcctttgtttatttgcatatttgtggagtgattgatggctccatagtatatgttgtcaaattttccatgtttatttagatggcatgcatgcaagaaattaacaataatatatgatcaattttaaggtctaaaaagacttctccatagtgataatagagctgtaatgtgtgtgagtttttgtccaaatgcatatggaggcatgtagacattcatagaaaaagttgatgacacaaccaatttagcattttagccacaaaaccaaaattctcaagtcagaaccaaacagccgacctaggaaactaagcccacatctaatggcgccatgcatgaagataagatcagaaattaagccatatacatcaaacccacacacactgacacagacacatttgcaagaagacatgaattgcaacatacactttaacttgacacaaagctatccataatctctctcccccatctgtaattaatcaaaccaaaaacctctcattatatatccccgataagatatcatcatcacctctatccctatcaagggcttagcgtgggagcagatggctttgtggcaatcaaacaaaggctccaaaaaggcattgctttcatgagggagaaggttaaaaaaatgaattttacattttgtggagtgaaagtggtgtgtggacatgtggctggtgaggccactgttctcccattcatctagaatgttgaattcccagcatcctatttatgttgaaaaatagataggtcgcaatcgcttatacgtgtatgcataatattatgtgtttgcaaaacctatgctccatcaagatcaacctcaaaaagaaatggagacattgttatcctctttcttttgtacactctctctggatttattgattatccacttgaaaattttgtaactggtagcatatatccaccattgtaaacatactttctactttgatagatcaaagttgtggcaccatacaagtttgcactccattattgacccactgaaatgtgcaataatgcaaattcatttatgtattcatggatacactactctattattgacttatgtgttcatacctgaggtaattgttatttgtgcaaaattataagacaattaattaaatggaaataaaggacaaaagaaaggtgacaaaggctggaagaaagtagaagcattctttagagctaaggctagcagtatcatctgcctgctggtggagctcacaatctatacatgatgcattcaataagccctttcttgtcctgcatgctacactgcatgtgggcccaggacatgttatggtcatagtgaccccactattaagtgcaaatgaaagtgacctttcatgacttttgtagtactgctatttcatttgagaaaaggctcttggggcaaatcatgcatgcatccttcatgatttccctaccaaatcactacactgcatttatttgagaggaaaatcactctacatgtctagtgttgcctttgtatatgtgtatggttagtgtaataatttatctgccaatcatcacaatgcacttacttgtactgtagttttctagggcttgaccatatgaaaggcattcttcaaccactcaagtattcaatatatacatcctgaataataattacttgggttaccaactggtacatactggattcatattaaccaaagtttaccttaattttctttgtttttttttgaacgaactggtacaaggtggtgcaaatgtaatttaatagatatctaggaaaaaaactttctatgcaagtatgaaaaggaaaggtataaaaaggaaaaagttctatacttaatttttattaatgcaacattaccttctgaaactagatcatttatactactcactctgtcccaaaataagcgcaaccagtttatgtgtccaattttgatcatccgttttatttgatttttttataattagtagttttattgttattagattataaaacatgaatagtactttatacgtgacttatgtttttatttaaaaaaacaaataaaacggacgattaaagttggacacggaaacttatggctgcacttattttgggacggagggactatatatcaaattgaacaacaaaaaaaaatgttcattgttgtgatttttcatattaactaaactgatctaaatcttgcaaaatcttaatgagagcaacattgctgctgactgatgagagaggtagcagtatagcactgtcttctttttccttggaagtcagctgtagctgatgtgatcttcccttttcaagctgttcaatttgtagggcctgatcttccctttgattgctatgcacattgcaatgttctgaaaaacaaaattatggtttcagaatgtctatccatagatcctaatactgctaggccttagaacacttgaagaactacactcatgcttataaggctgtgtttagttcagctcaaagtttggattttggttgaaattggagatgatgtgactgaaaagttgtgtgtgtatgacaggttgatgtgatggaaaaggactgaagtcagcctaagttacaatgatctttacagtgatcgatctgcctttcttgctggtgcaacctatgatcctctacctactcactacaagtagttcctttcaatattttttggagtataataatctaagagcctcgatgtttgccaatcatccaccaccaaaaatttattttggagttaattttaagttatttttaacgtagttacttttttagcgttagttttaagttgctaaaaatctggtttttaaatcttcggctatagtagcggttatctccagctatagctatttgagaagggtctaactgtttggtctcatgcacaatttacctactatagtttcatttagtccgctataactgtttgagaaagccaatcaaaacactgctacaaacatatatatgcataaattttactcagaaattattttttattgctaataagctgttttggcatataatcagcttttggccgattgatggggctgtaactatgatgcattgatctaatgtatgaaacgcattatacttcacagtaagttaaacaaaccaatattgttgagtttattcatcgacattttttttaataatgtattttataaaacctagcctctacaccaatccaacatgagtgtatacagccacttgtgcatagacattactattaattagttagttcatatccagaaaccagtcaatcaagcagaagcagatcatttcagataagggcttattttaccagggcatgacgccaatgacggcaggatcacactaaaagttctgaatttcttaagacagattagcaaaccagttgtcgacaacgtctttactcagaacctgacaaggcaaaccatgtgtagagaactagagatgacacctctatcaaaccagagttaaattaattaccataaagttaaactatagttatggatgcgtcacgcatgctcaaactaaaatatcctatgtgaaattgccaaaaaaaagtatattaaattaattataaatattattgctacacgaatggatgtgataacatctctatataaataacaatcaattaattaccattatcaatggacgtacttgtgtaagacaaactccccaaatatatgatttggtgtaaattattaacaagatgagatcgtcatagaatatgccaaacttgtactacattaattaattaaactgtctacaaattaatggtgacacattggtccacaagaattgaactagatagtcaacttaatcgcgcgcaattcctttccatggacaggaaattggaataggtatagtactataattttaagttacaaattaagatgagtactgaataatatttgcaaggcacgaatggaaagcgacacatatacatgcaaaactgattttggaattatcttttcggaggatttggatacgctaattatattagggagttacctttcgtgttatcgggtaattaagttccatgaagtacctaacatatattttaacatgatgcggaggccagcttggcgcgtgaggcgcgtccggtggaggaggccggcttggcgcgagagacgcggccggcggtggaggaggcgacctaggtgtgaggaggagcagccggtgggtgtggtgcggtcttcggcgcacgaaggctggccggcgggggacgccggtgcaagggtcccacatgtcggcagagcttgcgtggtggtggagcatcggtgcgtcagccgtggattcgcaggtggtgagcggcgggtgaaaacccagtctggccttggccggaccgacaacgatggttcattccccctcctgagggcgttgtcgtgctgtctcacccctcaagggtgattgccgggtgaaagcccagtcttggctcctttgagtcccgacggacggcggcggtagttttttcgtcgcttctcttcttgaagacgccgttttggcatcccctagggggcgatctcgtctgtgtccctttgttagtctagtggcagtcggtcatgcttagcggcggccggtccggtgttagtcttctcctggacttgtgtgttggcaatgtcggtgtgtgggtggtggcatatttttttcctggttacgaccctccaaggttgtaatcttgtattttttttctgctctatcaatagaactttgcaccatctcgtgcaagtcgttcaaaaaaaagactagtttacagtgatgggggatatatactctctacatgcagacttcctcaaactattttttaagataataaaaatgttttacatctacatctccaacctctgtagttgcgcacacaactgatgagtttgaatacttcaaaaaaaatgaaaaatatataagaaacaaattggtgggacaaacactcaacttcctcaaaactgaatagaatatatagtgaatattttgataggactatagttgggatttagattcaagtaaaaaaatatgtatatttttctagctttttattgttactagagattccctgttttcctctttgttttatgggggcaaacttggacagtgtcaatgacttacacctaaccagcagttgatgggagactactacatttttttgcagttggtctgtcaaatcattttaggttgtgatcgcctaaccaatgcagcatatacccatcaaacaataattaagcacacatcatcaagggaaaagccagtagttacacaactaaatcattatcccttttgcttatccattaataatgatgagaaaaagaagtgtgagtggggtgttgtctctataatttgtgacttttagtgagtttagaatgcatactagtgtccttgctagtaaaaaagaaaaggacagattagtgtttaacatgtttgattatatatggttcaaattaaatcactcatactactgtggactgtggcgtgtgctttgtacgcttattttaaaaataaagtctatgaatctcaattaaagcaagccattgctgtgcatgttttgtgagtgcaaatctctgctttagctttaaaaataaatcaatatctatatataaccttcaatctaaaattttatcatatgcttcatccagatttgcgctcacctaatattaactaccttgacgcgaaagggcctgtagcctagtggttacaagagtctcagtagcacctgaggtcctgggttcgactccccatgggagcgaatttttcaggatttaacggcgttgtgctttcagtgataggcgacgtacccgtcgacagcgaggcgcctgtggtgacttcgtcaatctctccagaatttgccggccaagtcttcgaagatgctcataggggtaaggtttgcgtgcgtgtgttcataggggtgagtgcgcgtgcgttgtgagtgtctgcgttgtactgtgtaattctcaaaaaaaaaatattaactaccttgacatgaaattagtagacttttgaaaagaggtgtaccgaagcaacgccctacctgcacaaaataagcaatgtagtatatggagagatcatggcaggatgaacctagctaccagtcaagtatctttagggcatcaattaattcttgccttctattatgtactttactctttgagaaaatcataatatagttctgttttggactaaggatttttttaattagtttagttatgcaaaatttaacattgtgccaaaaacatcttctcaaccttataaacacaaaaagtccagatatgaaggccaaatggtgcaaaatatccagataaggaaaatatatgacttacgtgtgatccaagaattaggcccaattggaatatcgtgcagttccttcgagctgttcacaaattagaagacagagcagatcatttacgcataattaattacgtattaactataataaatttgaaaattattttttaaagaaacttccatatagctttcttgaaaaaacaaaatattgtttaccaatttagaaagtatgctaacgaaaaatgaaatattgtttcggttgttcaaaaaacttagtcttacttcggaaagggtacacaaaactagctaacttggttagttgggtatacaacgtaatactagcatatcaaaccaaaaccatgggtttcctaaagtctagctaccggttttcaaagggacaagaagttattagtgaatgatccatatcaaatcattgtatcagcagataggtgcaaattaccactcttagctaggcctcattctcccaattatcaactctgtggtcttagcggtcatggaaacaaataagtcaagtaaaaaaatatcatctaagaaaacaaagactcggatatattcaagtatgtagtaatagtagtagaaaatggatgaaaacaactactacatgcttcaaattttcgtatgttggtaattgtatatgcaaaattaagggtgattgcttgcatatcatgatatcgttatagtaacaatgtagttgctttttagaaaaaaaagggataaaatatacaattgaaaaaaatagaactagaaatgattgtttggtgcaatttagatttaacctatcctttctcgaaagatgtattgtgcatgcaccagcacctacctgaagcagacaccttacagacagaacaatcaagtggaaagggacaaacaatattcacaaggtgaccataatgatgcgatggtttctcttgtagttccattggaaaaaaaaacataaaaatcaaaaccggccatattgtcaaagtatatataagcatccatggttcatgaaaactagcaaggggcattaagaaaatgaatttggacaaataggtttaaaccatactctttgcgatttttttagttaaccaatgattctttaatttagattccatgtgtaatgtataaatcatcaaacaaagttatttacgtcgaacaaaataggaaataactagggtaacaagccattatttacatcgaacaaaatagaaaacaactagggtaacaagccattacttgtatcaagtaatcacgggaacaactgtaattggtattaaaaggttgttgctattgatatttcacaagttctacaaaacactaaaatatatcatgctatccattcactcattcatgtcctgaaaaatcaaaatgtggtgttgtagctgataaatccaagcctagaccaccttgcaaccaatccaaccgctgtccatcccagcaaggaaaatgagatagtgttgctatcaaaagacaaaaaaaaatgtaccaaatgaaatcataaactacacagagaaaaccatacgatgtatctggacatgtacaccacacgcgagagtagaagatcccggaaagcacgtcatcaccgctctttggtgcgcgctgtgcttgtaggacggttcaccaaaatgttcttgatccaaaatgggagataacggttttcctaatgttataaaaaatgtttaaaaacagttgaatcccaacacaatatgatcaaattttaaatattagcttgtattttttttgaaacttaatcagaaaggagccaacgtcaaacttcgaattttaaaacttaattttagagttgatttgatgtttttttcggcgtagtttttttcggctttaacttttaagttgctatggatggatatacaaaaattttactcacaatttttttctcagtaataaactgttactaccttataatcagtcataaactaccgatgagcacggtcattccggggggatttgtttttggccttttggaaaaagaaaaaacgccgatccctactgagcacggaaggcatcatcccggccgcgatgcgcttgtggccgtgtctgtggcttcctgaggccgcgccacgtgtacttggtcgaatcggcccggtccaaccgaaagcgaggtgggcagtgtggagcccaccagctgggccgggatgaactgtatctttttgggagggtttgtttgtgtagaactgtagatcaatcagtgggtttggcttgtgtacgtaagcatcaaattatcactgtcaaatatatacgtcattgtccagtatttaattagttagtaaaattttaactagtctctcagtcccaaaatagttgagaccagatgtgacacatcatagtataataaatctagatataagtgtgtctagattcatcataatatgtcaaatccgataggaagttgagtttattttagaacagattgagcagttcttaaaaaaaaagtacactttgacgtgtgacagtcacttatactgccagtttaatagctccaacccacacaatttttttaatatgttgtatagagtttgtaggctaaatcagtggttattttactgattttgctagaaagctgctaatattttttcctctcaaaactaattttcagtttgtggccatccagttgtcgaacccggaatccttggtgggaagccacgttagccaaccaaccatgagtaatttttagctgaatttacactagttacatatcgtatatctacaatataagtacactttaattatattatagtatatttgatttaaaaaaaactgacgaatttgtatagctaattttttaaaagacaaatcagtggcttcgaaccactatttatgttcttccataataatcagatgatggctcaccaataactttgtctaacctaactctatctcaaaaacctagctctatctcaaagaatatttagagctaagataccaataaacccaatgaatactttgaggctggttgtacgatactaccatctccattctaaaataagtttatttttcacttatcccacacataccaatacaaaaccacaaatactataatatccctacttattaaatatctcaatgcaaatatttctcactttatctactcccaacataattattttcttttttataaactctaatgcaatgattattaaaaataaacttattttgggataaataacaggagctaatagtaaacttattatgagatggaggaacaggaagactaaattaaactgaaatgattgtgctttttttcgaggaatgattgtgcgatttttaaccattattctaactgttaatgtgattttcaaaggtacatttgaaatgaagtagttattaacttatttatatatcaaaataggcagcgatagcgttttcagaacacgacagttattacaatatcatagtatcacgtgaacaaccgtgatggttgatatgaccactaacttctatatagcatcgatatatacattttttattattttgaataatttcatatggtttgtttttttttttcatgttggatgtttggttcttaccaattaggaactatcatcaaaattgaatatacttattttgattggtacaaaactgtcgatgttttatatataaaagtattgtactgtttttttctctgtgtagctaattttgatattcatattaagttatgctataaatgacataacagaggcttccagtttttatagcaacccctcagtggccacttttttttaccaggcctccaaagccatgattattaaggcgctatgaatctcgaaggaaattcataggaattttagagggtttcattcatatatgattttttactatatagccctttgaatcaaaggaatagatcctatggaatcctatggaattcctatggattgtcttttcccatgcaagttttgaaggaaatttaacatgaggtagaacctcatggaaagaatcctttgtgtctttatctctcctcgaattcctgtgtttttcctgcgacccaatcaaacagtcattcctatgtttttcctgtgttttgcaatcatctgttttacacttgcattcctgtcagaatcctatgtttttcatattcctctgttttttcattcctgttattcaaaggggccctaagggcttgcttgtttgtgttgtggcttataattttaaattttagaactttatttttaaaattaaattaaaggttttgttttataagtttattttcatttgggtttgactttttttaatgaaacacattacaaacgaaaacgctcataatatgtgcacactcacatctataaatgcacacacacatcctactcctatgagcaccttgagaagattgagtccaacatgatgaagtcaccacggatgtctcgctgttgatggatacgtcacttaccactgacagaataattagccgcaaatgtgagcacccatgtcaattttagaacttgaacccgactaggttggtttcagcaaaataaactaaccagttaaattatactcacttcaccttttgggtttgacttttgaccgcatatagcagaaaggcaaaagccttaatttaaaattacaattttcgttattatagaaaaatatattgaaaagtacaaccacagagtttataacttatttctatatatatagagagtaataataacatagttaaaatgtatacttgcatgtttaggcatggcggataataaaaataaaaaataaagcccaaaaccctatcgaaaagatcaaggcaaaatttactacagaatacttaaaaaacgtgtaattagttgtgggacaccgcaaatatgtgaattggctataggacatcccaaaagagtgataattagctactaaacaccggagacattattttatcatttctggtggaaacggagagaggaacaatggaaaaaggaccagatttccctatgtgagccaaggatgtcagcatctccactattttcatgtcctcttactcctgatgaggcacaccacacgcaatacggcgccgctgacaccgtccttctccatcacgccggcaggctcgtacgcaaacgtgggtagggcatcgatggcgtgataattagctactagacaccggagacattattttatcatttccggtggaaacggagagaggaacaatggaaaaaggaccagatttccctatgtgagccaaggatgtcagcatctccactattttcatgtcctcttactcctgatgaggcacaccacacgcaatgcggcgccgctgacaccgtccttctccatcacgctggcaggctcgtacgcaaacgtgggtagggcatcaatggcgtcgcggacactcacatcgtgcccactatgccacgtcacgctctccgcgcgcaccctcgccgccctcgccgccgcctgcgcacagcgatgcagccgcaaccggcgaggacggcgacgccaatgcaaggcggtaggtgctgcatcgacgagaagtggtgctattccatcggctccttgccgtggccgccagagccagtgcccgaggcagcggctgttgctcggcttgctcctctcgccttgcttgcgcctgggctagcatctgatgcacctgcaccgccacagccccagacggcggcttcttgatggcatgcgactctaacacaagcaaacgacacgggggtatgttggtacttccagcgctctttctctctctgtttccactagaataataaaataatgcatcaagtgtctagtagctaattaccactattttataatatcctacagccaattcacatctttattgagtcccacagctaattacacgttttctgagggtcccgtagcaaatattgccaaagatgaaaaccacatttccatcagcgcgcgaaatcccaatcctacccctgcacaatgacatccaccgaggggcaagcccgtcatttcagctgcgcccacggagtccacttccccctcctcccccacaacggcgacaataccgtgagccacccgccgggcccacctgtcaacgtcccctccacccactacgccacgtcacccccctcccgcctttataaaacctcgcgaacaaactcctcgtcgtcccccctcctcctcgtcgtcgtcgtctcacccaacgaacttttccggcgaactccccgacgagatcgatggccgccggcgaacggcaatcgaacaaggagtactaggacgcccttctttgttgtttcttctcggcaagatcagttggttggcaccacctgccattcttggtttggaagtgtgggagggaggggttcggttggtcgatgccgttgcggttgccgtgcgcgatggagacgaggccaccgcgggcggcggcgccggcgccggcgagggtgtcgaggttccggaggctgcttgtgcgggtgttcgcggagccggagcgggcgggcg

SEQ ID NO: 27887 - DNA, 1810 bp, Oryza sativa
cctcccctccgactcctccgccaccgccgccgcttcggccgccgccgccgccggcgacgccctggacgcgttaaaggtatagggcctttttccccggctcgattgttgtttccaattgctcgccggagtgatcaacgctttgtgtcgtcgcagggcttggtgcagagcgcgagcatggcggagaggaacctcctcgccgacgcgtcgaggatcgccgagaggtgccgcaagggcggcaagaagaaggccgacgtccgctgcgccgtcgccgacggcctcgccgccctcggctacgacgccgccgtgtgcaagtcgcggtgggacaagaccccctcctaccccgcaggtaaactaaacctcgcccccaattcgatgctgctgaatcgccggcgctgaccggcggcgacggtgggcggcgcaaaccttgtgcaggcgagcacgagtacatcgacgcggtggtggcggcggagacgcggctggtggtggaggtggacttccggtcggagttcgaggtggcgaggtcgaccaaggcgtaccgcgcggcgctgcaagctctcccgccgctgttcgtcgggacgccggaccggctcgggcagatcgtcgccgtcgtggcggagcccgcgcggcagagcctgagaaagaagggcctccacgtcccgccatggcggaagccggagtacatgcgcgccaagtggctctccccgcaagtcctccgctgctccgacaagccgccgccgccgccgccgtcgcccccgcccacgccggtatcgctctccagcttctccggcgagttcgagctacgcttcgacgccaagaccccaccaaacctcagcgccaccgccgccggcgacgacaacgacaacgacaacgacgacgaggtcgaggcgaagaagattacgatggtggtgtccccatcgccgtggcgcccggtggagccggaggcggcgagcaagaaaaggtcaccgccgccgccgccgcggcgccccgaggggaaggtggtgaccgggctcgccgccgtgctctaaccgcggcgaagaactcactttactacactagctaattaaccagctctcctccctcgccaattttctctgttttttttttcatttttccatcgccgctttgatccgtccgaggcttagctcatggtgttttctcagttttttttccgattttttggaaaaagacatttacagaaaacacctccatttttcttttttcttttttttattctagaacaaattttggtttccacaaaagggaagtgcaaggagcagtagctgtgacagcttctaggccccctattgttgagaagaggatgaaaaatgaaagtatgaactagagatatgcaacattatctggttgcttaatcagatcttaatcactacttgtactagcgtgagtgtatcatatcacttggtatcatcagaggctcagagcaggcagtaggagcagtattaaaaaatatgcaagtatggagtactactagtagtgatgcatacttctaaaaaaacctgcagcgtaattatacttcactaaccactgctgcgaaaatatttggaattccaaattttcaaccactttgccacaaattagatagagcaagtaaaccaactataaacatacatatgtgaaaaagatacgagaagtgaaaaaaaaagagagctataaatttatagtcaaattatagacttctaataacaatagactttaacatgttgtttgtgtatgtgagagcttgtttgtgtatgtgagagcagactaaatattaatagtgtagtactacctctgttttttaatagataacgcc

SEQ ID NO: 27888 - DNA, 844 bp, Oryza sativa
  unsure (1)..(844): unsure at all n locations
tatnnnnnnnnnnnnnnnnnnnnnnnnnnnnnnnnnnnnnnnnnnnnnnnnnnnnnnnnnattccctccgtttcgttccgttccacgatataagacgttttttatctaaatatactagcatacatatgaatttatacacatctataaacatatatatggatccatatatgaatctataaaatcccaaaacgtcctataatgtgaaaaagagaaaaatacatctatttaaaaatatagcaatcgaaagagatacaacctaatactacgaatctgaacagatatattggtaccatgattgtattcccatctaatcctagatttactatattttgcaactaagagaatactattctaaactcatttctctctctctcctatgtcggccggctttgctgccatggaaaggaaggaggagaccgacctctgcacgaccggcgtctcccgccaggaaccccagccaccggacgacggatcagccgtacgtcgccgtgtccaggaggtagcagatcgagtggaggagggacacgggaggaaggatcggatcgagtggacgacagagagacttgttgttgacgaggaagtgatcagatcgtcagggacgaggaaaactctgtgaaagaccgtagctaggctttgccgattttttctcaagtcaattctactatggagtttggaccacatgacactcacagcctagctaccacggaaaccccaaaatcctactcactccctaggatttttttttaaagaaacatggtagtacacttgtccctataaacacacgtacactttattcatatttataacaattaatgtattgaagttggttgatacgaagaagaga

SEQ ID NO: 27889 - DNA, 2015 bp, Oryza sativa
  unsure (1)..(2015): unsure at all n locations
nnnnnnnnnnnnnnnnnnnnnnnnnnnnnnnnnnnnnnnnnnnnncctttcttctagacttgatcaccgcatgctagccaactcaactacatacaagtcgactaccaagtcacccggtatttgaaacgtattccaagtagttgtgtatagtacgcatcgtgaaccttttagataaacccctaatgaaattggagtgccaagtgccaactttctgaccatcacgaggtgtacttaataaccataaaatttctccagttcttttcttgcaaaaataatcacctcctttttcatattttacttggcgcgcgcggggtatcatattctctggttaaataggactccctccgtttctaaatatttgacaccgttgactttttagcacttatttgaccattcgtcttattcaaaaacttttgcgaaatatgcaaaactatgtgtatacatataagtatatttaaccataaattaaatgataggaaaataattaataattacttaaatttttttaaataagacgaccggtcaaacatattttaaaaagccaacagcgttaaatatttagaaatggagggagtagaaaatttcgcgcgcgagtatttaaccctgaacgtctggcgccgcgccgccagccaccgttgacgacacaccgacgccggcctttgctctgcagccaatcttcgcaccttcttggtctcttcgtcgtcatcgccgccggaggaaggcgagcagcagcgtcgtcgccccgacgaggccaacgtacagggtcgcggtttcttggcttttcttttttaaaacttacttttgaataacggggtttcgatcttggtttgattttgagcgctgatttggggctctacaactagacccatagatcttcacaggccgacccaatttttggctgtgattacctgtctgcatagttgtgtgaggaggggtccggtttccgaccacatgcgagactgcaaagatccattttcgcggacgaacaacttaaaagggtcgtctgcgataatgtttttaattttgtaggcgaaccttaagccgtccacttgtaaaaaaactaatttttataggtgaaccgctaggagtgccacctgccaaaatcgccgatggaacaactccctaaaaaaatctatgtcgtccccgtgtaattcttatcccaatataataactctatcgactaccccaaccttagatatcctctccctctcaaagtgcgcagcggcggctcagtgctgagaggaggagcagcggcagtgaggtaggggtgccagcggcaggagctcggctcctccctcccctcttcttctcctccccgcttctcccctccaatcctggcaacagcggtggctcggtgatgagaggaggagcggcggcagcgatgacgatggcgaacgccactcttcccccactcccagcaacggtggccggtgggtgctactttcttggcctctctcctgtctctacctctccctttctctctcgatctctccagtctctactctgccactgaagcgcagcagccagcggggcgtgggagtagagcagctggctgggcacgggatccgccgtcgccgcgaaggagttgggggtggcgcggtggagggcaaccacgatgacggacgaccaaatccagcaaagacaggaggtggtggatccggccgtggcggatccagtggtggctgtggcatccgtgatgacgatgatgaccttgacggcgatggcatccatgaccacaacctgcttgctgcgacgatggctggcggcggtgggcgaccttggcccgggtggatccagcaggctttggacggttgtgatcaagttgtggcggatctggctagggtttcgattttaggaatttttattttttttaacaaatttttcttttcacagtcaccctaattttcgcatgtggttgctacctgcatgtaaaaatttgattttcgcagacatctgagtnnnnnnnnnnnnnnnnnnnnnnnnnnnnnnnnnnnnnnnnnnnnnnnnnnnnnnnn

SEQ ID NO: 27890 - DNA, 1012 bp, Oryza sativa
gttttctacaccatgaaagatgcacaatactgaccagaatcaatgcacatggataattggatacctatttgaaagagaggttcagttcatacagaggactaaaaggcacttaaacagttgcatacctttgctcttagggcttcaatgtctgccattagtaccctattgtcaatagcagcagcactgtacttctgatttgcatcagcaagacgcctcaacagagaagagttttcaacccttaatagtgatacctgcaatgatttagcaacaattacacttgttacttacatattccaaaactttgttgtgcagtcaaatggaatagtgtaaaacacaaaacctgctcctccaggtcttttaggcgagctgcctttctgcttcttgagcgtctagctgactcccggttggattccttcctgaaattggacaagaacacaagctcaaatctcaaatatccggctgtatttattacacaaaaaaagccgacatgaatgtctgactgctgcgaaaaaaaagaccacagtagataaactcaatttttcatatgtagaaaaagcgactagacacaacaggacatgatattcccagcatgttatgaaaagcaagaagcaaatgcctcctaaattgttctaatcatacacgttgcatttttccttttttgcatgaatagctgcttgcgcggaaccaataattatccttaatgcaccagcttgtagcaagcattaccaaaatccactcaggtctctatgcatagtggcgcctatcgggtctcagaactccccaaagtggcaaaatatgctgaagataacttattgagtgacattttatcctttgcactttaataagtgtaatgttatcttttgcactcctgtggagtggcatattgagcgttttctcaagtacgttgatgtccacgatgcaaatgcccgggcttttcacggccatgtgggccccacttgtctggccccgctaatctcgttcgcccgcagctaaaccaggtgacgtcgaaccc

SEQ ID NO: 27891 - DNA, 759 bp, Oryza sativa
  unsure (1)..(759): unsure at all n locations
nnnnnnnnnnnnnnnnnnnnnnnnnnnnnnnnnnnnnnnnnnnnnnnnnnnnnnnttcaaagggagcaataatagtacagtacagcagctcagatcggaaccatgtactcaaagatctaatttggaccacactaaatatgcaaaaacaggagctttaacgtaagaatcaattaaaaaactagttggattgattgaatctgtgatcccaaaatttgtagcagcgaagtacaaatttcatctcagcccaatttcccttgtaaaatactaagcttcagagtggaaagaaatcagggcagattttgatccttttttgaaactaagggcagagttctagactatgaataacaaaacattaggatcttagtacacccaaaaactccttttttacctcagtttggtgaaaaaccaaatcagaaggcatcatcgagttggaatcacgaacaacagcagctcaagtcggaatcaccaacacaagaaacttcaagatgggatttttaacgcgcaatctaggccaaaatgtaagagttggagtacaagaaatccaaagaaaccagcatcaaaccactcctcacctgcaacaagaagccaaccaacggataaactcgcctcgccgatccaagattctcaaaatgaaaacagttttcccctctccagattaaacaagcaactcctaaatcgggattaacccccaactcgtctgtttcttccatccaattcacgcaaaaacagaaagaattaaagagctcgcaaaaaatttcg

SEQ ID NO: 27892 - DNA, 784 bp, Oryza sativa
  unsure (1)..(784): unsure at all n locations
nnnnnnnnnnnnnnnnnnnnnnnnnnnnnnnnnnnnnnnnnnnnnnnnnnnnnnnnnnnnnncatggtcttatatatgttcatgtacgcttcctatatgagattccttgtcatctttctgatttgatggatggagtaaaagtaatttactggtactatccgatcgaacaaaattcaggtaattgttggcggtacgatgaaaaacaggtatgctcatcagcaatgtatggttacattatagtaattcgaaaaggggccaaacgagctcagctagtatattaattgtttgatcaatataatgtttgatgtttgaatgtaaaatgtcatatatattttttttccaagtgaatggcacatatctcatacctgattgtctgtcgctattcacaagcataggaatgacataaagtttagagtaaaatatttcattagcacctgatagctagtgttcttatacaagtcacatgtcatgcatgctaccgttccaggttcaaaaaaaatacaatggctccgaccattccagatagagtacttgcaataggaccatgggagccctacgaagcctcgactaaattttttttatcatatatgcatttgaagggaagctatagctttatctaattatatcttcttggatccgccactgtccttaagtaaccaatatatgaactaaaaagatacataggagtagtaggcacctgaaatgctagaagcagccgacggcggtgttctctttggaggtagtagatgggggcagtggtgggtgccttcttggggcagacgac

SEQ ID NO: 27893 - DNA, 940 bp, Oryza sativa
  unsure (1)..(940): unsure at all n locations
taacacctcaacaaacttgttatcaagcatggctatctctgccaaatgtgtcatttccaaaaaaaaaaagaaaaatcatacaagtggtttatattcgcaacaaagatgaatacatacataactacatccattccaatatactcctttcgtctcaataattcaatatagatgtatctatgtacatcatctataaatctcctttagaaattttagcaaaagaatgaggttaaatgaggtatggtgggtgagaaggtagttggagctaatatgaaaagaaaattaaatgatctgctactaatacgaagtacttcgaattatttgagtagtactctacgagtgtttatattttgatctaatttttaataaatactacagtaaaatttacttttattactggttgtttcgttttgtaccaccttttcacaatttttttttcactttaaacattgtaaatctaccttttgtggcactttaactacctttaactatctacatcaacctatcgtatatcaaacaatagtgtaaatatagctacgtaagttcattgacgaataaaagctggcatactcgaaatcgtttatatgcattagaagagtatcgaggtgatccaaaatgaaacaaaggtaagattacctgaagtgaaaacaatggttaaagtgtgatccaaagcgaaacattgataataaaaaggtgacacagtaaaatatactctaaatactaaatgtgttcatagttttgaattttgggaagaaaactcatgggagtagctatatttatggtgccatattttttaaaaaaaaatcaacatgccctttacattgtaagtatctaaattacatatgtaattttagtgtattcataatgtaagttctannnnnnnnnnnnnnnnnnnnnnnnnnnnnnnnnnnnnnnnnnnnnnnnnnnnnnnnnnnnnnnnnnn

SEQ ID NO: 27894 - DNA, 1302 bp, Oryza sativa
  unsure (1)..(1302): unsure at all n locations
caagctacatgcctcaattaaatcaggaataatgtacatttgtgaatccaaagatttgaatacaggaatgacggtgttaacatccaaattcaacacatatatcatattcaaaatagaaaaacattactaaaatttggaaataactgttattccttcacggagccggtctgacaccgtaggtgtttggtcggtctgaccggcggctcatggttattacatagatacacgtcacgaagcgaaataaaaggcataggcttccttcgtattagtgtcggcgcaagcagaatttgcaatgaggatccttttcgcctcggaatccccgaggccggccttgaccatgagcagccagacgaaggtgatgagctcccctccacaggccagctccgccgcgtgcatcggcccccgggacttgccggcggtgtagatgaggagcctcgtccacatgtccaccatctccctcaacgtttcgtcgcatggatccaccatctcctccagtgctcgccctctcaccaccttcatcagctgcgcagcctcagccagcgtagcctcggagctgacgttgagcggcagcatggaagggtggttcaccaagaggtacatcatgtagttggacagcttccggcacacctccatcatatcatttgcttctcctccctgacctgcttcttcttcttcttcttctgctgcagcagcagcattcatcaggtactcctctgtgaatgagtgaatcacgacaatggcagcaccaaagtccgcggtgaaatgaactcttatggtttcgaggaatgggccaagctttggccatgcccgggacgcgacatcggagaattcgtcgcggatgcgattgatcccctccaccacaaactccatcgtcttctcatctacctctaggaacttagtgtccagcagcttgctcatccaaaacaattttttctttccaacgccgactaacctcgccgatcttctcaccagagccatcactttctggttgcatgatcttgttggttggtctgatccagagtcccagctgagtaagctgtactgtccaatggaactagaccacagtggccttctctcgggccacccaatatcactggaaaagaggaaccaggacaagttggctagccagtctctcttctgtgcagccttcaaccagacccaagtccatggagatgttatgacaataaacatcgcacaaaaatctaggaaaaagcctccgataaacagtgaatacgtaactgcaatnnnnnnnnnnnnnnnnnnnnnnnnnnnnnnnnnnnnnnnnnnnnnnnnnnnnnnnnn

SEQ ID NO: 27895 - DNA, 1790 bp, Oryza sativa
  unsure (1)..(1790): unsure at all n locations
tttttacggggttttgtgttcagacgaggcgttggatttgggcggagattgcgaggtgaagtagtagtagacgaggggagagtaggagggagagaatgcttttgatgacgtgaagggtgacgtggccggtggagtggggccacgtgcgcgactgaccgagtgagctggcttcgcggcgcgctccggtccgttgcgtgtttgacgcggggtgaagtgaatgaacccgacggtttacgaatttgggctgtgtttactgtttagatgcaaggtttggatccaaacttcagtcctttttcatcacatcaacctgtcatacacacacaactttttaatcacatcatctctaatttcaaccaaaatctaaactttgcgttgaactaaacagtcttagttgtgtttagttcacactaaaattagaagtttggttaaaattagaacgatgtgatgaaaagttggaagtttatgtgtgtaggaaagttttcatgtgatggaaaagttgaaagtttgaagaattatttggaactaaacacggcgttagttcgaattccgtccgaagcttcctcaaaccgttcgttttggatcaaatttcggacaaagtttcagtgttttgctaagggcatgttcactttgatacttaaaaaaaatccttactaaattttggtattgctgaaattttgacaactatgccaaaattttggcaagatttcattagttaccaaaatttggtagcaaactaaatgtagccacttttttggcaactttaccaaaatttggtaaggttgaaaatgtcatcaaagtgaacaggccctaaatttgtcgtaacgctaagcggtcccgcaaaacagaatgcaaaccaaggaacagtggttgccagcacagtcgaactgtcgaggttttgtttggaagaaaattcatccagaactcaagttgccactgattcaatcccgtgcaatttctgcaacagcacgagccaagacttcttcctcaatcattgacggtaacagagtttggttaactagcaaactcgtttcagtcagtcatcacagtgattccaggattaaagcaatggcacgaccatattttcctcaactaacacaaccacaaaacagacaacattttcctcaccaaaagcaagataagattgaggctcgctcaacttgatttaggcttgctaggcatgcccactgacaagatttcacaactcaaaactcatccaaccaaaattgcaaatatgtttaagtaggctgaacactgtgaatggaatcagcgccatggtgaccgagtaagccatgagccctagaacaatatgatacagcgatacaagatcacagcatcaaaatacaggacatcacagagaacatggaagtgcatacataatttagatagctggtccaaaccacatactctatgttctcacgacagcacattaacaaaacagagaaactagtctcaaaatcccacagataacttcttatggagatgttcaggtaaaaacagattgataaatccttgagataagatccggtaacgctgctactcaaaacttaaaacaagacaacgctcactgcgtcactccgagccacttcgagaagttgtcgaactcagcatagtcactgtctgagatcatggtcttgtaccatgcctttcttgcagccttaaccttagcagcctcctcttacaatgcctcaaccggaattttcagttagaacaaaaggcaccaagagattgaagtctccaaatggttgaggactannnnnnnnnnnnnnnnnnnnnnnnnnnnnnnnnnnnnn

SEQ ID NO: 27896 - DNA, 733 bp, Oryza sativa
gtatgcatgttgcatttgttctcaaaatggacaggttgtataacagttctcagatttattttcagaaacaattgctcttatgtggaaaagaagctggtttcatgatgtctgatgcctgacattttttatctgtgtaatgactggtttatagcatattctctaatatctacttcacctgtgtaaattagatagatgtctttcgtaaaccgtttcccctgaacaaataaaccatctgaatgcatgtgaagcccctaccagctgtttgataaaatcaagccatagttggatggtgttgtcttagttttcactaggctgcaaaatctgctagctgtttcatgctgccactctggctatgtgcgctcctattatattgtgtttgctcccctcctacaattaacatgtcgtccaatacaatatatttttgaagttttgccatattgttttctctttaaaatccctatcagctgatgttttcgtcctctaaacagtaagataccctgttcaagattatacccacatttattctggagagaagcgtcccttttcaacactggtaggttaaaccatatcgtcttgaaaaactgcatactgatcttttaatctcgtagttttgattttaatccagggtgatccttattatccattgagaggtcattcttgtcgtcgtcatgagggtagcacctatactacagcagcatcaaggtgatctgaaattctaaactatccccatatg

SEQ ID NO: 27897 - DNA, 424 bp, Oryza sativa
ttcatgagcgcctgaaaggttgccggggcgttgcacaacccaaacggcatgaccaggaactcatagaggccgtcatgggtgcggaacgccgtcttgtggatgtcctccggtcgcatccgcacctggtggtaccccgaccgaaggtcgagcttggtgaagaagcgcgccccatgaagctcgtccaggagctcgtcgacgacggggatggggaacgcgtccttgacggtgagggcgttcagggcgcggtagtcaacgcagaagcgccaggtgccgtcggctttcttgacgaggaggaccggcgatgagaacgcggagtcgctgcggcgaacgatgccctggtggatcatggcggcacattgccgctccagctcgtccttgtgggccgccgggtaccggtatggtcggacggccaccggcgccgcgt

SEQ ID NO: 27898 - DNA, 629 bp, Oryza sativa
  unsure (1)..(629): unsure at all n locations
nnnnnnnnnnnnnnnnnnnnnnnnnnnnnnnnnnnnnnnnnnnnnnnnnnnnnnnnnnnnnnnnnnnncgccggtgaaacaccctaagtacatgacgatgactctgtttgcccattccgtctggccgtgtgcttgaggctggaaagcctactttatgtacaacttggcgcccatcaacctcatcaactcgcgccaaaacagcgaggtgaacaccgggtcacggtccgagaccatggactgctgcataccatggacgcgcacgatgtcgttgaagaacgcctacgccacggtctaggcagtgtaccggtgccccagcggtatgaagtggccatatttgctgtaacgggcgacgactgataggatcaccgacttaccgtttaccctgggcagcgcctacacgaagtctagccccatgtcaatccaaacgacggtgggaacgggcagtggcagcattagtcctgctgtgtggaggcgctacgtcttatatctctggcacgtgatgcactcccgaacgaagtactgcacacattgacacatgtttgaaaatggaaatctctgtggatgcgatgtactggtgcgctggacccctttatgcccatcgttttggaccgctgtcactatctcaggca

SEQ ID NO: 27899 - DNA, 727 bp, Oryza sativa
  unsure (1)..(727): unsure at all n locations
nnnnnnnnnnnnnnnnnnnnnnnnnnnnnnnnnnnnnnnacgatttgcgcttcttattatgtgctggtacctatctacatgtggatgaaagaggagatggtccccaaggaccaaccaatttaactgtttcctgatgccaagcaatgccaacaaaacgaaatgatctgtgcttcttacttgtgctggtacctgtctccatgtggatcaaagaacagattgtcccaaaggaccaagcccatttaactgttacctgatgccaagttgccaagcaatgtcagacaaaatgacagggaaagttgtgttgtgttaagcttctgttacatgttaggcactgaacactccaatggtctaatgttcgtgttcatgttgtgttgtgggtgctgatggcatgctttgttctctagcttgcttcatttgttcccttggtggttttatgaaccgtcaaaaataaaaatgaggcaatatttaaaggatctgaaaaacaaacatggactcgactggaatgcaggaatatgaatataacagttaacagattcacagctcattttttttttgtcaacagaggaaaaactcgtgtttgaaacaagaaacgtgccaatacaaatatctaaacaaaggtaccaacagactttaataggacaagagactatctaaacaaagttacccgacaggctttaataggacaagagactacaaactttccatcattaaaaagacgacaaggggt

SEQ ID NO: 27900 - DNA, 684 bp, Oryza sativa
ctcctatgtaccttttagttcaataaatgggtaattaaggaccaatgggggatccaagaagatataattagataaagctatagcttcccttcaaatgcatatatgataaaaaaaatttagtcgaggcttcgtagggctcccatggtcctattgcaagtactctatctggaatggtcggagccattgtattttttttgaacctggaacggtagcatgcatgacatgtgacttgtataagaacactagctatcaggtgctaatgaaatattttactctaaactttatgtcattcctatgcttgtgaatagcgacagacaatcaggtatgagatatgtgccattcacttggaaaaaaaatatatatgacattttacattcaaacatcaaacattatattgatcaaacaattaatatactagctgagctcgtttggccccttttcgaattactataatgtaaccatacattgctgatgagcatacctgtttttcatcgtaccgccaacaattacctgaattttgttcgatcggatagtaccagtaaattacttttactccatccatcaaatcagaaagatgacaaggaatctcatataggaagcgtacatgaacatatataagaccatgatcccaaataaaaataagccagggaaagaaatatttttatttgggatatttttacttat

SEQ ID NO: 27901 - DNA, 811 bp, Oryza sativa
ttctgaatgtagtatattacaatgctaacaagtcatactcagttttattatctgcatgctcgtgtatggtaattaatattgttatctaaagtagaatagtgggaaaaaagtctcactatgttcctttcaatggttctggcatgatatgttctggtataaaaatacattattctttcaatgagcaattggcatttagtttggtcaggtttcttgtaagtcataggcttatcatttcagtactatgatagtttgtatttaaatgatgtattagcactgatttgcaacctgtgtgaccttttatatccacatgctcactttttggttgatatgtaggtgagagaggccttggagtatctacacaaaagccactttattttaagggaacaaacatgcatcgcattttgaaaggttttatggctcaggtactgaaaattaaaccaaatgatccaagtcctctggccactgcatatttctttgtatcaactcacagtatgtttttgttcttttatgggatttcaaatgttgaactgtacataattctagaatgtagatatgaatggcttgctagttatacagcataatcccagatttttttttgttccatttgcaggatatatatactgtagattgcattctagcatccattttttccctaactatactcatcttatcaaaattttcaactgcagggtggtgatttttcaagaggagatggtattgattcattatcccaggcatcttctttcaactgacttcttgctgttgtacactttataagctcaacgtcacatcctgtttccaggacgtggtg

SEQ ID NO: 27902 - DNA, 592 bp, Oryza sativa
  unsure (1)..(592): unsure at all n locations
nnnnnnnnnnnnnnnnnnnnnnnnnnnnnnnnnnnnnnactgaccactaggagattccaaggataatcagaagaataccaacctggacggactactggcggttggggaaccacgatatcttcttactggtgagcgtgcaccgtaggacatttcttccatacctgcacatgatggcatccaaacattaaattaatcatcatttttttttaaaaaaatgtggtaaataatctaactgcagtacctattaaaatgattccacctatcatttcttccatcattgtagcgagaccgaacaggggaacgctctggagatggtgtcctgtatcgacgtgcaaatgcatattgttgagtaaaaccacgccccttcctgacacgttgaggctgtccgttgtctgtagagcccattgctaaatctttaccattggttggcacaggttcagctctagatataccagcctctgcagtatcagcaccattgttgccatccacttttgttaaacttgcatcagccctaataggactgctcctagctctcgcaccaggatcatcccttgaaatacaaacaaacatctcaattgtgtactcaaaggat

SEQ ID NO: 27903 - DNA, 725 bp, Oryza sativa
  unsure (1)..(725): unsure at all n locations
nnnnnnnnnnnnnnnnnnnnnnnnnnnnnnnnnnnnnnnaaatgtgttccaaaataatgcaactcatatcttcttacctatcatcgatgaataaatcgggggagggctttcaatatcccatcaccgtacctactaatataactttcctattaatttggggcattttggctctttgtctcctttcttaactccaccataggaagctaaaatttgagtttttttggggagtatgttttttttccctagatctaaaagatgcacttgtactcatgatcatgattttcatgaccaaatacgtactttggcagtttgcagcatatggatcgattccttcagacgacgctatcaagtattacggattagaggccaccatggacatttatggctttaatctagagcatggacaacaaaccggaggttttatttggatttacaatacggatgaagcatctgccgtgaataaagttatagctggatggaatgctagttaaacttatctgcttgatttggaattgtaatttcaagcctacattagcttagctggttgatgctcaacaggttcatgagcttctcactgtcaatcgaagatgtgtcactaaacaagatactttgattaatcatttgcttcatgtcttttagatttaacatttaagtgtattgtacctcatacaaggtgaaccctgaatcgtacaatgattcacagacgcacttcagtacttgggttg

SEQ ID NO: 27904 - DNA, 880 bp, Oryza sativa
  unsure (1)..(880): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtgcttggtgtactaccttggaatttgagaagggattaaaattttagaactcttacaaaaattggtgagaaatttggatgttcagcacagatccatatcacatagggggaaccacatgcagtggtaaccatatctatggacactatgatttgaactctagtggatatatatatatagagagagagaagtgcgcaccatctcaattattaatgggttgttcagagaaaatatgcatatttagaaagagacgaggacactttcggcgcgtctgactgcttacgtgcaattattttcttctctccactgcctcctctcttatgcggcttcctctcctcctcaatgcactccgttctttctctttctctactactcagtattgttagtgaggaccatctcctctcctttccttttataaaacggcaacattggatttgtatgaagagagtggttattacgagctgagtaatggtggccgacatgaaatgacggcactaacgaaaatgataaaagagtgcacagaggtatttcaccctgtgcaaaaagaaagagatggaaatagtagagggaaagagtggtcatgttactcaaaaaaaaaggtgtgattgcatggttcaagtgaaggccgtgttgttctcgagatataaga

SEQ ID NO: 27905 - DNA, 676 bp, Oryza sativa
gcctatatttaatactttatacaagtgtttaaacgttcgatgtgacagggcgtaaaattttggggtgggatctaaatagggccctagtaacatcctagtaaaagtcaagtaaaagtcatgagtagctagacgtgttcagacataacgcatcaattcaccgagacttcgggtatgcgtaaaagatattacctccatccctaaatatatgaactaactgacgtgatatatataaagaagaatggaagagtatttgaacaagtatctacccccatattcgatcatttgacaaacctataagacagcatcaccaaacaaattgatggtctaggccttaaaccctgttctgtcaattggatcatcggcaaccaacaaacaaactttcatggatggatcttcattgaggacctcgtaaatgtagtggcaatcgacaaataggtaagagagacaaaagattctaaacaaatctacctccataagaatattaaacgataaaccctaatctacctcacgcaaaactcctaaaaatgccaaataaaaatctaaaaactgaccagagaaaatggcagaccggtccccagctagcaagaagcgaggaaagtggactcttaattagctagctatacatacactacttaaaaaacgatttattttccggatacaagggtttatttttact

SEQ ID NO: 27906 - DNA, 1612 bp, Oryza sativa
  unsure (1)..(1612): unsure at all n locations
tgtaagtttgaatcctttttgttcattagctagtgtaaacaagtaattctacatttataagggctcatctagctccagaaaggcattcatattgagcttctggtatttgagaacctatgccttattattttttagttcaactgttgggaggatggttggattaaatttcagattcacctaactaaattgctattctaaagaaatggtcgacttagcatgtttttttctatgtttttggctttcaacatttcttttaggcttggattctgttgcttgctggttcaatatatttgtttcccttccttgaaaataattctgctaatggtggatcactggaatttgatgtcaatttattagatacctgtacatttttttactttatacctcacaatctatatgagaaattctttgtgttaactataagatttttcgttcaatgtcttacatctgcttcatttttggtaaaacttccaatgtttcattcatgttgatggagaatatcttatgtgttatcttattattttactatacaggtccctttctgtcctatggtaggatcagaagtgtattcctcagaggtcaagaaaactgaggtgctaatggagaatttccgtagagctataggtttgcgtataaaagaaaataaagaggtctacgaaggagaggtaagcacaccatatatgctaatttttaagtttgcactaagatattgttcttgaatttgtgcattatttcattttctcttgatattagcacatttataactgatatgatattctcactgtctgtttctaaaataatatatatttgtgcttcattgccttttaggttactgaactttccccagaagaggctgagagtacaacaggtggatatggaaaaagcattagccatgtaatcataggtctgaagactgtaaaagggactaagcaactgaagctagatcctacaatttatgatgctttaataaaggaaaaggtatcctgctcctcgccctcctatcttgtgctggatattttagaatacactaagtgcattttttgaaattttagtaatagttggatgattgttcatttcttattcagaagaatgtcttgttgtgaatatttaatctataaagtaaactttggagaatgttaattgtaaaaaaaaaattgcatgattggaaattcataacttgtcatcgtgaagctgattagatgccttgatactgagattcacttctgttacttccattttttgcactagttgtttcattacatcagtgatacatgggatgcaggtgtcagtgggtgatgttatatacattgaagctaatagtggtgcggtcaaaagagttggtagatgtgatgcttttgctacagaatacgatcttgaagctgaggagtatgttccaatccccaaaggggaggtccataagaagaaggaaatagtgcaggtaatttggtgaattttagcctaaaagatttttgcacaggcaagtcttttttgcattgtactatctatgaatttatgttggtgataattaaagaaatgaatggatcgtgttttacaaatttgaagtatagtgtcaannnnnnnnnnnnnnnnnnnnnnnnnnnnnnnnnnnnnn

SEQ ID NO: 27907 - DNA, 7206 bp, Oryza sativa
  unsure (1)..(7206): unsure at all n locations
nnnnnnnnnnnnnnnnnnnnnnnnnnnnnnnnnnnnnnnnnnnnnnnnnnnnnnntgccttttaggttactgaactttccccagaagaggctgagagtacaacaggtggatatggaaaaagcattagccatgtaatcataggtctgaagactgtaaaagggactaagcaactgaagctagatcctacaatttatgatgctttaataaaggaaaaggtatcctgctcctcgccctcctatcttgtgctggatattttagaatacactaagtgcattttttgaaattttagtaatagttggatgattgttcatttcttattcagaagaatgtcttgttgtgaatatttaatctataaagtaaactttggagaatgttaattgtaaaaaaaaaattgcatgattggaaattcataacttgtcatcgtgaagctgattagatgccttgatactgagattcacttctgttacttccattttttgcactagttgtttcattacatcagtgatacatgggatgcaggtgtcagtgggtgatgttatatacattgaagctaatagtggtgcggtcaaaagagttggtagatgtgatgcttttgctacagaatacgatcttgaagctgaggagtatgttccaatccccaaaggggaggtccataagaagaaggaaatagtgcaggtaatttggtgaattttagcctaaaagatttttgcacaggcaagtcttttttgcattgtactatctatgaatttatgttggtgataattaaagaaatgaatggatcgtgttttacaaatttgaagtatagtgtcaaatattcatgccttgaagattgaaagtagagctgtcagctatgggacattttgttaccatcacaccttgtctgaatagatatggattaccagattagaaccaactctttcaggcctgtaggtgatattgaactaaccgccctaccaaagccaaaaggattggtcttaatcccttttctatccacatttgtaaatacacctcccttgataaatggtttatacagttcacaaatcaaacactactaaataataaattcatgaccatcagtctacattattataacccttggagttcattatgtttgattaattaggtcccactggaagatttgtcctttttatcttctattttatccctcaactgttatattcctgtctaccggcataaaaaaatgggttcccttatacagcattagtgtgttatatacaggctctctgtttatgattctcaagttatatggatgttagttaaagagctgaaacttcagttatcaattttgtacaggatgttacgcttcatgaccttgatgctgcaaatgctcaaccacaaggaggccaagatattttgtcccttatgggacagatgatgaagccacggaaaactgaaatcactgagaagctacgacaagaaatcaataaggtattcaaatttcccatgtagcagcactgctgcttttaaaagtggaccacatttaataaacatgtcaggattggcatatgatctttaacatctatactgtatgttgctaggtggttaacagatatattgatgaaggaattgctgagcttgtacctggtgttctgttcattgacgaggtatcttattatttcatccttacgaattatgattggaaattttctcagtggctcattttggagtcagaaggtataaatacaaatgagggtgtgtttgtctgttgtcaaacatacagtgggttgtccttgtggggcagtgccatactgccatgctatttctctactatatggtataaatcttgatgtggtttgatttagttacttgtgaggaactttaatcgcaggtccacatgttagacattgaatgcttctcttatcttaatcgtgctttggagagcccattatcaccaattgtgatacttgctacgaacagaggaatatgtaacgtaaggtaaacagtttgatttaccagtcgaagcactctgcgctacattataataccagactaatcatgtgtttgtcagtttgtttattaccatatgctccttaaagtttacaaagtcttgttatgcttgtgtccagaggaactgatatgacaagtccacatggtataccagttgatcttctagacagattggtgattattcgaacagaaacatatggtcccactgagatgatccaggtttgattttggatcttatatcacttaggctttcctgtttagaaatgtgtttgatctttgctcattgtcctctacagatacttgctattagagcgcaggtggaagagattgacattgatgaagaaagtctcgcatttttaggagagattggacaacagacatcttttgaggtacgattcttggttggtacaccgacaggtttgagaaagagagttaagatggaaattatgcagtaggagtttatgttaagtggactgatcttatttcccactttcggtgttctataagcattttaaattttgtagttttagttttataaccaccaagctcatcttactgaggcagctagcgaagatgaacgattgtaacacatgttgaatctcatgtaggcatgctattcagttgctatcacccgccagtgtagttgcaaaggctaatgggagagagaagatcagcaaggtatgtgttgaaattccagcaggatattgtaacgtcctcttgttgtcttttttgccgtatgggctatggctggctgctacattcacttgttagcctgatattgttcttgcaagttttatgtatgctgaacccatgaccttgtttttaatcaggccgatcttgaggaagtcagtgctctgtatttggacgctaaatcatcggctcgtctccttcaggagcagcaaggaagatacattacttaaatttctcttgcagtatgacgataaactcgagaatttgtccctattcatgctgtacacaggtgcgaagactctttcaggagcacacttgattgatttttgcagaaatgtagaaactgaacaatgtacccctgcactgtaggcagcctctagagaatagcagcattttcgaagtattgcttgttcaaactactgtttgctgagtagatctcctatggaattatcgtgtttcttaattgtccatgctaaccagtagtttgatactgttttatctaatgagcattttcatgtcggttcttgatcattcagttcatatagagggaaatgctctcaaacttgaattgtgaggagacgctgcatatttatcaaatatcaatacccagaatagcgtcatgccctctggtactacctatcttgatcacggctagctacacagtggtttcacttattcatgacattttctaagtaatatgattatgtagcatcagagttgtatcacaagatttataatagagtggagtctactaatgttttgtatttaagccaataatggtcgttgtttctaaacagaaataacgatcgaaattcaaattattgttttgtgcaaattattggtcgtggtggtaatacgattttaccgagctatcgttgatagaacaaatgaacaatcaactatcgtacgtggtgtccagcgacgtggagtgaggctgggtcagtcacgccgcatcgggctattttattttttttgccagttcttgtacttcatagactagtcatttcgattggaatgactatgaagttgggggcaaatctacctaaaagtttgcttaagatttgacacaactattcttttttaaaaaaaaattgttcaaactgaccatataaacgtacacactataattaacatctatcactaaatacaagtatatgtgctaagtttagaacttaaactaaattagagtggatagatttaaaaaaaaagaacatagcccattgagctacgctcgcttcgcgacacaaccaaaattatgacgtgctttaaaccaaaatgagtttgaagatctcatttctatccatcatctttaaagaaacaaaattatgacaagcttcaaaccaaaactgcccatagagcctagcttgggtgattggggtcattgctcattggatactcaacgtggacatcgaggccaccgtgaagaggtcaggcagccccccggcgtggctagttagcagcctccatctccatggccaacaaagtggcagcattttcagcatgcaagaacgacaattcgagatgagacgggaaaacagcaatgttagtgaccgtttggcgttttgttccatcatttttttctttagctgccctgttcgtttcttctagaagcataggataaaattttagatactcgtggcacgtttttcaaactactaaacggtgtatttcgtctgaaaactttctatataaaagtttctctgaaatatcagattattccatttttcaagtttataataattaaaactcaattaatcacacgttattaccacctcattttacgtgaaacatttaatatttatctttatattcatcttcaggagattcaaataccagccgtgcatgctactaacttgattatgataacctaagctactagggtgtaaaactggggtctctttataacgatggaatgttatatatgagatcttttactgtttttcaatttaagtgtctaaaactcttgtaaaagtttttttgttgctcctttcacccaaaagtcttaaagcttatttattttctgaaaagaaaatgagatatgcatatttgtagtctccatatgcatataagatttgaatgaagtgctaaattagcatcttaacactggttgcatgaatgcatattttttttctttgttatatatagaatgagttaattttttatttggtcttggtgaaacaagaaatatgctataaacttttggttggagggagtataaacaagtcatcttatttatacttctataaagttacaacccactaactgtaaagcttaacatacaaccatgctatatcatcacccactagcaataattatatattcaacctcgtgaaaacatgcaacatcatttataatctatttaattctacaaatcaacatgcaaacatatccaataatcacacatcacatcattttcacaatatttttacaaatctatctaccattttataatatttaacataaacttatcaatatgttacacattaaagtgtgggtttcatttgtctgtttcatgataaatactgataagccctgatatttcatttgttttctttttgcccctagcttgattgtaacgaaaaaatatatattaaaaattacttagtaattcccacagcaaagcgtggggaatcaccttgtatataattagactaattaatcacagggctttgctgcattacacatagttatatatatacaaccagccggatatatatatatatatatatatatatatatatatatatatatatatatatatatatatatatatatatatatatatgttacacattaaagtgtgggtttcatttgtctgtttcatgataaatattgataagccctgatatttcatttgttttctttttgcccctagcttgattgtaacgaaaaaatatatattaaaaattacttagtaattcccacagcaaagcgtggggaatcaccttgtatataattagactaattaatcgcagggctttgctgctttacacatagtgtaaaccaaccggatatatatatgcagcctttttaaatcaggaacttagcctattaagcaggaaacttagccttcaaataacccaatctataacccaatctgaaattcgctcctatggagctttgaactcaggatcttatggtgctactcaggtcactgcaaccactagactatatgccctttcatgagcgtaacatcttataactgactaactacagtctaccttctttatttccattttttcatgaaacttatagcgtttagataaaaattaatttcttggagccatagaaggtttgaatttttttttaaagaaaaaggtccatggaagtattgtgctctagaagaaaacgaaggcaaagatgcaagcctaagtagtgtcatttgaaatttgtttatcttagctgttagtttgcagaaaaaaaatttgaaaatatactgttcatcgttttctttttcaaaaatataccggatggcgaatcatttgcacaaatataccatcggtattgcaggatggaagagcgataccgaggttcgcaacgggaaagtgcgatagcgccacgatatcgctctatcaatcagcgagggtgcatttgagttggcggtatcgtgtgtgggaaaagcgagatcgttgcggtatcgctctttcgtagagcgagagcgccacgtggaaaaactgacccgttctggcgatttgggagggtagtatggcgggtgggcccaacggtctcatagtttcgcagcgcgagaccgagagagttttgggatccacgttgtcgcattaccgggacacagagggaggtgggtgggcctgcggtatcacacgcgtagagcgcgataccgtatcagtgttgcactcccgatgcgcgagaccgaggagcacggagattggagagtgggcccgcggtatcgcacactcaaagtgcgaaaacatcgttggtatcactctttcaaagcacgttaccggctttagttgtgggtcttgcgaattttttttgttggtgctaaggatggctacggtatcgctatttggaagtgcgagaccgacgccaccaacacctccactcatgctcttatatctcgaggacaacaccggcctcacctgaaccatgcaatcacacctttttttttgagtaacatgaccactctttccctctactatttccatctctttctttttgcacagggtgaaatacctctgtgcactcttttatcattttcgttagtgccgtcatttcatgtcggccaccattactcagctcgtaataaccactctcttcatacaaatccaatgttgccgttttataaaaggaaaggagaggagatggtcctcactaacaatactgagtagtagagaaagagaaagaacggagtgcattgaggaggagaggaagccgcataagagaggaggcagtggagagaagaaaataattgcacgtaagcagtcagacgcgccgaaagtgtcctcgtctctttctaaatatnnnnnnnnnnnnnnnnnnnnnnnnnnnnnnnnnnnnnnnnnnnnnnnnnnnnnnnnnnnnnnnnnn

SEQ ID NO: 27908 - DNA, 940 bp, Oryza sativa
  unsure (1)..(940): unsure at all n locations
agctacactacactactgcggtgtcgtatcttatagccatatgcttctagaccacaactgaaaattcatgaaccatgcgatgtgggttagctaacatcttgacatgattgcaggtgaggatggcagaggagagtgtgaagatggttacaggggctagacaacttcaccaggccattcctgacatgcaatctcccctcaatgtcaactctgatgcttctgtgccgatccagaacaacaacccaatgaactacttctccaacgctaacaatgccggtgttaacagcttcatgcaccaggtttctccagcgttccagattgtggattctgtcgagaagattgacccaacagatccagtgcagctgcagcagcaacagatggcgagcttgcagcatcttcagaatagagcttgtggtggcggcgcaagttcgaatgaatatacagcatggggatcgtctctgatggatgcaaatgagcttgtcaacatggagcttcagtagtaggagcatatcctaacaacatgatgagagcatttggaggtgcaaatttgcaacctgcaaatgctgttttgtagtagtagttgttgtcgctgtttttgtctgaaactgtagtttctatggattttggacttgctgaggaacatctgcggctgttgttgtttcaaattgagaaaatgagggacaatgggacatggtggtctcccttaatatagcgaaaaatggttggaatatggggtattgtgtttgtctccattttgaatgtttaacttgttggctggaacgcatgttgcgaaaatagcttttaaaactgttagaatcgaatttgccaaattttacttgatagttttttttaaaaaaagttagtacgaacataagttgattggcaattnnnnnnnnnnnnnnnnnnnnnnnnnnnnnnnnnnnnnnnnnnnnnnnnnnnnnnn

SEQ ID NO: 27909 - DNA, 748 bp, Oryza sativa
  unsure (1)..(748): unsure at all n locations
nnnnnnnnnnnnnnnnnnnnnnnnnnnnnnnnnnnnnnnaaaaaaacagctacaacaacgaagcgaaaaggcggaatacggaagcgtggagggcggaggggtgatgggctgatggcagatgtaactaccttattacaatttagtcctacgataaaaaggattttaaaaactagcctcataagtacaaaatgtatatccatgttaattaaataattagccctatgctagggatataaatttatagctaacaactttagtacctctacatatgtgaaacaacaagcgttttaaaaggaggatgagctacatcatctacaatgatatggaccgttcgatgaactggtaaatgaaaatacaccattggatcatcatgctcatctatgactgtggaaacacgttgaaccaatccggatgattccagatcatcatgctcatctcaaaaagcagagaactcatgtgcttagtctatttaacaataccgttcaaaaatagtctttttaacactatacatatgtttaattaatctcctgactaaataaaggaaaaaacatatgacgtcttagctgtaaatttatattgaatttatatgcaaatttatatctataatgtacgagagtgtacacacaaatgctatgttatactactttttgcttggcattggaacaacacacaacaactaagtagcattcactacgtaccaattttattttaaaatagtccatacgaatgcacacacgcacaccctaca

SEQ ID NO: 27910 - DNA, 622 bp, Oryza sativa
  unsure (1)..(622): unsure at all n locations
tatnnnnnnnnnnnnnnnnnnnnnnnnnnnnnnnnnnnnnnnnnnnnnnnnnnnnnnnnnctacacaaaagccactttattttaagggaacaaacatgcatcgcattctgaaagggtttatggctcaagtactgaaaattaaaccaaatgatccaagtcctctggccactggatatttctttgtatacaactcacagggaagtcctttgcccttttatgggatttcaaaggctgaactctacataattctagaatgtagatatgaatggcttgctagttatacagcataatcccatatttttttttgttccattcgcaggatatatgtactctagattgcattctagcatccattttttccctaactatactcatattatcaaaattttgaactgcagggtggtgatttttcaagaggagatggtattgattcattatcccaggcatcttctttcaactgacttcttgctgttgtacactttataagctcaacgctacatgctgtttccaagacgtggtggagagagcatatatggggcaaaatttaaaggttaacgactaatgaaacttgtggctgccataaaatttttttaatacaattagtgtaaatgcattaatatgc

SEQ ID NO: 27911 - DNA, 647 bp, Oryza sativa
cctttctctccctttagctgattctgggaatcagagacttcaccacagtccacgattttcacttcacaagtaggctttccggtatcagaacctaccgcttcaagcttcttcagcaagggcattccagtgaccaccttcccaaagaccacatgtttgctacacgattataattttaagtcatttgaagttgatagattttggagccattggtaaaaggaagttatatgacttcttatccacaggaaaacaccatagaaattaggaaattgattacttctgtgggcaacatacactgtgttggagccaccacatactctcaaccattacctgacacaacttgtagacacatttaagaaaggagtagggcttaatgatgtgttctacacacacacccactccagagagttttctatggttgtatatacatagacataaatgtgctgtttataagatattatttaacaaatggcaacttttatgtgtgtatgcatgaggctaattgatctttcatggttgtacagaatttttagattcaaggttttttaatagactaaatctctctagaatgttaaattttggtattggtagatatcaagtactatatctttgtgcagtaaggaaagaaagaaaggcataactttatatgc

SEQ ID NO: 27912 - DNA, 741 bp, Oryza sativa
  unsure (1)..(741): unsure at all n locations
gtattaccataatcaaagaagtatggatgtttagttatgccttttgtcaatgcttgtgtttgctggtagatgataaacactatattacattgtttctattaaaaatccatatattttaaaagcaccaccatagatattattgctaaaaagtagttaaatacacacctctgtatatgccatatcatcaaagcagatgatacagtagagaatgatagatgacatcaatggccaattcttaaacaaattcttatttatagttggagtaatatgttgctcaagaagttcttcagatttggcaaaatgtgcaaccggagattcaattggtccatcgtcctttttgtggactttgagatcatgcagtgtctcctgaaatattatgtcatgcaatttcttttaataactaatccatatattgtttatgcttccaatcttcgatgaaagcatacaagttaaaaatatgccatactcaaacaaccactccacatgtgacatttcattgcttaatcacccaacagctcctgttaattgcaaaattcgtgcttaaatattcaaacatttggtttccattggaattctatatatcttcttatggattttcaagtagaaaaagtaatactattttatatatttgcaaaaacatacataagtgtgcatcacatcgaatatttagcanaataacatagaaagggtgcacataccgggagccacatgcagcttattaaagatataaagcagaagacc

SEQ ID NO: 27913 - DNA, 741 bp, Oryza sativa
  unsure (1)..(741): unsure at all n locations
tcctcctccggcgagaggggttgcttggaggcgggagggaaggagacgtcgaggcgaggcgagcgaggtggtccgaggccaagaggaaggagatggcttggcttggcttctctcgttatttcgtcaatccatcgtttcaaatggaggttttcttgtttttttagtattggaaagaaaatccattttacaccttaaattgttttatattacattagttcacttaaccttctaaactattccaaccgtttcatattataatttatttgattttttttcttttagtcaaaattcttcaattttaacagagttgatagtaaaatatagcaatatttttaatataaaataaatattgtaataaaatatatttaatgctaaatttattaaaactagtttggtgtcatggatattgctaattttctctataaacttggtcgaaacctaaagaatcttgactaattaataaagtcaaataacttataatatgaaatggataaagtagtaatgtattggttttttcttattttacacctctgatggtatttctccttttcctttccccatgtataagttatattttgccataaaatttggtagaattgataaatgtgttataacttacctctcaaattttattattattgtttacatagatcggaagcaatgagactaaattaaataccgagtnnnnnnnnnnnnnnnnnnnnnnnnnnnnnnnnnnnnnnnnnnnnnnnnnnnnnnnnn

SEQ ID NO: 27914 - DNA, 722 bp, Oryza sativa
  unsure (1)..(722): unsure at all n locations
gctttttattgctgtttgtgagacgttgtgacaagatgaatcttttctcttccaaaaatgaaggaaatcaaaggtgtaattttcagttgatttgggaggcggtgtataatttattctggtacaaagacaattcagtaaaccttagatttcgcgcatgagaattagcttctctcatgtggcacattactttaggtgagtaataagaagttatacagtgaattggtttggtgaagagttatgtggcaatttaggaccaacttgctgcgaaatttgttccataacttccttgtactgaagacctgttcctagtcgtctacattttagaaaaatatagaattttggaattgcatgcttcttaacttgtaagggttattccccgcaaaaaaaagaaaaaaaaacttgtaagggttatcagtttcacataagtacatacccaattaagcatgttcatacttaggaggagctgccaaaagtgaaactgctgcttctgggatgctcaattatgatgtttgttgaaagctcatgattggttttgtataaaatgcagtctgttaaaccagaactggtagtacaagtggagcctattgaggatccttatggcccatccattattgatgataagttggatgccattattgtcaggtatggacaatttgatcatctcttannnnnnnnnnnnnnnnnnnnnnnnnnnnnnnnnnnnnnnnnnnnnnnnnnnnnnn

SEQ ID NO: 27915 - DNA, 438 bp, Oryza sativa
tttcgtctacacaaacactggccacatggcctcactgctctcgcggtgccgtcctgactgcccgatcttcgccttcacgacctcgacatctgtgaggagacgattgaacctccaatggggcctcatccccttccgcctcagcttctccgacacatggagagcaacctgaaccgtaccttctcgctgctcaaggccaggggcatgatccagtccggcgaccttgtcatcgcgctcttcgacatgctgcagtccatccaggtcatgaacgtaccttgagaatcatcatgctcccctctcgtgtttgtttgttctgcccaaaacggaacacggctttagttgacatcatcttaaaggcgggtttctggtttgaaatttattcgtttgttctccattgtgttagacgacagaaccagagaatgttacaacaataatgctgca

SEQ ID NO: 27916 - DNA, 646 bp, Oryza sativa
tatagggcgaattcgagctcggtaccccgccggctgcgagcttctcagttttctggattgctactcggggtatcatcagatccgactgaaggaatccgactgcttgaagacttcattcatcacgccctttggggcatactgctacgtcaccatgccgttcggactaaaaaacgcaggggcaacttatcaacgcatgattcagagatgcttctcaacacagatcggccgcaacgttgaagcctacgtggatgatgtagtcgtcaagaccaagcaaaaggatgatctgatctcggatctacaagaaacctttgcgagcatccgtgctttcaggatgaaattaaaccctgaaaagtgcaccttcggagtaccgtcagggaagctgcttggcttcatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaagacagataatttccaatggggacctgaagcacagaaagccttcgaaagattcaaacaactcctcaccaagccaccggtc

SEQ ID NO: 27917 - DNA, 553 bp, Oryza sativa
acacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcattgtatttccctattttgactgtcaacatcaagttttcttcttgccgttgtcagtcgggggctattatcataataatggagtgtgattttttttatcaattcagtttgcttacttggtttatcattgccttgtttggtttttctacttagtttgagaggactgaaagtttttaatagcttctttgggttttaggctcaacaaagcttagcaaaaacttttaagaatcaaaaactttgcaagaatcatcaagcacagcataaatacaccagtattgtacaaattgagcctccatgtattacatccaaactcagtcagagtcagtcctttcatcatcagagtcatcattactcggctggaggtcgttgttgcgaaattgctccacaacatcact

SEQ ID NO: 27918 - DNA, 1015 bp, Oryza sativa
cctgatttaattgaggcatgtagcttggcagtgaatgcccatgatgggcttgcaaaggcatctgccatttgtccagagatatagcacgatctaataactgactccctggacaagcttcccttgagatgtgcttctatgctctcccactaaaaaaaaagcatggatttcaaagaagacgagaggctaagattagaaggtgcttaaccgtctgaaaatcaattagaaagggtactttcgtccatggagagaattaatctcgcatctgatgttggctccttcggcgccggaggccaatacgctactacagctactcgatcattgcccagatcatgaatgcagaacagaagataactggaagaaaaattaacaacgaataggatcatcgatggtatagcttgatggagcattcaacctgatatatccatctcacagttcctactcttcgtctgaatgcggttgcacacttgcactggatggccatgaaagaaaaaggttctctaggacagccaattgacgcaaccccctaaaaagacgctccacgtcgcccacgcgcaggcagctcgtggcgaaccctagctgccagccgccccctcccctcctcatctcttcgtctcgccaccgcattggagtgcgccgctgggagaatcgggcggcaagcgaggatgacagtggcggggctaaacctcggtgacattccgcctccggcgtgggggaggaggcgcggagcttggaagctagaggacgacgacggcttatctggcgtgaggcagcggattcggcaccgccccaaccggatccggtccccacatagccagattcaacgtccctacttggatctggccggggagcaaccgaagtgggtggtggcgtgcggggacaatctgcggcgagaggttgtggacgacgtggtgaggctggaggccatggacagcacggcgggaggcagtggtcggtgcggcgaaaccggtggtgtcaacaacaacaggacgatgtgggcggtgccgatggtaacaag

SEQ ID NO: 27919 - DNA, 12277 bp, Oryza sativa
tgggctagtgcgggggagaggggatccatccttctctctcaccctctctctctccaacctgtccacgtggatggatctggagtgcgtcggaggctgagatcctgctttgatggctagccgacagcgaggtgttggtgcagtggctgcgtgttgaagggatttggctggtggtggctgctgaacctaataggcactcaatgacgcgggagtgttgtccaatcccatcttttttttcatctctttttttttgggtttgtgtggaggttaccccttgtattgcatgaggggtggctcaccttctcttttctcacttatttcttctacctcatcattcaattctatatatgtgacattttcaggtgcaacacatcaagtattatagtacttgccctaacacgtaggtgctttgctaccatcctcactcctcatatgcctccctagggtgtgtttggtagtacaggtttccaaccgggaacaatacgcgcgaaaaatggagcagtccattagcgcgtggttaattaagtattagctaattttttttccaaaaatggattaatttattttataaacaactttcgtgtagaaactttttttaagaaaacaccgtttagtagtttgaaaagcgtgcgcgtggaaaacgagagagatgagttgggaaaaggaggtgccgaacacacccctagggggtccctccctgtgtgagcagccatcgacgcgacaaatgcctccatccattgtgtgaacaggccacgtgatgccacctcttcttcccagctctcaaagctataggggttctatctcacatgacctctcctctccatatcatggccttagggtgtgttcagttcgtgaaaagaaaattttttggtgtcacatcggatgtttgaccgggtgtcagaaggggtttttggatacgaatggaaaaactaatttcataactcggctagaaaccgcgagacgaaacttttgagcctaattaagccatcattagcatatgtgggttactataacatttatggctaatcatggactaagtaggctttaaagattcgtctcgcgatttccatgcaaactgtacagttagttttgtttttatctatatttaatgctccatcatgtgttcaaagattcgatgtgatgtttttgggaaagaaaatttgggaactaaactagtcgagtggatctggtggaatttgaccattggtagcttctcgtccttccggtagtagtgtaaaatagcaaaggggttctcgctggttagcctacttatccaccatcttcgttctcctccctttcatttcattctaggacttcgtccttgcgatattcattctcctgttttcctttagtttgcctataatacttgtgtagttatggatattgtgcatatcacaagttgcgataaattttgagggttcaatgaaattgagggtaaagcctgtacaatatatccatgttcctaattttgatacatgagcatgccatctttcatttttttaatataaactagccacatgtcttattcacgtgtttaaggattggcattgaataatattttttctctttttttacattgattagctatagttgccacacgatttaatgcccctcgaaagtacctctactttcttatagagacattttataaaatgcatcttcacttctagagataattcaccaaaaggtattttgaaaaatgcctccattgcattgtagaggcattttaaaaatgtttctatagtattaaaaagatgtctctacagtgcatttttgttgtagtgtttgctggatcgataaacaagcaattcgtgtggatcaaatagcagtgcccaattccatttaaatttttatgattgttgttttataggtgcctttctagtgaaccgaggttaatagttggtcagccatatattcttgatgtcatgttattacagcacagcagatacctgtaaacttttcattgtgatattttgcatatgaaatttacaataaatatccttgtaacttgtgaatttcacagagataatatatggctggaattctgattgtttgctaatgaaaattttttgacataaatgtagaaggtccctttattttttgccaaaaataaataaattgtttgcagatgtgatttgggtggaacaaatagataatttggtggagtgcacatacaacttgacaattcttacatgccaatctattgcagcaacctttcccgtctagattatattatgtgtagttttgacctcattaatttggcggtaaagttcatttttcatcctgaactataaaactcaaatgcttttcagtggttgtgtttgaaatggatgtggttttcctattttatactcttactgtgcatatttttatgcaaatatcacttacttagatccagagtcgtgaaacatacctgattgaagttcatactatatcaaattgatcaaaaccaccatgaattatgaaatagggagtagaggtgaaaaataattggtttcgtagtttagggtggaaaatagattccaagcaaagttaagggcaaaaaatagagtttacacttaatttggtttccatgtcctgttcttttgatggactggcctcatctttccgagaaatcaactcaaccacttaccaaatggtactgattttgtaaaggttactgaattgttagttgcactgaaattgttgtaagttttgttgatgttttcttaaacatgcatttcatcaaggataggaattacctgatgagtacttagtattgtaaccatatcgataagtagaattaactacagaaggaatagttgaacagaaatctctgaatttagatttacaaaatcgctacggtgctatgttacatttgtaatatctacaaatgttttcccaaaaaatgggagaagatagattgttagttattaatatgacagtgtaactcaatttagtataattattatggtatggcctgtgattgatgttttgttttcaagctttggttctatgcaaattttaatgttacggggtatgcttatgtgtcgcaaatgtagacttttatgttcaataaaactagtcatcttgttatgttagcttttttgtgttattgattttgatttaagttgcacatataaacaagcaccactgtcttttttttttacaaagttacagggtgttcatggtctatttgttgcccactggaatgttttcttaaaagagagaattcttagagacttcttgaatcatatcacttcaactgcaatatgatattccagcttcgattagtataaatgacaatcttgttcaacttcttacaactgtatatatggcgaagtattacacagatacggttacagtcaagagaaaaggaaggagaaaatctgggatatatataggggctggcagctatagaaagcccaaatcatatcagccatgcattatctcttatcacaggaagattgctggttattaatcctaactctacttcatacatagctttagattataaagatgtagggaacaacaaacaaagctactcaaatcagctaaagtactaatcaaactttcaaactttaatcagttgaaaaagaacgcatatgcttccttcaaatcagctgcagcaccagcagaatcagcagacgaaatggacgatatggtggacgtcagccggacccttctcctctcggattcgccgagcccttcccgggccatgagcagccaggcgaaggtgatgagctcccctccgctggccagctccgccgcgtgcaccttaccattggacctgccggcggcgaagatgaggaaccgcagccacattgctgccatctcctcactgcaccccagcttggttggacatcctcttctagtatcatcttgtacatttcctccattgttccttgccttgacacaccatccttattctgctgtataatgttgtatagctcatccagggtcatcttgcttccttgttgtgtcctagacagttcctctctcgatttcgcaaactcaaccacggtggcttcggagctggcattgagcggaagcatggaagggtggttgacaaagaggtacatcatgtagttggacagttttcggcacacctccaccatatcatctgcatctccccctccttcgtctcccgctgccgcggcttctactgcattcaaatatacttgagtgaatatgtgcatcaccacaatagcacatcccatatctgcgacaaaacagacccgtatctttttcagcaatgggccaagatgctgccattgttgttgctcggagacttcatcgctcaagctactaatcccctttacgacaaactccatcgtcttttcatcggcctccacatgctcagtgtccaacgtcttgctcagccagaacaaatcttcttttccaacaccgactaaactcgacaatcttctcactagagccaccactttctggttgtatgatcttggctggtctccaccagaaacccagttcagcaagttgtactgtccgatggaattcgaccaccgtggccttttctctggccagccaatatcactggaaaaaaggaaccaggacaagctagccagccggtcgcatttctgagccttcaaccacgcccaagtccatggagacattatgaagataaacactgcagaaagatcaaggaaaaagcctccgataaacagcgaataggtgatcgcaacatcaactccgttgtacctccgtttgtcacatgtaaggaacagtgcaaaagcaaggagggaacatgcgtgagaggtgcatcggagaatcatgcctatccttgttctcagcacaagagcctttgtgtagaggtcatcgtacatgattgcaagctcaagctccaccaccttgagcatttttttggttccctgtaccgtgtctcgagcaataacaactggggaattagattctggaccattaacaaatgggttacgcgctgcaaagacattgtggacatttagcattgaacatagagcatccaaaactaccttagaatagccatgatccgaatcgtttaattccggaaaccgtttcttgtagtgatctccagttgagctctcgagacttttaaaccttccatacttgagagacagtgtcctttctccatacttggtaactccggcaatgaacacaaggacacctgaaactagaagctctgcactgtgccttgctggcgatttccagaaaacatatgcagctaggactacttgcaccaccaagttcaagagatgcctcagccacaagttgttgtctgccattgaaaatgcggtgatgctgtcctgcccaccaagatggatgaggaggaatgatgcccaaaagaaagctagtggctgggttccccctgacatttgcctctgaatatcatcgtgtcgtgagaggtaaccaagagcataaactgctgtgaagtctgctcccaaataagctgtccagatagaaaccctgaggaacacattggtgttgcgcctccgaagactgccggtgaaaaagaggaacatttggagtgtgaagctgaggagcacaagcagctggatttcccgctgatgataaagtttcataaaatccttcattattataaatttaagagcacctgtgttggatattccagtaatcatttagtacaagttttaaaaagaagattacattttcgacgtactacaacccagaaacgtaaagaaaaagaagtcagagtaaattctttaaaattctaggtatatattatgatctaaattgcataaatccagaagttttggcacgtggcatataacactggatatattatagtcctacagtttcatataaccgcactgtttattaattttacttgctactattgtgtcaaaacaaaaacaaaaaaaaaatgcttaacttaatggctatcaaactttttatacaatagatcaaataattcttcatatatttcagaattaatttagaacccacaaatatggtcaatcaaataacaatttattaacagcatgattttatgaaactataaaaccatagcaccaagaataatcatatgctccgtgctaaaattccatttttttttgcaaacagcaacaaatcgattcacaatattaaagctcgatgcatgtatgtacaacaagaaaatagtaaataccccggttgtttgtgacagtttttgcccagtgtaattaattagttatacctataatatatcctatctacaattccctccgtttcgttccgttccacgatataagacgttttttatctaaatatactagcatacatatgaatttatacacatctataaacatatatatggatccatatatgaatctataaaatcccaaaacgtcctataatgtgaaaaagagaaaaatacatctatttaaaaatatagcaatcgaaagagatacaacctaatactacgaatctgaacagatatattggtaccatgattgtattcccatctaatcctagatttactatattttgcaactaagagaatactattctaaactcatttctctctctctcctatgtcggccggctttgctgccatggaaaggaaggaggagaccgacctctgcacgaccggcgtctcccgccaggaaccccagccaccggacgacggatcagccgtacgtcgccgtgtccaggaggtagcagatcgagtggaggagggacacgggaggaaggatcggatcgagtggacgacagagagacttgttgttgacgaggaagtgatcagatcgtcagggacgaggaaaactctgtgaaagaccgtagctaggctttgccgattttttctcaagtcaattctactatggagtttggaccacatgacactcacagcctagctaccacggaaaccccaaaatcctactcactccctaggatttttttttaaagaaacatggtagtacacttgtccctataaacacacgtacactttattcatatttataacaattaatgtattgaagttggttgatacgaagaagagaacgcggaaaaattaaataaaagatagttgtgattgattgagataatagtatagatactagagagtctatatttttacaataaaatttaaaagtatggagagtatcaagcatatatcacaagtactagatggagagcggtaagaggccagccggttgcttccctggccacgtgatataatgatataacgtacggtaaccttttcagtttttggaaaccacggtaatcctcacgataacagcatggttcacgataaccacacagtttctgcacatgataaccaccttactgtgggttaaaggtaatctcaccaagacggtttggcgaatcctgatactcaccaggaaattctattgtgtagtgtcatccaattgtgcaaccatggtgatagtataggtggtttcaaagtgaggttgtttttttaataaagatgcagtacccaccatgagttggtacggttattaatcattggctgtattagttttgcttttcatagggctgcatatgactagatactttaaaaaaagtacaatggcactccaaatactatagcgataagcattccacgttggattgcatgctgagctgaaaagagattagtgaagagagaaggcaaacaagtgactaagggtatgtttagcagagcttcaacttcgaagtttatcttcaagagctcgatttgaagtgaagttgtagagcagtttaaaccgagcttcaccttcttaatttattttatgagagcattctagtcagtttcactctagctccctttttaggtggagttgaaactgtttggttgggccttagctccagaagacatgtagttggagctagagctctgccaaacataccctaaatagtcgctcgctccatgcgcactccaagagcgttgtatagtagctttcctatcgcttgctcgtagccgatgccgacaacacccccatgtggtaatgtggggccgtataattagcgacatccaacgccagggagatcatggagaaacagcagcgcggccacctccagggactacgagggggaataggcaccagagaaagacggtggcgcgatatagagcgacggcgacatgtcagttaccatgacgacaagaaaaagaacagaaaggagttgatatagaaaaaataactagtgaaaaaaaggtagggaaatttctgaccataccgatattgttttcataaagaaaagtaagatattgtttttagctttatgtaaaatttggtttttttaatttatgtatgaattatattgaagtcatcactaaaatgttagttagatttataaatataaaaagttcccaaccatagtgataccattttcataaaattttagttattaatatcgtttccaacaattttcatcctaaaaaatccaatcagagaaaggaataggagctcccaatggcagtggtagtgtcctggtcagcaacagcggcggcattccgggctccgcgacacatagttcactgttagcttttttggctcccagggctcccttagagcaagtttaataatatagtccaactactagctccaaaaattaaggcaccatctatagctaacctaataattcactcatataatagttagttgttagttgtatatatattgcatcattaatacttattcacatatatctcttatattgtttattggaacccatgctttagttggctataaatttatagcccattttttctctctcgtcttctctctcctccatataaacacaaatatgatgtgacaaatcgtacatcccgcttacatcattctattatactcggttttatggcagcaattctaaaggaaagggtaggtagagggagaagatgctggaatcttaacatttcagctgatgtcgtggcagatgagcgaattggactctcaactttatcgcaaccagcaaaaccaattaattttacagaaaaactagaaaacgggattctgttcaacgggataacctagccttcacaacataagcatacatgtagcggcttgccggcttacatggagagatcaaccaaactctatacaaaaggcaagggcccacatgcatgtactatccttttttcttgtccatccatgcagctagcttatgggccaacgtgcatgtgcgtacatgctcgacattttactcctgcatgtacggtgcccacatgactttggcagagaggtcgatcagttctatgcggtagttaatcatcaataatgaatacacttattagatcactagtacagaaatataatccctcatacctaatatgtattataactgaaaaaatatagtgcaaaaaatggttccttggatccaatacctacatatatcgtaactgatatctcacaagtatcatcactagtacccatgtatcatcaccaatacctgataggtatcatcactagtacctacgtatcatcactgatacctcataggtattatcactagtaccagacaggtatcgtcattggtacccatgtatcatcaccgatacctaacatgtatcatcaattggcacctatatgtatcttcaccgatacctcacaagtatcatcaccagtacctacatgtatcatcaccggtacctacatgtattatcttcgatactgggtatcgaccaacccagattgttccaactgatatcataggtaccatcgagatacttggtacctagatcaacatgattcccatatgtaccagatctagtactgggtatcgggtatttgggtatcaagtacctggtacctagatcggtctgatacctataggtaccatacctagtgctggtatcaaggtacatgaggtatcatatacctgataccacctgagtatcgggtactaggtgtacctgaattgatgttgaacgatacctgttggtattgggcctggtatcagatactagttttagtatcaggtatcaactcacatgccacgtcacatgcatgcatgcagctagcaacacagccacgtcacatgtatgcatgtagctagaaacacagccatgagtaatcagtagaatgctacgtgagaggaagcaggtgggggggggggctagcgacgcggaacggaagggtatcccgttcccacgggatcctacggtctagctatcctcttaattttatgttatttgagaccattcaacaactttattttgttaacgtacaatagagttagttgttggctcaaggctgagagcaggagcatggcggtggcgcacagtatgagggatggctcttggaggataaggaaggagaggatcattgtaaaagcattataggtgttaaaaaattacaaagatgagggtttttttttcttttcttaagggaaaaaagaagtttgaattaccccaaactattacagttgctcgaattacctccttaaactcaaatactagatatttaacaccccaaattctttgaaccggatgaattaccctctcattcaatctgaagcggttttttacaacatggcgtacacatggcagtccaatcagcaaaacaataattaaaaaattgtgtggtcccaactgtccaatatttctctcttctccagctcaactctagcaggcagacatggtgaggagggcgctaccgttgctgcccctattcctctcttccctctcttaccagtatctcagcaggcgaggctggctccagcgaggcaagcggcatccactgccacccctcttcctctctttccccagatcgacctcgggaggtgatgcggactccgggtatcgacctaaggaggcaataaggaatccggcgaggcgggcctcgaccacctattgacgaaaaatctgcgctcagtcgatggtgccagaactgtgttggcgcgaactaagtcaacgaacacaacagactgggagattagcttagctccagtgaaggtccaaaggttgatgagatgtgggcgtgtcaatcagtttgatcctgcaactgacaagatatacaaatagcatatcaatgagccgatcggctgacaagccgatggaataattccagccgatgtcgatagggttttgaacaatcgactaatggtaatgtaattaaaccataataatatccagtagaaatcaatcggctaacaatgatatgatagaataatcaccgatccgaaggttaaaacatacatcggctgaatatccgatgtcatcaaatccacaagattagacaatgaaacatttgttgtgatcggctaaatccaacatgtatgcaatccttgtaagccgatgcaacgtccagatacctcattggctgaaactctgatgaaacccttattggcaatcaagaagcgggctagagattatgattctaagcacgacttagtagatcaaacttaactgatgctgcactaagtatgaaaagaaacataatatctagacaatcaagcctttgactgattttcagggtggtagataccttagctaatctaatatggtaagcgatttagccgataccaatataaaccctaaagcgaatgtcagccgatacaagtaaatcgagctaccaaactagattatctaagatgtatgatagataggtgcttagattgacaatatcagagtgtcgaaaccctagccccgccgatgcaaatagccatgacaagtataaactcgtcgaaaaattagaaaagtaaaaaggtggcgatgcgccgaagttgtattgatcgtggagatagtttacaaaaaaaaacctcgggtgtacatatttatacccatgggtagatactagtcgttgttggataagaaagaaacttttctaaagatagaaggaaaacataaagtctttatgggacactaaacacactttcctaaagataaaagaaaactaacaaactcttcctaattaatagataatttgacatgccgcatcctctttgaattcagtcacttctggataagcttcccttaatatattaatttccttaaccgaatcctccaagaatccgactgctagcgacttgataactcccattggccgattccagaactctgaagccgatactgattttaggtcgataatgtcttcagggcttaccaaatttcactgttaacaccaccgcagccctctttcccaggatcgacctcaggaggcaatgcaggcttcggcgaggtagggcctcagacgccaccaacgcccctcttcttcggcaccgacgagctgagcactggcacatggtcctcgcagagtgcatgctacctccatggttccaggtgacagagctcaaggttgtgaagaggcggcgaccaaaagaggagcttgtgcggaggcggcggtgagctcctggccaacgagcg

SEQ ID NO: 27920 - DNA, 2350 bp, Oryza sativa
  unsure (1)..(2350): unsure at all n locations
nnnnnnnnnnnnnnnnnnnnnnnnnnnnnnnnnnnnnnnnnnnnnnnnnnnnnnnnnnnnnnnnnnnncatcctaaccgtttataacattcaaatatttttttaaataagcaaataaattttataactcacatatactatttatcatgtagtttttttttaataacgcgtgtgatttctatctagtaacaataattcgctcattcgctgtgccctcgagaaaatataataataattcaatgtgcgacggtgacgacatgagtgataggactatttcatccccctcatttctctgaccaaataaaaacatgattcactccatccatctaaccaaacatcctatcacaaaatttagagaataatccaatccatctcagctcgatctcacaccaaacacgtactaagataagaagtgggtagatgctggcagaacaagttgacaaaagaagaggacaagatcgatttaggccatgttcagttctcaaaacaaaatttttcacgctgtcacattgaaatgtttggacacatgtaaagtattaaatgtaaaaaaaaataactacacagattgcatgtaaattacgggacgaaccttttaagcctaattacagcataatttgacaatattgtgctacagtaaacatttgctaatgacaaattaattaggcttaataaattcgcctcgcaattttctggcggaatctgtcatttgtttcgttattagactacgtttaataattcaaatgtgtgtccgtgtatccaaaacccaaaaattttccccaactggacgaggcctttacaccccataattctcgagtggcagagtgaagaacaagctagacaggatcgatcgatggccggcggcagcgagtttgatatccaggaagccgcggcgtcggcgtcggcgtcggcatcggcgtcggcgtcggcgtcggcgacggcggcggcggcgccgttgctggagaagaagatcacgtactgggaaggttgccctggctgcgccgtcgagcggaggaaggcggagaatcccggcgtcccctacctgcagttcttccacatctggatcatcatcctcgtctcctgtacgtaatttcatatgtactagctcagttagcttaattaggacactaatttaagtaattaggattgtttttttttgtcctggaaaagattcctcctcagaatttgttgattagcacgccttcttacttaattagcttaggtggaagttgcttaagagcaagtttaatagtatagccaactactagctccaattcatctatagccaatctaatagctcattcatacaatagttacatactacactattaatatatagtcccacctgtcatacacacattacgtcttggagttcgtactacagctggctacaaatctgtagtccgctgctcttctctctcctcatttatcttcttaaaatatgtttgcagctggcttatagcttgctattgtacctgctctaaccgatgaggttccagctggtttcattcggcagtttattattattaattactttctcttttcctgaataattatcatcgttgactaaggttgtttttactttgattataaattaattttaaattattatattacgataaatgaaagttgtatggttatatttgtatcgctacactacaataatataacatatgtttaaaaaaaatatctgtattttaaaagaaaactagttaaaatttaaacttgaacaatgatcgggtcaattattcgataacggagaagagcactgcagagcagagtgagtgatgcctaactgttatccgtccgggtcagtagatatataacgtgcgcgctaacattatctaatattccctccattacaaaaatcctaggctgtttagcaaatactatgatcagatcaaaattaagattactttttactcaattttttgaacttttaagtgtttagattatgtttccaagcatggctttagaatcattgaaatgacgagaataatgcaaattagtctaggaatgcttatatagtggtacaaaatttaaatacaagaagcccttataattaggaacggggggagtatcacagtgtcgtttctagtagtacatcagtacattagtagtctacacgaagatgttcaagtgttaacagatacatcaatgtgatattgtttctttttgctgccctttatttcagtctttttttttccatatgttcagtttagttgttttgtaattgtagcacgtttgccgtctgctataaaaggtggatttctaatattttttttctttttattctaggtttgccaataacatttannnnnnnnnnnnnnnnnnnnnnnnnnnnnnnnnnnnnn

SEQ ID NO: 27921 - DNA, 16449 bp, Oryza sativa
  unsure (1)..(16449): unsure at all n locations
nnnnnnnnnnnnnnnnnnnnnnnnnnnnnnnnnnnnnnnnnnnnnnnnnnnnnnnnnnnnnnnnnnnnnccattgcatatgatgtttaagtagaaccatctataataagtttgtgtgacagtgttaagaaaccatttgcaataaggtgtccctacgacttctttttaggtagtggatgttactcgattctcttttttaatgttgtcacaacccactaaacaactaaaactcaacatgcaagcatattaattattattagtgcatcctaaagactaacatgcaagaatgccacgtcaactcaataggtacctaaagctcaacatgcaactatagctattacatatacaattttattacatcctaaacctcaacatactaggatgctaaattatcattcctcacataatttttgtaatattaatttcaatccaaaccaaatctatccatgtcattgtcatgtggggcacggcctatacacggcgtcgccgggcgcgagatgtgcggagagctgcggagcgagccgcagcgcgtgtcgcggcgcagagcgcgatcaccatgaccgtggatggcaaggacgggctcagtggctaggatcggagtagccttgattctaggagggtttgtttccaagttgttagcgtttatttccaagttagttagccggagggctatatactcttgtaccgaaacatttgagaggaaagcatgaaagttatcgtctaatctccctcttattctgttaagccactagctgaggggtataacctcgcaggtgaggactggagcgcgactacgagttacgtagtcgcggcccgccgtcgttgagcgcccaggcgcttgacaacctggtatcgggatctcgtcgatcctcggcgtccgccgccgccgcgcctttccctaccaccgccgcacccgcgtctcccgaccccgcacccatcaaccctagtccaccacccatcactgccaacaccagtccaccttccccgtcatcctcgtcatccgtcgcctccaactccggtgacatgggtgacaacggcgacctcaaggccgcgatcgacgccctcaccaagaacgtcgccgccatgcagtcgtctatccaggccaacgccaaggcgatcgagaacatcaccgcatcatcctcaggctccggcccacggcaccactccggcgagcaacccccagatcgcccccccaagcattggcgcccggagatgccgcgctacgatggcaagactgatcctctcaccttcatcaacaagtgcgaatcctttttcttgcagcagcggattatgccggaggagcgcgtctggatggcttcgtacaacctccacgacgacgcccagctgtggttcatgcaaattcaggaggatgagggcactccgacatggccatgcttcaaggacctcatcaatctgcggttcgggccaccgctccgctcgactccgctcttcgagctctcggcctgccgccggaccgggacggtcgcggagtactcgtcgcagtggcaggcgctgctgccccgcgcgggcaaactggaggaggcccagaagatccagctctacaccggcgggctcctgccaccgcttagcctccaagtccagatgcagaacccccagtccgtggcgtccgccatgagtctggcacggcagttcaagctcatggccgaatacacgaccgcgccggccaaggctccgggccgcggcgtcctgggcgccccacaagcgcgtccggctctgccggcacccccgccgcaccctgacaagacaccggcggtcaccaaccagggcgagggccgccaggcgaagcgcctcaccaaggaggaacaggcggaacgccgccgccttggcctctgctacaactgcaacgagagctacacccgggggcacaaccgtgtttgccggcgcatcttccacattgccggggtggagctcgacgacgacgccgccgccgacgctcatgaggagccgaccacggaatcgccggtcttctccctgcacgcggtggccggcgtaccgcgcggcgggacgctgcagatcgcagtcaccatcggcggtgcgccactcgtcgccctcctcgacagtgggtcgacccacaacttcatctctgccagcgccgcgccacgcacgaggcttccggtggagtccagaccgcggctcacggcggtcgtcgccaacggcgagcgcgtcgcgtgtccgggcgtcatccgcgccgcgccagtcgtcatcgacggcaccaacttcgacatcgacttgtttgtaatgcctcttgcagggtacgatttggtgctgggcacccagtggatggccacccttggcgagatagtctgggacttcgccacgccgtctatggcgttccacctccacgggcacgccttccgctggaccggggtgacgtctgctgctgcaccatcgctcctctctacggtggccagcgcgtccctcctcgacgagctgctggcgtcgttcgcggacgtcttcgccgaacccgtgggcctaccacccccccgcggccgcgatcacggcatagtcctcaagccggacgcggcgccggtggccgtccgaccataccggtacccggcggcccacaaggacgagctggagcggcaatgtgccgccatgatccaccagggcatcgttcgccgcagcgactccgcgttctcatcgccggtcctcctcgtcaagaaagccgacggcacctggcgcttctgcgttgactaccgcgccctgaacgccctcaccgtcaaggacgcgttccccatccccgtcgtcgacgagctcctggacgagcttcatggggcgcgcttcttcaccaagctcgaccttcggtcggggtaccaccaggtgcggatgcgaccggaggacatccacaagacggcgttccgcacccatgacggcctctatgagttcctggtcatgccgtttgggttgtgcaacgccccggcaaccttccaggcgctcatgaacgacgtcctccgcgatcacctccgccggtttgtacttgtcttcttcgatgacatattgatttacagcaatacttgggccgatcaccttcgccacctccgcgtcgtcctcaccatcctgcgccagcatcgcctgttcgtgaagaagaccaagtgctcgttcggagtcaactccgtcgggtacctgggccacaccatctcggcgtcgggtgtggcattggaccccgctaaggtccaggccatccacgagtggccacagccccgctccgcgcgtgccgtgcgcggcttcctcggcctggcgggctattaccggaagttcgtccacaacttcggctccatcgccgctcccctcaccgcgctcctgaagaaggacgggttcacatggactgccgacgccgcggcagccttcctcgccctcaaggaggccgtgacgaccgcgcctgtgctggcgctcccggacttcgccaagcccttcatcgtggaatgtgacgcgtccacgtatggcttcggggcggtcctcatccaggacggccacccgatcgcgttcttcagtcggccggtggcgccccgccatcgctccttggcagcctatgagcgcgagctcattggtctcgttctcgccgtccgccactggcggccatacttgtgggggcgccgcttctacgtcaagacggaccactacagcctaaaatacctcctcgaccagcgcctcgccacgattccccagcaccactgggtgggcaagctgctgggatttgatttcaccgtggagtacaagtccggcgcgacgaacacggtggctgacgccctgtcccgccgggacaccgaggaggcttccctgagcacgatcatggcggtctcgggaccccgcttcgacttcatcgaccgcctccgccaagctcaagccagggacccggctctggtggcgatccacgacgaaatcgtcgctggcacacgggcggcgccgtgggcgatcacggacggcctcatcacctacgacggccgcctctacataccgccaacatctccgctgttgccagagatcgtggcagcggtccacgacgatgggcatgaaggggtccagcgcacactacatcgcctccaccgcgatttccattttccaaacatgcgtcgatgtgtgcaggacttcgttcgggagtgcatcacgtgccagagatataagacggagcacctccaccccgccggactactgctgccgctgcccgttcccaccgtcgtctgggctgacatcgggctcgacttcgtggaggcgctgcccagggtaaacgggaagtcggtgatcctctccgtcgtcgaccgcttcagcaaatattgccacttcatcccgctggcgcacccgtacactgccgagaccgtggcgtaggcgttcttcaacgacatcgtgcgcctccatggtatgccgcagtccatggtctcggaccgtgacccggtgttcacctcgctgttttggcgcgagttgatgaggctgatgggcgccaagttgcacatgacgtccgccttccaccctcaagcagacggccagacggaatcggcaaaccgcgtcatcgtcatgtacttacggtgtttcaccggcgaccgcccccggcagtggctccggtggcttccctgggccgagtacgtctacaacacggcgtaccagacttcactccgggagactccgttccgcgtcgtctacggccgcgacccacccaccctccgttcatacgagccgggcgaaacccgggtggctgccgtggcacgtgacatggaggaacgagaagccttcctcgccgacgtccgatatcgcctggagcaggcgcagttggtgcacaagcgccactatgaccgtcagcatcgccacgtttcgtaccaggtgggtgattgggcgttgctgcgtcttcgccagcgcaccatgtcttcactgccacaagctacctccggcaagctcaagccgcgcttcatcgggccgtacctcgtcacggagttgatcaatgacgtcgccgtccggttggctcttcctccccaggcgcgcatccacgacgttttccatatcagcgttctcaagaagttcgtcggcgtccctccagcagcgctgccagagctgccccccatccaccacggcgtggtcacgccggagccggctcgcgtggaacgggcccatctagcgcgcggcgttcgtcaacttctcgtgcactggcgtggcgaaccggccgaatcagctacttgggaagacctcgacgccttccgcgagcagtatcctcagttccagctcgaggacgagctgattcgcgaggaggggagagatgtcatgtggggcacggcctatacacggcgtcgccgggcgcgagatgtgcggagagctgcggagcgagccgcagcgcgtgtcgcggcgcagagcgcgatcaccgtgaccgtggatggcaaggacgggctcagtggctaggatcggagtagccttgattctaggagggtttgtttccaagttgttagcgtttatttccaagttagttagccggagggctatatactcttgtaccgaaatatttgagaggaaagcatgaaagttatcgtctaatctccctcttattctgttaagccactagctgaggggtataacctcgcaggtgaggactggagcgcgactacgagttacgtagtcacggcccgccgtcgttgagcgcccaggcgcttgacagtcatcatttctattgcatttaacatgtatccatacatcccacagcaaagcatgggacgtcatctagtttacaatatggtttgaccattcgttagtgattaatgataataatcgtatttgtgacattatattttggtaaattgtcttgaaattaattaagtcgatatatttttcttgaacacattgaagtcaatataataaactatagtgcagttactcttcttttataaaccattgacaattttgctaagtattgtaaaattttgtcctcaatagataagagatttgcatgttgccaaaacaatagaagacattggattttacggaggctttgtaggtaagaacccctccaaacaatttcaatatggttatatccaatgattagatgtgtcaagctccagttgttatataagtaataatcattcttttgtactcagtcatccagcatcgatgtcatgttcttaatatttgtaggtgcttcatatatgcttggtagagctttaacttcaactatttgggggatggtagcagatcgtatcggcaggaagccggttattgtgtttggaattttcttcacgttagaaatttttttctctatttgtattgcacctattctttgttaccttcatttgattcattgtattgcactaaatatcttaggctggtatttaatactttgtttgggctaagcacgcagtactggatggcaataactacacgttttcttgttggatcattgaatggtttacttggcccaataagagtatgattactgactgaatcagaactctattagatatttaaggatgttaagtttagtaacttgggtctttgatctttataggcttacactactgaagtttgtcggcctgagcatcaagctattggattgtcacttgtaagcatacaatattttatagaaatatgttttcactactcgctaatgcaacaactcaatttatgatgtttgttcctctccattattaggatagcacatcatgggcaatgggtcttattattggatcagttattggtggatatcttgcacaggtataaaaaatattagtgatataggaatttaatatgcacttatccactaatattattatgacactgttattttgtctgatagccaacggaaaaatatccaaagttatttcctggcaactcactattcggaaggtatttagtatcacatatgaatacggttataatacatttattaaaaaaaacagttacaatagacaagtggcttcaacttactgtttttaaaaattcttttcataggtacccgtacttattaccttccttatgtatatcggtcttctgctttattatctttataagctgcatgtggctcccggtatgtgcaacctttctatgttattttgctaaatattcgatgtgatgcacacttatgtatgtttttgcaaatatataaaatagtattactttttctacttgaaaatccataagaagatatatagaattacaatggaaaacaaatgtttgaatatttaagcacgaattttgcaattaacaggagctgttgggtgattaagcaatgaaatgtcacatgtggagtggttgtttgagtatggcatatttttaacttgtatgctttcatcgaagattggaagcataaacaatatatggattagttattaaaagaaattgcatgacataatatttcaggagacactgcatgatctcaaagtccacaaaaaggacgatggaccaattgaatctccggttgcacattttgccaaatctgaagaacttcttgagcaacatattactccaactataaataagaatttgtttaagaattggccattgatgtcatctatcattctctactgtatcatctgctttgatgatatggcatatacagaggtgtgtatttaactactttttagcaataatatctatggtggtgcttttaaaatatatggatttttaatagaaacaatgtaatatagtgtttatcatctaccagcaaacacaagcattgacaaaaggcataactaaacatccatacttctttgattatggtaatacaaaagctgagaccaactaaaaatatatattggttgcctaaatcaatacatatagtaggagcttcccctatggtttctaggtcgaaaaaagaacttccatatagttatatattccaatgcctttactgcaattaataatacttatagttcttgttacctgatccaaatagctacattttttctcagtatttatttttctagtcattattgcatttaatcatttcatttaaattcaactttatatgggtacaataaaatgaaatagagagatatgtatagcctttaggctgtctccactaagttgatgagttgattatagatatttctttatgcaaagaatgttttgtttctatggaatttctctaacgtttcaagtcacattttagatattttctctatggtctgaaagtgataaaaagtatggtgggctaagtttctcccctgaggatgttggtcaagtacttgcaatttcaggtaaattctattcataattgcactttccatgtcaactttttaattacatatcaccaataccaattgtcttaaacgatttcatcttatattttctctttctataggtgtgagtgttatgttgtatcaaacatttatttatcctaatattgagaaaattcttggaccaatcaatacttctcgtgttgcagcggtgagttcaatattgcaagttagcatgattttttttacatatgtttaaaaaaattgtacatatcatgattaaattttgcaggttctatctatggttttgctttttacttactcacctatgacgcacctcccaagaccttgggttcaaatagtactaaatattgtttcggtacttaaaagtaatcttgttgtgagtatcaacatgcttgaaatatttattgatattgcaacatatatttgttttgtttctctatgtattagagcaagaaaaaatttaaatatcaacctcaggcatataggtatatatttcttgcttttgttgaacatatttcataacaacatttcatgttttttgattctctagaaaaagaaaatgtttgtttataaagaatgtttctataataattagaaaaatacatgaaattatcaatgtcacatagccaaattttaatttatgagttcacctaaagagtttttcataggattattgcaattggatgttatatctgatttcttttcaatatctgaaagaagcacaaaaatatagcatgggtcaatatcttaattactaacatatttttcctattgttatggttattaggtcaccattgttacttgcacgtacatacttcaaaatgattctgtggtatgtgccactatatcatagtttaattccttcagttttattataatatcttctttttaagacattgtccctcaatggaaccataagacccaagatcaaagaggaacggcaaatggtttagccaccactctaatgtcctttttcaaggcatttgctccagcaggagctggtattgtgtaagtattattttatttctagtgtttatgtttgtaggaaaataagcatcaattctaacttacgaatttcaaatggcatgaagctttcattccaaaaatgtgcactagatatgttcccttttggaggctgttaagtaatttacatttttttttattcaacttggtatacatttggaatgtacaagtgccaatctggtataaaatagtcatctgttaatgcaggttttcatgggcgcaaaagcgtcaacatgctttcttctttccaggtattgtgaactagtactatttgtggaaataactttaaaacttcacattcttaaataaataatattatgaatcttgtaatatgactaaaatttagggggtatttgacacagcttcagatctaagactttttagagctgggtattcctagctccataaatccatggatttgtatctacaatatatttataacatttggacgaatcattttatttaaattttagatgaaatataaaattttaaaccaatataatttaacatacaaacttcaaatcaagtgtggatctgagatctggagttgtgcccaataggaccttagacactggtacacactgtctggtttgttctcaaattctttccttcgccatatgataatttcatatcatgtagtctatttgatcttctctacccattttattgttaactttcttttttgggtatgtaggtgatcaaatggtgttcttccttttgttcattgtcgagtttgttgggctggtttggacattcaagccttttcttgttatgccagaaaaactttctttaaactattcctccaactgagatagagtttcttgagaagttctgtgacatggactacaaagagtttgtatctcctaggtaattaaggcagcctttgtccaccttcttctgcaatttggggagctaccgatagttgacaacaaagggtggacccaaaccttgggccacccaagcagtggcctggggcctggaagtgaagacccatataagctcatctgatttcaccatgtaaaaggatctgagctaaagttggagcggcccagggcctgtctaaagtatgggtccgctcccaaccatataaattcttgttgaagaattcgaaatattcagcaagaaagaaaaatggaagtacaagacgatgaacataaaaattgcgtagttctaagcacgcatccaaaaactgtttctgaaagtggaaaccatgtgtttttttaaaaaaaaataatttaaattgatagtgttgacactaggaaactggtggaaagcctgccgccggctagtaacctaatggactttggacgatcacttatgattgtttttcttcttggtcattgatctcataaagtttgtttcaatcaatgagatcagaatagtttgtttcaatcaatgagatcagaatattaatttccaatcagatatttcctttaccaaatttgtccatagaatagtttgtcatgttcgcgtaattgtaaacacgcatcaatttcggtcagcaattttaaataggtcggttcaccaaagaggcttgtgcaattaggattgtatatatcataccattacatatagatgcttgaagatctgactttaaaggtatatactagaaaatagatgctttaaacccatacactcaatcaagcggctactctcggggcattgattccaggggtgccaaggtgcaagatcgacggatccggagatggctaccaaactccagcatctgccatggtaaaggtggaagcatggaggtctcggcatagccgtcacgtctgaccagcgagatggttgcggtggtgtgagcttggcaagcagggcgttcaccgccattgaggagtccaattgatcaacaagtcttcgatagcactccaatattcacggaagagccatttagtgcgagtgccatcgcttatacaatcaagtattgcagtcactgccaccaccattgctcctatttaatctcattgcgtagctcaattcttctttcgattgtcaactccttatttgatttaatcaggtaaatgattcccctataaatgttgtttgaaactttttttccttcattagtttgactacaatattgtcttgtttagtgctaaatcatttgaaatgagaccagaattgaagatactggagttctagaattgtgtggaaatagttctttctaaatacttactcttggtctcttggggaaagaaagagagacacgtgtcaacatataattgtgcatcatcttaaccaatcagcgagcagcaaccttgccggcttgagatatataaagatattgctgaaactgcccgttatatagtataactacctagaatatataaaaaatgtgacttttatcccaacacttcccaattctcatgctacctctatcatctactaacccttaaaccgcaccacaccatccattaatgagggcattgcagatcttttaccctaatcgttaatttctccaaaacatagaaagctatattttaggacagaccaagtatctaaagcatattgtgattttctctaggtcaggagtgatgtacgtgtgcccttgaaggtactgctaggatcgttcaacagttcttcacaattcaggaataccaagaaaacatcacaacaggcagatatacgaggataattttcagaagcactttccagtttcctttgtacaatggccatatatcagtttaagacaaacgcaacacctcctgctacataagaaggcctattttggaacacgggaattccatggatccctacagggaaatatacagctaaagcaaaactccaactgaaattcccatgttccaaactaagactatcatccccaaagagcattcactaaactgtataatgtaccaatagtgatgccattagctttaagttttcagtcttctgccatggtttaactacggacttctcacgcagcgaatccacaaaaaccatcatctgtgttggaaaatattcgtcattatcatgtggtcaacctgctgtagtacatgaatcaacacaaagataagatgttgagatttaagtgtgctcaataccaatttgatatatggaagttacccttacattttttgccatgcctgcttcgataggactgcgctggttggcgagaacttgattgcctcacctgaacagagtgaaatacaaatggtcaagttatatgttggattgtaacaacaaaattaaatatcagaaatcaggaaacatttaacaagttagaggtgtatccacaggttccacccaggtttaagggtgggaggaagatctagagaatttgccataggaaatcatacctgactactgattggtgttcctgttagtccataataaaaagctgaaaatgcgtgatacattacatatattatagtccatatggaggagtcctttattaattgttagcaccagacacactgtataacatacctaggtgtggaggatatctattgctgtcatgataatgtggcagagaagattcagcagtagcagggggcagcgcaccatagctgacataagaggatgcaaaatgattaagtgagaaagaatccgctactctattctgataaataatatgacatatggggatagtttagaatttcagatcaccttgatgctgctgtagtataggtgctaccctcatgacgacgacaagaatgacctctcaatggataataaggatcaccctggattaaaatcaaaactacgagattaaaagatcagtatgcagtttttcaagacgatatggtttaacctaccagtgttgaaaagggacgcttctctccagaataaatgtgggtataatcttgaacagggtatcttactgtttagaggacgaaaacatcagctgatagggattttaaagagaaaacaatatggcaaaacttcaaaaatatattgtattggacgacatgttaattgtaggaggggagcaaacacaatataataggagcgcacatagccagagtggcagcatgaaacagctagcagattttgcagcctagtgaaaactaagacaacaccatccaactatggcttgattttatcaaacagctggtaggggcttcacatgcattcagatggtttatttgttcaggggaaacggtttacgaaagacatctatctaatttacacaggtgaagtagatattagagaatatgctataaaccagtcattacacagataaaaaatgtcaggcatcagacatcatgaaaccagcttcttttccacataagagcaattgtttctgaaaataaatctgagaactgttatacaacctgtccattttgagaacaaatgcaacatgcatacaattcacccaatcaattaatcagttaataaataatcatccaccttatattcatttgcattttgcactagttttatttttcgatctaaggaaaaggtcaagaacatgcaaatggaggcaattgcttggtttcttggtcaagggtctgtcggcctattaaatatggaggattatgaattcatgatttgaccactctcagttgggccttcggtatgtattgactttggttgcagaaaaatgagcctcatgaccatggaacggtttgcaaattcagattcactcaaatgctaaagataagtttgatatggcacttgttatgacaattggggtatatcttgctctttcattaaaatctgaagatttatgtgtcttgagctatcaatcttcagattataatgaagttggttgattaatgtagttaatatttacataggagaaagctggcagccacagatgggtcaaacaattggaaatagacgacaagatggatggaattgggaatgactaacttttagaagtcttcattttgccttccccagtaatactagatttatggtcttccttggtctgcttgctctgttgggcaggtttagccaatgaaactttaatattcacctgggacacgccaaaagatgtaaaaatcctatcaattgtaaactaatactctgaattaatccaagtcgagaaaagacctttgagccgttcttactgaactcttccttgtcaaaagattcaagacacgagattgcagcctcacgagtaatgtaattaataaaggcaaagtccctccttttagctgacggcatatcgcgtgacagaaccacactttcaatcttcccatgtttcttgaagatttcttttagctgagcatgatcccaggacgttggtatcccatccacaaaaatcgatttaacctagatggaacaaacagtgcatcagagtacttagacttcccagggaagcgaaatcaaatatgttgttaagtgttcagaacttcagatatgattaaaggacttgaacggggatatgaataaagccaggtatgttaacaagtggaaacaaatggtcgttaacttatttatgtaataaggaggacgacgatgcacttcgaaccaagggccaaacatatgaaggtccaagaaacattgttcataaaggacatggacatactagtcaaactgatttttccatccaacagagttatgaaacaattaagacagaacagaaggaaagaaatctctcccaaggtttggataaagcaacatcatgaataatatgtccaggtcgaaatagaacagttgacatctgtaagaaccaatggtataaggaccataggataaaaggttgatagcgaaaaaactgaactctacgatcatcaatgaggccagatcatcagcaatacagagatacagggatgcccttaaaagaacagaaaattcatttcgtgtcagaacttaagcataaacagttacagctagtataccgatgtatatccaggatataattgtgatagcaacagaaccagtaagacacaacctgtgccttatgccaaatgataggataagtgacaagaatgccaaacgtatgactagactgaaagaaagtggaggttgtcttcaaaagaaaaggttaaaacaaataagatcatctgatttgacattcatttgcagtttcagtcttattagagtcacaaaaccaccatatgcatatgatatgatctctataaaagctaagtggatgacacacataggcagtatgttggagagagagggagagagagacctgcatatctttctcattggatcattcaatggttcagcccatgcaactcttatattcaggcctttgccaaaagcatttttctgtgaaagctttttgtatgccatccgtgcatctctactagtttccagttcaagaaatgcaaaaccacgattacagactggattatttgaatcagacttaagtgttacagaatcaatgttctcaattccaattttctttagctgcttgatgacctgctttgaagagcaacatatgagaatataaaaatgaaattcaggctaacacccaatcaagtcaatcagaacacaaaaatgaaaatgttactcacatcttcttttttccatttcttgttgatgtttccaagaaaaattctgtcattcccaactggaactgcagctcgacagagcttcccacaaatctgtagcagagtttccataaacaaaattggagaaagaggtgtaataagtactattcattacagcaatatgtgggactagaagacctggtctatccaaaattttcacaagaaaccatttttatcacagaaaattggcactgcataataataaagcaaccaaatatatacgaaatacatgtagaagtttatggatttgtgctatgatgagtcaaccataacaaatggtaaacaggataggaattaagatcaatgtggcatatcccattaggggatgctggatcaactagtacgacctgactcaataaaatcaatcatggcatcgtagagagaagtcactggtccatttgacagtggaaaatttttaagctcttgcagtaagcttacatggtcattccatccgatacttaactgaaaaaagtatctgtgtaccggttgcgatattatgaaacaaatatgcagcattgtcccgcatttgatgattgcactaatgcacaggtcatacagcaatcagcactggtgcgggattacaatgatgataaaatcaaaccaaaagtgtgatggcctaccttcacattgccgaattccgcgatggccttcttcgcctgcgcggcgtggcggtagcgcacgaagcagtaccccttgttcttccctgcaagaggattcattatcatccggacctcggtgatttccccggccttggcgaacaccgccctcacatcatcc

SEQ ID NO: 27922 - DNA, 722 bp, Oryza sativa
  unsure (1)..(722): unsure at all n locations
catttaagtgtttttttcgaattttttctagtgaaatttcaatttcactaggctacgaagtcacgcattcgcgtgactcaaacccgcctattatacatggtcaaaaattgtaaaaaaaatccataaaaaattgagtaaataaccaattacaacattccaccagttttcctcatttcaatcaatcgtaatctactatcattgaattttacctattttttaaatatccgtattgaatcctaaacttcttatatgttgagaaggtagtacaatgcgaccatttcaagaaatcaaagatatattaaattaagagcttatatatataatgaattttatggaaggatcaaattacaaaattgcattgacatatgtcctcagcttacagtattgcacatctctctcctcaccgatttatctcagtttggatttggagactctggaagcctcatgaagatttaccagcacctgtagttttgtaatctatgtttatccaacgacatatgtcgtttcactattagcatatctgacaattaatattgagtctgttcggctgttatatgcagcggctgcactgctgcagctgccaatacaaaacattgttcctattgactgcagtacaaacactgttcctattgactgcagtatagtaataaaaattgcaannnnnnnnnnnnnnnnnnnnnnnnnnnnnnnnnnnnnnnnnnnnnnnnnnnnnnnnnnnnnnn

SEQ ID NO: 27923 - DNA, 685 bp, Oryza sativa
gagccttggcttcctcaattcttccgttcttctttgctccttgctcttgctcggatgtcagttgctcaactggcggttgttcaccggtcgtcgatcgtcactgtgtcgcatgggccagggcatgccgtgccattcgggggccatgtcatgctagcttcccacatacaacttgtcgtgcggggttggggtggcggcccaagcatggtatggttagatgggtcgtgccatcatgacccatagctaaacagggtgtaccattcctgggtcgggaactatacatacatgcccgggctaatacggaaaggcctagcccattttatatcctataggaagattcggcaaactcatagaagatgattagtaagctagatgttccacctctttatcttatatggacaaaatttatggccccatctttttgcttatgctgatgcttatcaacaaaaaattgaattttcaaccttaaatttaaagctgattttgagtttttttcatcgaagtttatttttcagccttcgcttttaggtcgctaaaaacacgtatgtaaaatttttattcacaaattacttattgtggaataagccaaacaatgaggccgttagatgtctggtactaatcacccttcctttaaaacttacactaaggctacaccataagaaataaaaaaccattttgtatctctgta

SEQ ID NO: 27924 - DNA, 329 bp, Oryza sativa
agattggacagtatattttgagattgtgtcagcatagaatggggggacggccctaatgttgtgttggccgggttgcgagcggataaaagcggacgtggggactctggtcggggcacagcgtaactaagataagagagccattccatttagggcgagacagaatgggcgggcacaagcggtctggtgtccgagccgatttgtcagacggtgaaaaaattatctcgaacaccttatagtcgagagtaattatctgaaaattcttttgattatattattggggaatgatttttatagatggatatagacccaaagataggttttttttttta

SEQ ID NO: 27925 - DNA, 831 bp, Oryza sativa
  unsure (1)..(831): unsure at all n locations
nnnnnnnnnnnnnnnnnnnnnnnnnnnnnnnnnnnnnnnnnntgctcccttgatgaagagctggtgggctgctttacaaggacatcaacattctgtaccaactgtgagcccgatcccccacttgggccacttagcatgttttgaactggagtagcattgcctgatatgtgcccatgttccaaacagagcatagtataagccaggcatgaaatatcagaagtcaaaagtagcattcctgttttgtcgacatttcactacaggacaaatcatgataacaacagctatttaagtactactcaattctaaagctaagtgcccatctttgcaagatcctaaggattcaaggtgcattaatcaaaatatgttttcttgtgagcactcagaacaggaagttctccattcatggtcaaggcaacaacaaatgctcctgccagctggcagtcagcaatgaaatgatttaagggaactccaaacaaacataaccctatccacttaagcataacaattctaacgttcaaagaatcactaacaaatgcggaacttatttattcatagcttcagaactatttgatgacgtgacagcaatacaactctacttctatttcaaagaaactaaaatttaatcccatgcaattgtgcaggatatttgggtagtttcataacaatctgaaaatgtaaccagataagataagtacctccgatggaattaggagcgcctatgtgtgaaacatctgcattcagcaaggatgaaccagctccaggacgctcaggtggaactgtgccagaggcctgaagatgaaaatgacatgagctagcatgataaaatgaaca

SEQ ID NO: 27926 - DNA, 874 bp, Oryza sativa
  unsure (1)..(874): unsure at all n locations
nnnnnnnnnnnnnnnnnnnnnnnnnnnnnnnnnnnnnnntgttggtagaaacacacatgatcgatatatctctctcacttgacaaaaacttgaagatgaacagtaagctaaagagcaatgaacacagaaagttttgtggtgcttaaatcttgccgcaccgttttcacgttttcttcttccttttattgaagggaaaatgcacactacggcctaacaaattgaccggattactcgctctaccatccggattacgagcgctatcccactcgtcagatcgtgcagcgagagactcgcatactaccgcctcgacgtgaactcgcacgcctcaggtctacagacgcgctcaactctgactagagcgagcccagaaaaacagggaataaaaaacaaacacataacgtgcatgaaaggaaactatcctaactgaataaaacagcttttgcaggcacaagtttaacgtaatatgcaacaaatctccccctaaaccttgtgctcgcgacttacttccaaaaccccgatccgcgagcgtagctcctcaaaccgcactcgaccaagggacttcgtcagtatatcagtgacttgatatgcagtcccagtgaattccaactgaactcgaccttcttccacacactcccggatataatgataccgagtagctatgtgttttctgcggtcgtgaaacaccggatttttgctcaatgcaatcgccgacttgttgtcaaccatcagcttgaaaacatctggttgagcttgattaatttctcccagcaactgtgccatctagacaccctgacatgctaccgtcgtcgccgcaatatactctgcctcgcaagacgaaagagcgacaaccttttgcttctgggattgccaactc

SEQ ID NO: 27927 - DNA, 403 bp, Oryza sativa
agtatatacctagttataagtattcgattcatacctatacctagaaacaaaacaacttaaattcaactttatttgacaatccagtattacatacctaactaattatatatttggatgctatatacctagaatcaaatcctaataaaaacatgtttaaattcaatttaaacttgttttgaactagttgtatagttaatattaatacctaaacatttgaaaaaatttcatactcatttgaattgagtatatactcaatttgaatcatggagcccaggcaccatggagcaccaaacaaatttaatatatatatatatatatatatatatatatatatatatatatatatatatatatatatatatatatatatatatatatatatatatatatatatatatatata

SEQ ID NO: 27928 - DNA, 597 bp, Oryza sativa
  unsure (1)..(597): unsure at all n locations
nnnnnnnnnnnnnnnnnnnnnnnnnnnnnnnnnnnnnnnnnnnnnnnnnnnnnnnnnnnnnnatgcaagcttatagcactgcagattacaagagattaatgtttggtgagtgctatacatgattaaagtattcaataattatacattacatgttgataaggtgtcactaggaggcggcaatgagagtgatattaaccacataatactaagtactaacctcatcactgtttacttgaatatatcgtgcaactgctccaaacgcgaagttatcaactgatacaaaattgggcccagcaaaatccaaaattacaccatcttctctgcagatgccaatgtgaccgataaaggggatcaaccatgagattaacggtaatggtgtccatactatacaacaaggaaagcgagctcttcttgggtcaattggagcaggctggcttctgtcggtttccatcaggacagtataagcacaagctgttggaaaagagaaacgggttaacattaaataaaagtgtcacaagcatgttgataggggtgccggcaaatacacatcaaagcatgctaggannnnnnnnnnnnnnnnnnnnnnnnnnnnnnnnn

SEQ ID NO: 27929 - DNA, 726 bp, Oryza sativa
tgctggtctttaccatgaagctgtgcttttccttatttttttttccttcatgacccaccatcaatcaattcacgggtacctgaaagctgtaattgtggttttagggacagctccatgaattcagaatttcggtacatactgattcttgtcgggaggcaaatgcatatgcttttatcattgctaggctgtgagcggttgtcgttgtctgctcccaggtctgggattacatgacctgtaaggcgtgatatggatgttcaattgtctccctactgtctgatccgcatctatcatgtgggtctagtgcacgttgtctgtagtcactgtagcaccagcattttcatattctccctcccatcactttgcaaaattagagagacccttctcactggactgttgccacactgtatttttacctactagtatcaatgttatacagtgcagctacattatctctgtcgtttgctggcattttggccaggttttctcttgcagccatgcatgcatgcatcgcctatgtggtgtagtaggtcagtatcagtaggtcccggttatgacctgtgctgctgtgcacaagttgtgacattttgggctgcagtaaaagtccaggtaccatcgttatcaggggggttactcgcctctgcatcctatgctatgatcatatgatgtgtcggcattccatgcatgtaggttttccacacacacctaaaatgagttttttttaacctt

SEQ ID NO: 27930 - DNA, 608 bp, Oryza sativa
  unsure (1)..(608): unsure at all n locations
nnnnnnnnnnnnnnnnnnnnnnnnnnnnnnnnnnnnnnnnnnnnnnnnnnnnnttttagattagacaatttatcggagtgatattgtcatatagaacttgtttttaacagagaatagcatttgcagaattgaaaacacagttgctggagtagttgctacggtgctcacggattctttttccccatatatgtgcacgccgtttgtgattctcgttgcactgcgcatgtgtgggtgatataatttctgaaagaaatttaaaacaaaaggaaattaaacgccaccgctctgactattcttaggccttgtcttccacgtggtgtcggccagcaaaattctgaagagcttaatttggaaatgacatcaccatcatgatggtcgcaattaggacacgtttgtttacgcgaataaacggaccaattattaggaattaattagcccatccattaatgtaagtttattccagcattatggagcgtacgtgcactaccaagatacttctttcgttatagtaattcatattgtaagtatgtcgttttgagccaaactttattagaaaaatttagccacatattacaattaaatataattttaataatttatttgatttg

SEQ ID NO: 27931 - DNA, 1408 bp, Oryza sativa
  unsure (1)..(1408): unsure at all n locations
aaagagtgtttcggtccactgagaaccatgcgatcaaatcttagtatgctgtcccttttgagataagcaagagcgcatccttagggttatatgcatgcttaaaataacatgtgattttactactataatacagagttccgtaaattgcaacatcagaggttgactatgggggaaataactctgatgtcttcttgaactatgcagacagatagggcagctatgctagatgagatccttgattatgtgaaattcctgaggctgcaagtaaaggtttggttcactatgctattatctagtaagcataaaccacattttgtgtttttagttgtttgatagagcatgattctatggtggtaggttttaagcatgagcaggctgggtggcgcgggtgctgttgcacagctggttgctgatattccactttcagttaaggtaaatctgtggccattaactaatatatagcactgtgcccagttactttctctcgacttagtttttactgccattcttaatatacttccttcggtcaaaattatttgacgttggctatgtggtttatttgttagttcaaggttttcttctctcttgtataaaagcaatacatcaagcatatcatcctcataactatgtatagtaaaattgtgaactaattgctctctgcagtgcctatttttcattcttttaaattatatgctacttgttcttgcccattctctctctcccttctcctcctcttgctcctccctcctctctctgtgtgtgactgcagagaaattgatggatgtttgctacatgggaaagcatcagcctgtacttaaatcagatctccatacaaaataaaagcacctttgtctttgtttcatactgacaattactctgtatttccactttattcaaacaaaatatgaatcagttttcccttgcaagaatcattctacttctgattcctctatttttctctcgtgaagtttttcacttctttcttctagacagtggtgctgaaaggcagttcccactcaccacattattttcactgctggccttttattgatttcttgatctaattgtctatgtcagtgcaatccatttgtacttttgctatcagtgacagtgattgtagcttttcctgtctcttcttgaacataaaacttctatgtctatagtttaacaataatgaatagtgttaaagtcttagcaagatgaagatatgacacatttctaccatatgacaacatgtcttgtagatcccacattaaaatctctctcatctctagtttcctgatgagcacagtgtctccattaggcttttgcttgcttcagagcccaattacaaagacttgtatacttcctgatccccatcgatcgctccannnnnnnnnnnnnnnnnnnnnnnnnnnnnnnnnnnnnn

SEQ ID NO: 27932 - DNA, 1032 bp, Oryza sativa
  unsure (1)..(1032): unsure at all n locations
aaggaaagaagtttatcagttcaagcttcgacaactcggtgtgcacctcgtcgccggcgacctcttttttcacctccatcaccagcaggctcatcagcatgtccgacgccgccaccaactccgccgcggctgcggcggcgccgacgaccaagaagccgtcgtcgtgcgccaggaaggccaccgccgacgacgacgccggcggcaaaatgccattgcccaaagaagaagtccgtgtcaatctcgccaccgtttctcggccatttctgccatgatcttgaccgtgttcttgcttccgatttcttcgcaggaaacccagggagaagaaggtggtcaccgtgccggcgatcagcgacaaggtcgccgatataccttcggacaattattcttggagaaaatatggtcagaaaccaatcaaaggctctcctcatccaaggtagtaaatctcactactaagaacaattaatcatctcaaaattcagtcatagcttcataatactcgttcatctcagttactgctactgatcaacttctttgcaattccaattactatgatcagtttcaacttaagacaagaataaccatctcattatcatctttaaaagacaatagctaatgatcaacttatctgtcatgcctattaatacggccacttccaactgatctgcaatctgtaccctgtactctgcttaatcatgatcaaatgttcagatgaaaaaaattagacaaatttgatgagattgattgtgtttgggtttgatgcaggggatactacaggtgcagcagcaagaaggattgcccggcgaggaagcacgtcgagaggtgtcgcagcgacccggcgatgctgctcgtcacctacgagaacgaacacaaccacgcgcagccgctcgatctctccgtagtgcagcaagccaccgctaatccccagacctgatgatccttagcttaatcaccatccgtgtatctatcagcatcactgcaaatgcaaatgcaaatgnnnnnnnnnnnnnnnnnnnnnnnnnnnnnnnnnnnnnn

SEQ ID NO: 27933 - DNA, 543 bp, Oryza sativa
  unsure (1)..(543): unsure at all n locations
agataaaagggactaacattgggccctctaataacttctcctgcctcctgtttaatttttaaactctgtaaacaccaattactgttcattgactgtgcaagtacaggtgaagctgtccacagggcagatggtggacttgatcccttggtgcttgcccaacacagccaaaaggcacaatcagtggaaaggactgtacggtaggttggactgggagggcaatttccccacttctgtaacggatcctcagccaatggggaaggtcggcatgtgcttccatcctgagcaggacaggatcattactgtccgtgaatgtgctcgatcccaggtacacataccaattttcacaccccatacattcactgctgcaacaggttaatgatgcttaactaatcatcaagtcattgactaacccaaacaaacaaattttcaggaagttttatccttcaaagtaaaaaaagaaaaacattttgtctcaatcagcactgtagnnnnnnnnnnnnnnnnnnnnnnnnnnnnnnnnnnnnnnnnnnnnnnnnnnnnnnn

SEQ ID NO: 27934 - DNA, 930 bp, Oryza sativa
agctgtcttttaacaaattcatgtgttaaaagaatggtttctgcgagtgacaactgctttcataagtattattttagagaagatatatattccctccgtcccattttaagtatagttatggtttttcgcgaccaactttgcccgtctgtcttatttgaaaattttttgaacttatatttgcacttaaaatgggacataatgagtagattggagtaggttgcttacaaacttgcaatgtttcttggacagtaagtgaactcaaatcataattctctaccatcaatcatcaactcatcacctaacttcaaacctttttcccctaaaatcgatgtgattccgtggcatgcaaagttgcgaacgcatcattgctttgtttacctgcagcagtagaacatagagtaggagactccgttgttgcttcccgggaaatataatccgttgcggggccgccctcgtcctctatcccgccttgcctgccgtcctctgcacccgctggccgctgcttcgcctcgcctagaaagagagaagaggagaaagagggagggtgatgacgtggatcaccctgacatgtgggctccacgtaggtctcacgctagctcagccgtcacatcggataaaatcggatgcaatactgctctatgaccgattgtgacgagtcttaattaggcatgcaaaattggttatatagcatcgaaagttcacatttttggttttgtagcaccgaaagttaccggttcactttaatagcatccaaagttcactctgttcccatttttagcacttccgtcaatttttccgtccgtcttgatcgttattgatctagccacacacatgatatgacatttctacccctcattgacatgcattatacttgtacttgtgaggggtagaaacgtcatatcgtgtgtgtggctggatcaagacggacag

SEQ ID NO: 27935 - DNA, 721 bp, Oryza sativa
  unsure (1)..(721): unsure at all n locations
nnnnnnnnnnnnnnnnnnnnnnnnnnnnnnnnnnnnnnnnnnnnnnnnnnnnnnnnnnnnnnnnnaataaaagaagagacgatgttaatgttgatcttttcttttcaatctgaaacagatagctttcacagtttccaactaaaaagaggtcatatttcgcatctagttttattttctttatcatttcctttgttttatgaattaatagcaagcagaaaaggctgtttagctgcaaacaatgtatgccttgcgtcagttatacttcatctcccctttaacaatatcaaccctggaaatattgatattggtccatttcaactgaaaattcatgcagttcaaacaggtaacgatcaaatttaaaatgaaacatgtcggtagatttacattttgcaaggagagctaaagttggcatgattatattctttgggggaaaaatatggtgatcatggacagttaagtaccccagtagccaggtttggtgacagtagtggctgaaatgtccagcacaccggccggacccaacacaggtaaaactttgcactcttgacgctggcgcgtgggcccgatttggttattataacttcgtcagattagattatcctcttaagcggcctccgatcgatgtgtcagcgactcctgagcattatctagacaagaaaattgtcataaaattttcatcaaaaatgatgccaataacgactagctattggttaaattaaat

SEQ ID NO: 27936 - DNA, 616 bp, Oryza sativa
cagcgtcaagagtgcaaagttttacctgtgttgggtccggccggtgtgctggacatttcagccactactgtcaccaaacctggctactggggtacttaactgtccatgatcaccatatttttcccccaaagaatataatcatgccaactttagctctccttgcaaaatgtaaatctaccgacatgtttcattttaaatttgatcgttacctgtttgaactgcatgaattttcagttgaaatggaccaatatcaatatttccagggttgatattgttaaaggggagatgaagtataactgacgcaaggcatacattgtttgcagctaaacagccttttctgcttgctatttaattcataaaacaaaggaaatgataaagaaaataaaactagatgcgaaatatgacctctttttagttggaaactgtgaaagctatctgtttcagattgaaaagaaaagatcaacattaacatgtctcttcttttattcccttcaatcttctgttctcttccagcctgtaatgacgagttctgagaggctccccatctcgaattcatgctccatttgacaactctttctatgccctttttattttttttttgataaagaatgtagtt

SEQ ID NO: 27937 - DNA, 445 bp, Oryza sativa
tgccttcgttgagttcgttagtctagtggcccttcatgtcaccattggtttatcttgagaaaaaaaaagttcatgtatatatattctgagtcctctcttccatccaacaggaaaacaaaaaggagaggctcaaactataggacaatgccccatggatgtatacacattgggattatttgcaacgtgccattgtgaaacatattcactcgatgaaagaaagactcatcgagttgttgaatgtgtgtgcaacgttggcactagagtcactgtccgttagaaaaagcaaggaactcagaaacctcatactatttactccatccgccccaaaaaaaaaatccattcctagcatcttaaagtgaaataagtggagagtgagaatgactaaaatacccttaatcattaaaaaaaccgtaagagtgataggtaggtaaagatattgaagaga

SEQ ID NO: 27938 - DNA, 1240 bp, Oryza sativa
cgggtggtccatgaggcagcccggatcaaccggcggcgagctcctcctcttgccaagcctcgccctcgcatggccgaccctgttgctgaggatggtgaccaccttgccgaaccttgacaccgcctcgtcggtctccgcgacggccgccatcagccggaacgggtcgccggacttggacaggatggccacgagcttcttcgagctctccaccgccgccatgttcgcctcctccaccccatccatggcgaaaaccgagtaaaattcaagcacccttggtgttgcaatggaacagtgagtgtttttcagctgagaaatcaatgaattctagcagaaatgagcagatcataggtagtaaatagtaactgaattgatcaaagatgaagaacaaatttgaccaagaaaatgaaaaaagaaaaaaaaaaggagctttgtaagattggatgaaacagatttctctatgaaaatctaggaggaacaagagatgaaaagctgcaagattgcaagaaatggtggcgtaggaaaaagtttatgaataagatcttggtgagattttatagaggaggaggagaatactaccattatatgatggcaaatgaaatctcattgggtccttcacttgtgcaggaagtaattcggggagtatagaattccatctgggagtgagaggaggaacaccattggaataaaattttagcaaagtcaacgagactgctcctgatcaagtgatcacagccgtcggtaggatggacggtctggatgctatttgactttgcttttatatttttttttgttaacattgaaactgaagtgtggacatggaactaaacttttctgcagtttcaagtattttatgctcattatcaagtacagggacttgaaagaagttgatgagctcataaacattttcctttaaaaaccattatagctgttttatttataggattatgactgcaagtcttagacactaaaattcagtaaggcattatttttgggagaaataaaaactgaattgaataagtcgctttggctgtattttttttgccagctcactggcagatgaatggatcaacattttggaagtcaacagaaatttcatttggttttgtttggtggaaatactatatcatcggcttgctgttcgattccagccgtcatctccaccagtgtcagtcacaaacaattccatatgaaattctccattttttttatcgaagccaacctccttttaactgatgatatg

SEQ ID NO: 27939 - DNA, 840 bp, Oryza sativa
  unsure (1)..(840): unsure at all n locations
tcagtgttgtccatagggttccccttacagtttttggcgtggttattgaacccccacggcaaggtggttatcgcgaatccgtccggtaaccccgagaaataccgtggttttaaaaactgaaaaggtttccgtgcatggtaatcgcgcggttttgtgtggctccctgatagtggtgagcctagggacaatgactaccaatgggggttctacacctagatttgactgagtgatgatgggacagtattgtctttacggcgtgttggtgtggacaatgatggtggtggtacaggtgatggccctaggagcagtggctactagtggaaacttttcatccatatctgactgtgtgacggtgagggtgatgactattgtggcggtgcttttcggcatggtagtggcaatgaccctaggggcagtggctgctaaatcgtcggtttataggcctaaatcgaaccatgtggattgggaggtggctctagctagtacgacaatgacaagcttggtggctgtgctagtggcaactggagaggaaggatccaacctaaagtcagacccgacgctcttttaatgagcaagacgaggagcggacatagggcttgttggaggtgctggcaacggttaggaagcgatgctgaatttgagacctaaacagggtttacaaaaccgcgcagttatcgcggttaccatgcacggtaatcttttcaatttttaaaaccacggtttatctcgtggttaccacgccaaaaatggtaagaggaacctagcatccatttccacgccattcannnnnnnnnnnnnnnnnnnnnnnnnnnnnnnnnnnnnnnnnnnnnnnnnnnnnnn

SEQ ID NO: 27940 - DNA, 335 bp, Oryza sativa
aggtcgccggggcggccggcgacgcggcagcgggagcacgaggcgacacagccggcgacgcggcggcgggcgcacgaggcgaagcggcggcgggagcacgaggcggcaccgcatcctcgaccgcctgccgctggatggatgtcctgattcagcagcgcctctatcttgtcgtaggtgccctccgccgccagcatccccatgtagttgaagtactacaagagcaaacagattcatatatatactcagaatctcatttcaggaatcaaagtaactattctcgatggaattactctagcaaacccctctttgctcacagccatgtgctggcgaggtgc

SEQ ID NO: 27941 - DNA, 946 bp, Oryza sativa
ctttttcttccgatgtctcattttgcgacgtggttatgagcatcagaatttgaactcaggttgctgttatgatctcaaggctgatttgctgctctcctatttttgaaagtgccaccacttgtgctatttgaagtattgcttaagctggataacacgtgtttcacccctggtctagttctatttggtgctaatgaacgaggtggtggcataagaactcgagcatctctctgacgctgaaaagcaaaacagacgggattaaatgtagggaagcataccaaagcaacctactggaaatttgaagaagtttgtaaattgaaataccagtatagagagaacaacctgattcttttcatcgcttgacatgccagacgctgccttacctgaagcactggaagctggttctctgcattaaactaacaaaatcaggaaagatgccttttctgcagaatgtctatgcagttttagactaagtacaacattaacataagagactgaaaaggacaaactacaagcctatgatccaggcgcacaaaacagctatgatctcaaaaggtgctatctttaacaaataatcgagtatttcatggattacttccagattttgtattatccagagataatttttagataaccctacagtaactaaacatagacaagcttaggaaaattactgtaaacagtgagtagtcaccaattctaaagctatattgctatctgagcagcaaagcataaatttattggttatatacatttatctgagcaaatggaataattgcaatatagtagcttaacacatgatatatcagatggaacgtaacaaggaagatgcaacaaacatgagggagcatcatacttggcacttttgtcagtccattcatcatcagcctcttcatcacttgaactccccgacatgaagaagtcgtcatcactcacatccacagtatca

SEQ ID NO: 27942 - DNA, 663 bp, Oryza sativa
aacttatttattcatagcttcagaactatttgatgacgtgacagcaatacaactctacttctatttcaaagaaactaaaatttaatcccatgcaattgtgcaggatatttgggtagtttcataacaatctgaaaatgtaaccagataagataagtacctccgatggaattaggagcgcctatgtgtgaaacatctgcattcagcaaggatgaaccagctccaggacgctcaggtggaactgtgccagaggcctgaagatgaaaatgacatgagctagcatgataaaatgaacagaactacataaatgattataggataaaccaatcagtgcatgttgctctagttgtccattttaagtccaatgtaacaaaaaattgaattgcaaataataaattataggcacaaaacgaggcatagccacacattgcaacaacataagctgggaaaaaactgaaggcaaccaacaaataggctaatttcagcaaatgaaggccagtgaccatcaaattctggagcacataaataggctatttttcgtttcttagaaaatcgatgacgacatagaaaagacaaattaagctgacatcacccaactaagcacaagcacctagaaatggctgtgacagcttatacgcatgccagggcggattcaacgtgggtgca

SEQ ID NO: 27943 - DNA, 702 bp, Oryza sativa
  unsure (1)..(702): unsure at all n locations
tgaagcccgcgccgtcgaacgccaccctggccgccgccgccgcctgctgcttcgtgctcgcgcacggcgacgcggccgcgccggtagacgagccggcattgtcggcgccgaacgaggaggagcgagaagacgaggcggtggcagcggaggcgctccttttgtcgccggacgcggcggtcgtcgccgtcgccgtcggcgggggcttgtagtacatgcgcgccgtctgggggcagtgcgagtaggccctgacggcgaccctcgcggtcatgcccagcaggtccccgtacgccgcgtacttccccatcgccatggatggagctcgacgcgatcctcctcctcctcctccggcaagaacaagaacaaagaaccagagcaagatcggctccaagaaccgcggacaagcggatgatcccctctctctctctctctctctctctctctctcgcgatcaagctagcgatcgaattggaaggattcctgtgtcgcgagctcggattctcctccttggcaatggatgtgtagggtttgggggatcggtgtatttgtagccggtggggagttcgattcggagtccgattcggacaaggatgatcttgctcttaccagccgcggcgagtggacgccacgggaattttcccggnnnnnnnnnnnnnnnnnnnnnnnnnnnnnnnnnnnnnnnnnnnnnnnnnnnnnnnnnnnnnn

SEQ ID NO: 27944 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtaattatcagcttacatgtcattcttgtattaatcagttccgtcatgcaatgttttatgcagatgggcgatccccattgccgtattattgtctttttggcttctttactggcgatgtttcggtagaagaaaacggggcagccgatcgtcactcctgccactccacaacaagatctcccacaagaactcaacgcgcccgagatcagactaatctgatgctcttttttccctgaaaggacagtacaaagtatcaaacttgtagaagcagaagatagctgtgaatcatctgtcttgtcttccatgccgcgttggagtggattggattggatgggccttcttttggtggttccctgccaatgtatcactgattcgtttcttggccgcggaagacgatgaagtcgctgccatttgagcgcgtgcgcaagcgttgttgtggttggtataccgagttttatgcatttttgtgtagctaggctgcccttacgggatgcgatctcattcattgattattgttcacaccccaccggtggatcttatataaggcttcctttttttttctctaaacgaaaaatttaccattaataactacacttgcttgtatgatgaactgtgatgggattctgggtgaaaatgcatcaacttatttgattatgaaaatgacatgtattagg

SEQ ID NO: 27945 - DNA, 2282 bp, Oryza sativa
ctaagtcccttagaagaagagggtactaagaggtgtcccttacaaagaatgcacaatgacgacgacgacgaccaacaatcatcaacctcacagcattagcaatgtctacgcctgtccaatcatcatttcctgctcgcagtgtctttcagaaccgaagcagctctgggtttcggtctcaggacgtcgacccagacgaagccggcccaccgcacatcctcttctggagatgctccaggctcgccacccgctgcagcgaggctgtccggccaatcttgccggcagccagagcgccattgacgaagtcctcgtcctcctgagccgaagaaggtatgtcgggcatgtagttgttgttacctccgatgtcgttgttagtagcgaagtaattgttcgggtcatcttggatgggaacagcagcgtctgacgttgcttcagatggggagctgttgaatggcatgctgagggatgacatatcagaagcggcgggaaacaacgcgttcatgcctgtcacccgcttcaccgagtcctctgccatcttcacctgcgaatttttgatacatttcaatgttcagattgacctgatttaataatcatgtttggactgtccaaatggtgatttatagagtataatggtagcgtggattattcttctaataacagggtacacaagtcagttgaaagtttgaaacaagccaaagtagccaatccatgggatgcatattgcaaaaggcatatatagcatacctttgctctcaaggtctcaacatctgcttttagcactctattgtcaacagcagcatcattgtacttctggttaacatcagcaagacgccttaacagcgaggagttctcgactcttaattgcgatacctgtaacaagtaaatccataactgaagtcagtagccagtaatttaggattttatgtcttatcgaaaataactatgtgaactatcagacctgtgcctccagctcattcaagtgagctgcctttctgcttcttgagcgcctggctgactcccgattggattgcttcctggaacaggtcaacaaaactagcattatatcgagaagtgcttgctcaacatcttcatacaaaatcacccaaaagaacagcctatattattgtctagcacaagtaacataataaacaatacaaggtataatgcaatccaccatatcatcacgtgacgtttgaatattttgattttagtgagcaaatgtggggtgtacacactgtccatatcataactcaccataccttgtatgctgcacatacatgtaccctaccgtgacattattttacagccaactgagactaataccaaacttaaattgagaaaatagctgccaaatgaattctggtaatcatagtcgatagctatcaaatccgtggtttattggggtaattgctttatgaaaggtaaagctctctagggagtataactttgatttgcaaatccaagatgggggtgcatcaaccagatactagatacaatcggtttcagaaacttgtgacataaggaatatgatgtgaactcagatttaattcatcccaaattgcttatgtcaataaacaagtagagagcaaagtgctacgtgtaatggccatacaaattcctctcttgctcgagacactaagcactgagtatggcacacagagaactaatatggtaggtaaaagatcatatatgcgatgcaataggaaactgaaaggctaccggatgaaagtggaaatccaactgaaagggctaaggtgaaaataggacacatgcatgcatgacgaggtaggttaattatgtacagaatctatattacaagcaagcaatgaatgatcaccttcgttgtaatctttgatcagcaggtcttgcagttccagtggtctcagcttctccctccatgtcatcatcatctgactgctcccttgatgaagagctggtgggctgctttacaaggacatcaacattctgtaccaactgtgagcccgatcccccacttgggccacttagcatgttttgaactggagtagcattgcctgatatgtgcccatgttccaaacagagcatagtataagccaggcatgaaatatcagaagtcaaaagtagcattcctgttttgtcgacatttcactacaggacaaatcatgataacaacagctatttaagtactactcaattctaaagctaagtgcccatctttgcaagatcctaaggattcaaggtgcattaatcaaaatatgttttcttgtgagcactcagaacaggaagttctccattcatggtcaagg

SEQ ID NO: 27946 - DNA, 6934 bp, Oryza sativa
acccatcggacccatggatacccccctgagtccccccttcaattttttcaccatggttgataagataagaggtgctaaaggtctcttaatagcattttagcatagtttaatactgagatgatgtgtttatgccagtgtactcggtatgttgaatccccccaactttttgttcctggatccgcccaatcaaatacttgcataaagtcacatattgccaatctaaaaaggcaatgtacagtttaagcagccccatacaaaaatattgcaattgcaaacaaaccactgtctcgcagtttagtaagaatatgactgattacattgccaattcgccaggttgcatcgatatcgcaatctcaataccgaggtctatgaagcttccgtttgtacacaaccctacatactttgagtcgaaccaaccaccgacactcaacagagcgcattgcaagaccatggacgccattggtctatagaaatgcccgatctaaatacctataaacattcgatgcaaacagtagctagcattgccgatctcagtaagctctcgagtactagaggggggggggggagaatggctgtaccctccacatggcgaccgcggcgaggtccttctccagcttctgcttcagcatcgcgttgtactccacggggtccaccaccgcgctcgtcgtcgccgccgccgccgccgccgccgagagctgcggctgcttaacatcgaccggcaccacccctcctgcgcccctgatccctcccgcttcggccctcgggctagggttcgggacggggctatcgagcaccgcctcctccagaaacttctggaagtaccactccgacgggcaccggttcatcgcgttcccgccgccgccgccccccgctacaccaccaccacctcccgaagccacgccgccgccgccctgctgctgggccgccgccgccgactgcggcggcggaggcgggacccagaatgggtcggagatctcctccacggagaacacccgctccatcgcggaatcggaatccgctctcgccgacgcggatcgcggggctaccctccgatggattcgcgagggggggattcgagggtttgatcggagaaaacctcgcgcgaattgccgcttggagaagaggagaggattgggaaggcggctgcgtgctgctaattttttgtgtttgggtgtaaattaatgactcggatgctcctggttacgacaaatactacgcggtttttgttccgaggttggggttgggaaaattttggattactactaatcttctttaccggataataattaactaacggcaaaatatgcgtttgtaactactgggtgagggtagtttggtgtgcagtgcgctgatagtaggatatactgctggtagtaattgttatccagaatttatccataaaagggatcaagtggaatttagatatatcgtggataaatggtataccgtatattatgtctttatttttgtcgcgacgaatatctaatatcaattttatggatataattgtgcattcgtatactacacaatgctagaaaactatagggacttcatccgtttcatattataaaactttttagcattgtccacacacgcatatacatacatatatatatatacacgcatatacatatatatatatatatatatatacatatatatatatatatatatatatatatatatatatgtgtgtgtgtgtgtatatacgtatatatacatatacgtgtatatacgtatatgtgtatatacgtgtatatgtatatacgtatattaaacggagggagtagctcggttggtgaattagacacctcaagttcgatttctcccttgtacaaaattataaattgtttgggagatctcctttttcatatactacacaataccgtgaacatgaattgccctagtctaacttggcaatcctataaaacctgcgaaaacccctcgttttcacggctggggctattcaagtaccctaactgcaacaacacaacagatgctatcgaagaattccaattcaagtaccgtagcggtagcgatagtcatacgtagctttacctaagtaccgaattgccccgttatttactaaaatccgataaaaaatatagcctcccataaaaataaataattgcattatccattctctctcttgttattaatgtattagatgggtaccacaaacgaatttgccatttgctttcctgttattgtcgccaaagtgaaaaagaaaaaaaaaaaggaagtaaaacggcatctagtttttaggtcaagactcaagaccgaacacgcacgttgcgatcgaacagaaaaatgtcacgagaatgtcgcggctgatcgatcgatttgacgacgatcgcaacgtgatctccccatgcttatccctctttccgcagcagcagcagcagcatcgacgactcgacgtgacaaaaggaaaaaaagcgagagggacacacacagattctggttgaatgcctttcccatctgcctattgtggattggattgggttcccttctttttagcctcatccaaaaagggcaagccgatggtggtatatgcaaatttatttatttatttttacttatttatttattcctttcatctgataatgactcgtgtcaacattttgtgaatctggccttacgtttcatcatcaatcagagatgataagaatgtttactgcttgagaaattgaaagtgtactgtttgaaaagaatcagagatgatacgagtgtttaggttgtgtttagttcacgctaaaattgaaagtttagttgaaattggaacgatttaacggaaaagttggaagtttatgtgtataggaaagctttggtgtgataaaaaagttgaaagtttgaagaaaaacttcgaaactaaacacggcattactgcttgaggaattgagagtgtacactgtttaaaaggatgagactgatttgtttcgccatgtaggaaaggtatacgaactgtttgcaaaagtggtttgatttgagctcctttgatgttgagattgttttttttctttctctttaatcattgcaaaagtggtttgatttgagctcttttgatgttgagattgtttttttttctctctctctcttaaatcttaattctttttctcgggggatttccaggaaagcgagattgcgcggatgatgcgtgttggtgcaagcaattgactttttccatggctacagaacatcactttttcatggctaattccagttattacagatcatgccatcagggagtaacatgcaaattagtatagctgtttgctcgctaatgcacagctgctaaattgacaagaccaattcaactatacttgcttatgttacactgcttgttccaatgttacactgtccctggaattcagatatgcttaatctctttcattctgacttgacaaggtagcccgccaaccaaccacttggttcattttgattccagatttccagtcaagaacatgtcatagctagatgatgatgataagcatagaagaagtgtatccctttcccctcgaaaaagcatagaagaagtgtatgaatatatatgggtttaattcgttatggagaactggaagaaaagtgtcagcatctgggaccatggggatcattttgaaagacaagtgacccctgcaaattgcagtcttcctggagaacttgggcaattaggggaggaaatctgaaggcaaagtcgctttcagcgcagccgttgtgctgcctcatccatggacaagagatgatggattcagacggcataatctccagtcagccatggaaatcatccaggccttatccgtccttgatgtgttgcctcctatccccacaggaataggaatatgggataactcattccaatcgctgtcttttcagcctgcaaaaggattaacacgatgtttcccagaattgatggcatgacacaactcctgattggatcttacaaaaagagcctaatatgttctgcatattaatttctcctgatatactactactccataaatgttcattggattttatttatgaacttacaaaattggagatgcaattctgggacagctatttcagacagtttctgagctaccttctttattattcatctgtatgttaacagaaggatagtactagagtgagatacagtcatgattcatgaatcatacaagaaaatactggattaaaatgctatgcaatttaatcagacaaaaaaaaacgatgtactgccttcttgttggcttgcatgggtggaggcatggaaccgctcatctcaaggcatagcagccttcatgttcttggcatactcttctactcttttcaacccttcttcaggtgaagcagcctctcctaactgtctaacaatagcgctgccgatgatcacaccatctgctccccagcctgcaatctgtattgcaaatcacaaagttattaacaaagacaggccaaatacgtagtaacaagaacgttgcattgagtctaattcacctgctttacatgctctggagtcgatatgccaaagccaacagcaacaggtttgtctgtaacctgtaaagtcaggaatataagctatattaagataagcgctcttcaatcacgaatttccgacatagtacccttgcaatagtttactgttttactggtgagagaaaaactaaactctacaaaccttcttgatctcctgaagaaggtactcaacacgcaaatttacatttgagcgtgcacctgtaactccaacagaacttacctgcataatgtacagactagttatcgcacacataattgattgccaccgatcagattcaaaggcaaaggtagaatatgatggtatttaatagatgagagatgaccaaaatatggatcatgtgcttgcgatgccataatggttcagtatttgcaatttttagctgtttcaatttcccctcttttttctgttcatgtcagtctgggatgactgatcacatgttgtttcataagcatgcaaaagtgcactacagataatatttcataattgtccctttgtacctgttgaaaacaaatattcaaaatataaagtaggggataaaagaaaggatatcatctatatttagtgacaaacttaaagcaagtgcttggggtctactagatacccacaaagataaataaatccttctgaagcttttgcaatctccttcatcctctctgttggtgtggttggtgttgtaagcagcacctgcaggcaattgtgtaaaatactaaaataagaattgctagatgaatgaaactcaagataactcaatgcataaggtcaactcttgccacagatttaatcgacaaaaggcaatagaactacacaagcagtttttcacttgaacattacatgtcagggaaaaaggtgaggaccaaccagctctatgccatgcatgacagcctcattcctcaacagcgctgtctcttccaaaggaagatcaggtactacaagacctgctcataacaagagtggataaaaaacaatctaaatgcactatacagaactacagatatctcatatctcaatgtaaaatttagaaatatcacttcacaagtagtttgtcaagcagattctgaaaaggtggtatattactgaactaactgccatcttttcactaataataaaagactaacgcagagatagagtcatgcacttcaagagtcaatagaaaataagaagaaatatagcttttctaacaattgagcatatccttatatcttaggcatatacagcagagatatcaacaaagtgaaatccttgattggccacatcttgtgtgatggcattttaaaataaactatggatattcagttcaattcagacagattgactgcaaaagaaactatggtctgctttgatctggtgattaaatcagaaaatttactcgatgccaaattgaacctagaagtgactacagctaacttcaaatcggtcatctcttttcaaagtaaagttttctttcttctcgtgtcttcaaatgccttttccgaacattttttttcctgaaaatctgccactggtaaaaaaattatttgcctatttcctttttctgttctgtgttttgaactccttgattactcaaaactgcaagacattttaagatcattctattaactatgcaggaaaattaccatgtacgccggcttgtttaatgatagccatgaagttactcactccgcgctttaaaattgggttgtagtatgtgaagataactattggacaagacaactcaggtataacccccttgagcatagctatgaccgaatcaaatgtagcgcctttcttaagagcacgcgttgctgcagcctgaaatgaaccgcagccaaaaaaaaaaaacttatgttgcagcccatgagaaacattaaagctgataagttcaaagaagcacatacctgaataaccggcccatcagccaacggatccgagtaaggtacacccagctcaatcacatctgaaccacaggaatcaaggatcttcaacgctttcgatgtggttgccaagtcagggtcactggcggtgatgaatggaatgaatgcagtctgaaaaattccgaggtcagaacactatgctcaaactaaatccctccctgaaagaatatgtgctagtatattttttcttgtcctcaattctgtcacatatagcacacgcagagcaatagcaatatagcattgagcactggagcctgtatgtaaactcacagtctgtctaacgtgttcaaagcaacatcgaacagctgactatcctgatcttagttacactctagtgaaaattgcttcagcagcttacccattcatatactacatagttctccataggcaaattgtcaaattgtcaagtgttacactccaccatagtgctgttttctcaaattgtcaagtgttacagtccatagtgctgttttcttgatgagaaaacttgagaggttttcctgtattg

SEQ ID NO: 27947 - DNA, 1290 bp, Oryza sativa
gtctccgcgacgccgcgctttccggcgcccacgacgccgcgaccgctatcttccatctccatgagcggcaacctccctggctccctgtccctggccgacaggcccagccccgccccgccttcgccgcggaaacgaagcagagcagcccacgcggaggagagagacgccgccgcggcggcgacggcaacggcgacggcgacgaaatggaggcggcggagcgggtggcctcgcgatgagcacgtgcgcgtgacagcgtgtagacctcggctcggctcggcttcgctgcgctatatgggccggaaaggtgcagaagcccatgtgaggcccgttatatatgggccggaacaaactggattggagtaataagtctacttttgctccctcctgtgtaggtaaatcttattcaaatccttcaaccataatatcaaatattttgaccccccactattaaaaacagtgcaatttgatttcctcgatggttctttgagagtggcttttgctgacatggctcgttgacttggtccaaataacccagttagtgggttgggtccacatgtcagtgtctcctcttattccaagattggcagtaactcggcccatttatttatgggctggaaagggatcacggcgaacgtgcaggccattttaataggaaaaagtgcaccggaggtccctcaacttgtcagtgagataaaaaacgtcctcaaaccgtaaaaccaggtatgtgggggtcccttaactatgcaaaaccggtcacccgagatccttcggcggttttgatcccggttttggtctacgtggcagctgagtcagcatgggacccacgtgggccccacgtgtcagcctgtccaggtcagctactcttttctctcccttctctctctcacttctctcctctcgggcaagccggggcgggtaggtgttggtagaaacacacatgatcgatatctctctctcacttgacaaaaacttgaagatgaacagtaagctaaagagcaatgaacacagaaagttttgtggtgcttaaatcttgccgcaccgttttcacgttttcttcttccttttattgaagggaaaatgcacactacggcctaacaaattgaccggattactcgctctaccatccggattacgagcgctatcccactcgtcagatcgtgcagcgagagactcgcatactaccgcctcgacgtgaactcgcacgcctcaggtctacagacgcgctcaactctgactagagcgagcccagaaaaacagggaataaaaaacaaacacataacgtgcatgaaa

SEQ ID NO: 27948 - DNA, 4640 bp, Oryza sativa
  unsure (1)..(4640): unsure at all n locations
nnnnnnnnnnnnnnnnnnnnnnnnnnnnnnnnnnnnnnnnnnnnnnnnnnnnnnnnnnntgcatgaaaggaaactatcctaactgaataaaacagcttttgcaggcacaagtttaacgtaatatgcaacaaatctccccctaaaccttgtgctcgcgacttacttccaaaaccccgatccgcgagcgtagctcctcaaaccgcactcgaccaagggacttcgtcagtatatcagtgacttgatatgcagtcccagtgaattccaactgaactcgaccttcttccacacactcccggatataatgataccgagtagctatgtgttttctgcggtcgtgaaacaccggatttttgctcaatgcaatcgccgacttgttgtcaaccatcagcttgaaaacatctggttgagcttgattaatttctcccagcaactgtgccatctagacaccctgacatgctaccgtcgtcgccgcaatatactctgcctcgcaagacgaaagagcgacaaccttttgcttctgggattgccaactcaccggactggatccaaggaagaacatgacaccgctggttctttttcgtgtatccacatcaccggccatatctgcatcagaaaacccaactagagtagccggcgtctccgatctccggtagatgatcccgtaatcaattgtgccagcaatgtatcttagtatccgcttcaccgctgcctcatgctcggcagtgggcgcctccatgaagcgactgacataacccaccgcgaacgcgatgtccagtcttgtgtgaaccaagtaccgcaaacttccgacgatgctgcgatagccagtagaatccaccagtggtgcatcactatgtttgctgagcttgagccgctgctccattggcgtcacacaggcattgcagtcctgcatccctgccttctccaaaatacgacgcgcgaaggccgactgagtcagccgtgtgctgcccgccacctgtttgacctcaatccccaggtagaagcagaggagaccaagatcgctcatcctgaaaagagacatcatctccgccttgaatcgatcaatctccacagcatcacttcctgtaatgattagatcatccacataaacaccaacaagcaagtggtgtgttccctgaccttgagcatacacggcgtgctcaaagtcacagcgcctgaaaccaagtgacgttaggcttgtgtccagcttggcattccacactcggggggcttggcgaagtccatagagcgccttgtccagcttcagcacttgatgttcatgcccctcgaccacgaagccaggcggttgcacaacatacacctcctcagtgagctccccattgagaaaagcggacttcacatccatgtgatggacaaaccacccggcctgtgcagctaaagcgagcagcatgcggactgattccagccttgccatcggagcgaacacctcgttgaagtccaccccaggctgctgcacatatcctttcgccaccaaacgcgccttgaacttggtcacctcacctcgggcatcctttttcaccttgaagacccacttcagtccaatggcatggtgtccacgagggaggtcgaccagtcgccacgtcttgttttcttcaatggttgcgatctcctccaacatggtgctacgccagcgctggtgttgttcggcctcgttaaatgaagccggttcctcagcctcctgaagatacaactgttctggagcgagtgcacgctcggcgaggcccggcgccgccgcgtcgcccaagagatcccctagggggcgataccttggcgggcagtcatcgtgatcagcatcaaggtgctcgtctcccctcgacggaggcgaaatgaacactggacttgtcccatgcaaagacgctcgtggtcccaagcttggcgacggcgtgcgcggctcctcaggcgtggtcgatgcagcgcgtcgcgagcttggcgatgagttttcctcctgtgcgccgcgaccaccaccgctcacctgtgtcagcacatactcgatggaaaactccgtctgttcaaggccggactcggccgcttcagcgccccagtcccagctcgcgccttcgtcgaagatgacatcgcgtgacacctgcacgcgcccggtcacagggtcgaacaccttgtaccccttggtgcccgctgcataccctatgaacaccatgggcgtgctgcgatcttcaagcttggagaggtgtgggcgcatgttcttgacgtacgccaggcagccgaatgtgcgcagatgtcccaccgctggcttcttgccgaaccaggcttcgtagggagttcggttctccaagcttttcgtcggggcgcgatttaggagaaatacggccatggtgaccgcctccccccaaaaccgcgccggcatccccttcgccttgagaaggctgcaagcggtggcgaggatcgtctggttcctgcgctccaccaccccgttttgctggggcgagtacggggcggagaagtgcctgccaacaccatgatctgcacagtactttgcgaattcaacagatgtgaactcactaccattgtcgatcctgaatttacgcagcttccggtctgattctgcctcagctgatgcctggaaatgcatgatcgccttcaccgcgtcccccttcctcgcgagcaggaccagccacatgtagcggctgtggtcatccaccagcaggaggaagtaactcttgccgccgggcgtcgccggcgagattggaccgcagagatccccatggaccagatcaagtcgatcagtcgcacggtagaccgcgcgcgttgggaacggcgaacgccggtgcttggagatgatgcagccgtcgcacagttgctcaacgtgctcgatgcggggcagcccgcgcaccatgtccttgtcagcgagcttgcgcagagcatcaaaatgaaggtggccgaaacgagcgtgccacaaccaggccgtgtctgaggtgcacgcggacaaacagaccggatgacccgtcatcagtttaagcaaatacagacgattggcattgcagcgtaccttggcgagcagcttcttcgctgggtcgcgaattgtgcacacaccatggtaaatgcgcacatcacaaccatgctcatcgagttggcccagcgagatcaggttggcgttcaacttggggatgaagtagacttcggtgagggcacggtgctctccattgttgcacataatcagaattttacctcacccttcgatgccgacaacggagccgtcgccgaaacggacggaaccacgcaccgccaggtcgagctccacgaacgcggagcgcactcccgtcatgtgattcgtcgcatcggtgtcgagatgccacacgcacgcatccatgttttcctcctgatggaggtatgcaaacaccttcagctcgtcgagcatgatggtctgtagcggcggcgccggcgcgagagggcgtggcatgggtgaggcccctgaaattgcacaaacatgggccatcagtagcgctggctccacatcgtcctccttggcgtgagcttggtgggcctccgtgttcttcctgggctgacggcagtctttcgcccagtggcctgcacaaccacagttgcgacagcgattgcggcccccgtcttgcgtatcgcaggcattttggtttccgcgatcaccgtcacggccaccggtgtcagagcgcttgcgaccccctcagcgccggcggttgccgttgcctttcttgccggaggatgcctccccagcctgcttctctttcagcctagccgcccattggtcctccgtgagcatgagcttgccagtttctgtggtgagccgcttcgccgtgagcttatcctcggcgttgcgccgacgaccggtgacctcctccagagagagctcctcaacatcgagcagcgtctcgatcgagagggcgatttgctgcagatgctcaggaaccgcattaaggaatttctgaactaccttgctttcctcgatcggagcgcccagagtgaccagcgtggtgaccaggttgttgaggcgtagcgagaagtcctcgacggactccccctccttgaactcgatggcgtcgtactgccgtagaaacagttgcgccttggacttgcgcactcgatcaacgccgactcgcataaccctgatggagtcccacgcctcctttgccgtctccttcacagcgagcgtcaacagcatctcctgcggcactgcacggaggatggcctccagcgccattctgtcttcctgaaagtctgcgtcgccgtgctagacggcttcccacagaccacgggcttggagcataactttcatcatcagggaccagtcaccatagtttgtcttcgtgagggtaggatagtttgctgagccgcccacctccttgacgacgcgccggaccggaacgatgtccctgtcttcgccggcacggcggcgaccacggcgcggaggcggtgagcgggattgacgacgcatgcgcggcactggcgaacgcgagacgcgcggcgtcggagccgacatggctctgataccacttgttggtagaaacacacaggatcgatatatctctctcacttgataaaaacttgaagatgaatagtaagctaaagagcaatgaacacagaaagttttgtggtgcttaaatcttgccgcaccgttttcacgttttcttctt

SEQ ID NO: 27949 - DNA, 7496 bp, Oryza sativa
  unsure (1)..(7496): unsure at all n locations
cgcccgggtttgcccgagaggagagaagtgagagagagaagggagagaagagaggaaagagagtggctgaccaggttgacacgtggggcccacgtgggtcccacgctgactcagctaccacatagaccaaaaccgggatcaaaaccgccgaaggacctcgggtgaccggttttgtatagttaagggaccccgcatatctggttttgcggtttgaggatgcttttttaatctcgctgacaagttgagggacctccagtgcactttttccgttttaatatgggtcagaatggtatcccaacgaacatgtggcctgttctatacgggctggtccaattttgaggccgggaaagccgtgcggcccggcccgttcgatctatctctttccctcatgtttccttccttgagtttgttctagtctactggtgtcaccaactcaccattgattggtttatctttgaaaaaagaaattgtgcatgcttagatatattcaaggctgactattctcctgtaccatgtcaattatgaaaaaaaatattgatataaaaaaattattgaaagtgtccttctgaattttctcttccatgcattcagcaggccatggagaccctataagacagtgctccatggatgtccacatattgggattattcatttatttgaaattttggatatgccgtcaaacatattttgatgtgccttttcagaaatgtttcaaacgagcataagaaagacttgtcgagttgtcgcatgaatacagcgtgttagcaccaaagtcactgtccatcagaaaaagcaactgcgagacctcatgaattgaccatctatgagcagggaaacacacttgcattatcggaacaagcagaagacgcaaatatttggaatcacatttggattcctcggcgaggtctactgcaagtaagcaagttttatttaaaaataatactccctccgtttcgaaatgtttactttttatcacatatttgaccattcgtcttatttaaaaaatttaagtaattattaattcttttcctatcatttgattcattgttaaatatatttttatgtaggcatataattttatatatctcatataagtttttgaataagacgaacggtcaaacatgtactaaaaagtcaacggtgtcaaacatttcgaaatggaggaaataataaaattgattctgacctatactttgaagaaattatagcagttttacaggatgaataagaaaactactaaaaataccaccttgaagacaaagatcttcatctatggttggtcagaggatgcacgaccgttgtttctatcaacggcttacaagttatacacagttcttgtcctccaaacaaaaaagcagaatctccaaaaccagccgtcgatcgaatttctctcccatcgtcgctgacaaactggtgtcgaaccaaagtgaaacgtcggagattagttgagttgtgtaaatcagtctaacttgcaagtaatcaagttaattgatagtaattggctaatttttatgtgtcaaaatcttcaacatggtatggccaagtactagcttataacatgctgcaatttggatggcaggtaagaaggaaggcgttacatgatggtgagtatcagagctctctgaagagtgaagactattggtttcattaataaacttaattatatcggagttagaagctacagaaatcatagaggcgaaagtcaggttgcaaagcgaaaagattaagaccactgtcccaaaatggttaccaccagaagaaggtaataagtgaaaattaatgttgatgttgctatttcacgttctacaaaaggagcagttggagttgtttgtagagatgaaaatggtcttcctacttgagtactttggattaataatagtaatccctacttcctttctctaaaaaaaaatatatatttccctcatgttgccttcgttgagttcgttagtctagtggcccttcatgtcaccattggtttatcttgagaaaaaaaaagttcatgtatatatattctgagtcctctcttccatccaacaggaaaacaaaaaggagaggctcaaactataggacaatgccccatggatgtatacacattgggattatttgcaacgtgccattgtgaaacatattcactcgatgaaagaaagactcatcgagttgttgaatgtgtgtgcaacgttggcactagagtcactgtccgttagaaaaagcaaggaactcagaaacctcatactatttactccatccgccccaaaaaaaaaatccattcctagcatcttaaagtgaaataagtggagagtgagaatgactaaaatacccttaatcattaaaaaaaccgtaagagtgataggtaggtaaagatattgaagagataaaacttcttgttttagtgctaagggtatatgtaggatagtagaagttggttttttgttggataaaatttaaactctggaagttaagttttttttaggacggagaaaataagtatcattttattttattttatgaaaccgatccagtcagatacctcgtgatttgactatctatcagcacactcttcaattatctgagcaagcagagggctgtataaattttgcaacccccatggaaaataatattgcagatatttttaatacaaatgtatttacaataattactaccttcatttcagaacaagttaatctagtactggatttgacatatctcgatactataaatttagtattagctataaatttagtattaggatatgtcacatttctattagattaatttattctaggacgaaagactatggtacatttaataaaggccagcttctgccgtaatggagcggaggcccgtcgccgggaggcttgggccggagcgtagcggatcgtcatcccttttagagttccatcatatatatacctcttgtaagccgccgtgcggcgatgtaacctcaccccagatatagtgaagatattttgctggctggcatccgtggttttttctcttttgttttgggagggttttccacgttaaaatctcgtgtcttctgtgattgatctattattttttatcgtttatttgtccatcgtttcctaacaacattgatttactgcaacatggtacaatgattttgtagctctatcagattttgatatttttatggcagtgcatccttcattctcctagcatactcctccagccttttgagcccttgtttgggagaagctgcttcacctagctgcctcaccattgcactcccaatgatcactccatctgcaccccaccctgctatctgcatccatttacatttgatcataaatgagtcagattttgcagcaaaaatgttggaaaaagaaaaaactaaattgcaaccaaatcaaacattctgaaggaatttgagatattaataagctatttacctgcctaacatggtcaggggttgatatgccaaagccaacacacacagctttgtcagtgaccagcttgatgtcctgaaggagatgctcaacgcgtgtgtttacttttggacggggacccgtaactccattgacactaacctgcatatatattacaatttacaacatgtcatttgatctggatcagaaagctaaactttctaatgagcagtcaggtttctgcatatatactacttaattagcacttacaaggtaaacaaatcctcctgaagcttctgtgatgatcttcatcctctctcccggtgtagctggtgttgttagcagcacctgcagagattaacccgcacaaaatcatcagaattctgaacatgttgatcactggagtagtatactctagctaggttgcttaattaatcgatgaaaggaactaattatgttcataccagctctaggttgctcttaatggcttcactcctgaaagtacatgtgtccacataaggaagatcaggaactataaggcctgaaacacacgtgacaactgtgaattagcatttccactgtcaaagagataagttttgctgtgttcggtttatcatttattattagttactctccgactatatcaattatattggcacagactggtgttggttcgtaaacaaatattatttattacataagcacaataattcttgtaataagggaacaatattccaatgagcacttcattagacatcttaattaggattgtaacatcacaaccacccttacttcattagtatatatagtttaagagacctgttggctccatctaaattgtactgatgaagatttgatgagtttattattactaaaagacaatctaggacagggattggagcccaggagtgtcgcatatattcagcgaaacttccaaaccaagtcttgtcatgaacgtttccctgaatttgggtgtgtacgccaatctacagtatctatgatgtttacacttcactgttaattttttttagataatggacttcactgttaattaatctgcccatcatgttattcaacactgacactgacaggctaatattgttgtttttttttctaaatcaggtagtaaaaggcaaagccgggtatgttcagttttattgggtaatttctttcggtgtatgttcctcttttactacatggtactgagtattatcttcttcttgaaatactcctaaattacagtcctcctgctcttgacaaatgaagtataggtataagatttaagaaaaaagtggagatcatagtagtacaaattaagatgcaaatcatgcatgcacgtaaatgagtaaaagttaattaagggatcagtaaaagtgaaagattaggagagtaataataagttggttaaatgtaaatttaccttgcacaccagcttctttggctgcggcggtgaagttggcggcacctcgccggaggatggggccgaggtaggagaggagcaccaccgggcaggacagctccggcgtcacctccttgagcatcgacaagacggcctccggcgtggcgccggcggcgagcgcccgcgacgcggaggcctggatgacggggccgtcggcataggggtcggagaagggcacgccgagctcgatgacgtcggcgccgcaggcgtcgagcagccgcagcgcctccgctgtcgtccccatgtccgggtcgccggcggtgatgtacgggatgaacgccgtctgctcaatgacgaaatccaacacaattcagcaccgacatgaactcgttctacgtcaatgcacgctatatgtttgttaccttgcccttctccttgagcttggacatggtctgcgacaccgacatgcgccgctcaacggcggcggcggcggcggcgggcacgggcgaagcctccagagcgaccgaggctgccgcggcggcgagcctccgggcggcggcaaccctcgccggctgcgcgacgcaccggcgcaacaccggagccgaggaggaggaagccgacatcggcgacgccttcatcgtcgtgaaagccattgctacgtacgctcgtgcgacgctgtgtacgtgcagctcgagttgtagcctaggtgttcgacgcgaagaccgcgaggctgatgagatgatcgagttaattagccgtggtgtactggtgtggttgggttggggtagtgaggactgaggaggccatggcgggcgtttatatagatcgcggcgcgcgttaattacgagctgagacgacgaacgatgctggttaattagctctcatgagataatccactaccgtggagtggagcgtgtcacgtgtgcgcgcgtggttaggagatcgacgcgcacgcagcgcgcgtcgcgtcgttttcgcgtgcgtgcgtgcgtcgaggccctggcgcacgtggctgacgtacgccactttcgatcgatcggtgtgtttgtttgtttcaacttccaagctagttcgatctatgtattctctatatcttaatttgatcagctacacgcatgaactcaccaactgataactcaccatggttccatagacaccatactgtgtggtgtggagcgaagaatatatatctcctacgaacttcgaagcactgctagctgctcactggtggtcatccgcaccgtttacctttgttcaccaattgctaaacatgtaggagtacatcctctgaaatattgtgtgtgtgtgtatattagatgtttttcgtgaatacgcaaaaaaattacaggtcaatatattagaagacaatagtgtttatttacacaacgcaatcagccagaccggcttatgccaaaggaggagagaaaagacaaaaacggaaaaaaaaaaggaaaaatgaagagactactacgacggctaaacacaactccaattagcgggaaggagagcagagctacactaccttcccaaggaaatcccaaaagaagcaacgccagctaacgaccatagatgatcctcagtgaggatgtactctaaaactattgagaccgaagtgagagcagagtcgaaaacgctgaagttccgttccttccgctcgcaagtatattaggtgttaccaatatatggattctacagtacagatcgaatcacattctaattaacctttgttgtagctaattactcgcataaaagaacatggacatcatgcattggcatgcatgtaccctgcagacagaatcgagtacatgccaccacgtgcgtatcgtgcatgttcaatgtttttttttctttttttcttaaaaagaacatttgtgtgcactttgtactatatttcgtgttattgctatgggatactttcttccgattctaaatgtataaatgtaaagtcgttttacggttttctactctctctctctctctctacaagttagtcaatatacgagatttctttacaaattgctaccactctcatgtataatatgcttataatgtgtaataattccatgaactaagttattacttcagatttccccaaattttttttaaaaaaaactgtcaccacaaaaaatggggctgattttactcggattttaggcgcacgatttaaaaatatatctacatttagaacaagaggtggcgcatgatattgttgtcaaaatcttgggattcccgtttaaatatgaaccagagagcattgaggtgacattagttggacgagatgcgtactttcgttttctctctcctttatttttggaattttggcctttttggtaatcactgcaaacgacgcagggaagaagacgaagtcggtaacgactattgactcgttaagcaccaatataattaaccagagctttctcccgatcgatcgaccgagagggttcaattcgataattatattagtacaaatctagctactagaacatatgagtactggctaatataaacgtgtttcttgctcaatatataaataagatatatcttagccgttgacaacggtggaaaggtcggcaagtgactaattatttctcaaattgacaaaatatataagccagctcaggaaccaactaaaaatagtatatgtagcaaagactacaaaattgtctttctgcannnnnnnnnnnnnnnnnnnnnnnnnnnnnnnnnnnnnn

SEQ ID NO: 27950 - DNA, 16054 bp, Oryza sativa
  unsure (1)..(16054): unsure at all n locations
nnnnnnnnnnnnnnnnnnnnnnnnnnnnnnnnnnnnnnnaattttggcctttttggtaatcactgcaaacgacgcagggaagaagacgaagtcggtaacgactattgactcgttaagcaccaatataattaaccagagctttctcccgatcgatcgaccgagagggttcaattcgataattatattagtacaaatctagctactagaacatatgagtactggctaatataaacgtgtttcttgctcaatatataaataagatatatcttagccgttgacaacggtggaaaggtcggcaagtgactaattatttctcaaattgacaaaatatataagccagctcaggaaccaactaaaaatagtatatgtagcaaagactacaaaattgtctttctgcagagtgtaaaactaaaacattttcatacttgcaagagcccgtattgagtatataattttccgtttcatattataaaacgttacttcctctatcccataatataagacgtggttaaagttggcacggtctccaaatctattctttatattttaatttctcatatattataatatttgtaacaacgaaattagaaccatatgaaagtaaatttaaatgtcaatccaatgaaatattttttaacaaataaaatttattttatattaaactaagtgttggtcaaatgttttaaatgtttaatcttaaaatatgtgcacgccttatattatgggatggagggagtatgatcttttctctagtcaaactttcttaagtttgaccaaatttatagtttttttaataatatttataacataaaattagtttcattaaatataacatttaatatattttggtacatgtttgttttgtagtgaaaatatgttaccatacttgtcttaaaatcgattaaaaaattaactagtaaaaagatcaaaacattcttacaatatgaaacataaggtattatgacaaaaaaattacttttaaacctaagaaatttttttaacctgcgcacagatgtactccctccgttacattaaaaaccaatctcttatccagatttgatgtgtcagatctgatactatcttagtttttaacccttttctttaatgggatgtagggagtactcctcctttctcaaaggtgaaatcatccgagagggtcgtgggccgcaattcctctagagtatagccagcccagaagatcgatgacgtcgacaggctcacgaccaataccaagttaccaaccgggcgtgagagcagctaatattttcatgtcatcgctgtgatcagcatacgtacataaatcccaccaaaagaaagagagaaaaaaaagcatacgtacataaattgacgcagcggccgccgatccaacagcgaaattaacacggagagaataaagaaaaccaagtttaaatattctcctgtcaaaatccaacagatttagtattatttccttaattagacgacgcaaagtgtcattctgttcaaggtgacaatagataaggtcagtacatttctggtagatcttcttttcattggtttgcttaattaattattcgacgcctttgcgtgtgttggatttgttttctcttccattccttggacgttgcgatttgtgatgctgatcttttatcttaaacaaacacagcgtgatggtaattaattgtactataaggaatgttcattatcaacgagattgcggttaatcacgcgaccgcgacgcttttaaccgttactgcactgtagaccttccggctatcttggtttaagttgtgggtagtcggcgcattttattttcggcgataaataaaacttaaatcatttttttactagtcatatgactagtcctgtgcttgtaacgaaacgggatccgtggaacatgtttcaaactttttattccctcttccatatatttttctctcggttttctcgaacggtttttctcttgattctttgagaacttttttaggattacacggcaaacatatacgagcacacacaactagatacccaacaccatccatactcacacatccacaaacgcgtcccctaacacatgatttaaaaaatggaaaccaggacttaaattcctcttgaaagcctaactatatgggtgtaatatttatagaaatcaggacttaaatcctgattgattttatctctagccttttagcttttttttacacggaattggagtgggaagaggaggaggataactgtgcttttaagataaatagaaatttatgagagtgggttctctctttcttttagcgctttttttatgcggaattggactgagaagaggactactatgcttttaagatagtagatatatataggatattacttagagcatttacaatgtcatgttatgacgagtgacctcgtgtctccacgtcgagaagagccagctcaactcggggtatatgtgctttacatgtgttgtcttgtgtatatggtttttgttgttaaggagtttgtttcgcgcctttgttgattgttagcacaaatatgcacacaatttgcagcaattattttcttcgaacaaccgaagaattaacatccgacctctacacagacgaggtgttttacagtccccaaggatctggatgcctatacatcacttattatctataacactttctagtgctaatttgcggtacagttaactatgagactatgagaaaggcagcttcagcttcccttttatgcatgtagctagtcatcaccaagagattaattaattaatctctcatgccattatttagcaacttgtttttatagcttctatggaagtgcattcttcaggctcctagcatacttctccagccttttcagcccttgcttgggagaagctgcttcacccagctgcctcaccattgcactgccaatgatcaccccatctgcaccccactctgctatctgtgtccatttttcaattgacaataatgttttagaatttgcaatatttgattaggaaatctaccaaatacatttgtgataaaatggtaattcaatcacctgtctaacatgatcaggggttgatatgccatagccaacacacacagctttgtcagtgacctgcttaatctcctgaaggagatgctcaacacgcgggttcacgtcttggcgagatcctgtaactccattgacactaacctgcatgacacgttttacagcaagcaattgtgtcagaagctaaacttctattaagtaattaatcaggatttctgaagatttactagtgtgctttaccaggtaaacaaatcctcctgaggcggctgtgattgccttcatcctgtctggtggtgtagttggtgtagtaagcagcacctgcagccattttaatccacaaaacataatccagaatttgttgttaattgaccatacaaatttactaatggttatatgttgatgaaatcaacatagatactatacgtaccagctctaggttgttcttgataacttcactcctgaaagagcatgcctctaggtaaggaagatcaggtactattagacctggaacacgtgtgcaaattattagtaacaaaaaaaaaagaatgcgtttagaattccgattagcacgcattaattttgcctgaatactaaggctgtgttctttcaaaggagactggggagagattggtgagattgtcactcgtttttcacatgcacgctttccaaactattaaacggtgtattttttgtaaaaaatttctatgtgaaagttgctttaaaaaatcatattagtccatttttgaaatttaaaatagttaatactcaattaatcatgcgctaatggctcacctcgttttgcgtatattcccaattttcttaatcccctctccctcaaacacagcctaaaactctaaaagcataaacgtgcataagagcaggtacaatagcaggctataaggcagctgcaaacatattttaaggagataaataagaagagagaagggcagcgggctacaaatttgtagctagctgcagcacggactccaaaacgcagtgtgtgtatgataggtgggactaggtattaatagtgtagtatgtaactactgtatgaatgagctattagattgaccatatatgaattagaactagtagttggctatactattaaacttgctctaattacgtaatggtacttgtaacttgtccacataaatgatttcgaatgatcactcatcggagagcacatcacaacctcagacacagattttttttggcttagcttggcctgaagaatctatggctagctttatgtatataggacagtgattggtgttttgcatcgatccagaaacggccaaacatgtgctgtacctcagctatgcacgtgaaaaacaaatgaaaacgactcaagaccatctgatttgattgaagattaatcctattcaagataaggtgaacgacaacattggttcagaaaacacaaaatgactgtgcaggcaaatcagaaatgtaccgtatacactatatatacagttcagatccctgtacagttactgtacttaactgtttattagtattagatattttacatcactgatatatacttcctccgtaaaaaaaaactaatctagacacatcttagtactaagatgttccattatgggtcacattctagtattaagtttttttaaaaaaaagacgagggtgtatgaaagattaatgtccaagtgcaaaacagagagtaattaattaattaattaccttgtacgccggcttctttggctgcggcggtgaagttggccggacctcgccggacgatggggccgagataggagaagagcaccaccgggcatgacagctccggcgtcacctccgcgagcatcgacatgatcccgtccatcgtggcgccggcggagagcgcccgcgcggcggaggcctggatgacggggccgtcgttgtaggggtcggagaagggcacgccgagctcgatgacgtcggcgccgcacgcgtcgagcagccgcagcgcctccgccgtcgtccccatgtccgggtcgccggcggtgatgtacgggatgaacgccgtcttccccttctccatcagcctcgacatggtccgcgacaccgacgacagcccgcgctccgtcgccggcgccgcgggcgcccgatcgagcctaagcgacgtcgccgccgcggtgagcttcctgaccgcgaccctccccggcgccgctccgagcttagctggcgccgaggaagaagaagaagaagcagccggcgacgacggcgacgacgccttgaccgtgaaagccatgagagtgtagtggcggcaacgcgcgtgcgtgtgagagtggcttggaacggtgtgacccggcgtggcgtggcgtggcgcgcgcgatgtacgtgcgtgcgtgcgtgtgcgcgcgtgtgcttggatggatgggatgtctcggctctcggtgccgcggagtttatatagatcgcggcgggcgatggcgataattagctcgggtttggaaattgcaagtgtctctccgctcggtgtagcccgcgcgcgccgtgagaaacgtgttaaccagagtgctctatggtgtgggtgtacatttttcagtggccacactgatgctcaacagagaccagccactccagtgtactattcccctctcccacgtgtcacacaaaccaggaacatcccaattttgggctagcctaatgaaagtaaaagatcaattttttcagtatggatcttttaaacctggtaatggaatagaaataagattttgggaagacacatggttgggcttgcaaccactcaaatatcaatatccttctctgtacaatgtgattcgaaagagacattctactttggcagaggttatgagcacaacaccattaaatgtttcattccgacgatcaattgtaggaccaaagttagttgagtggaatgatttgatttctcgactagctaacataaccctgtcaaatgaaaaggattgctttatttggtcgctacataaaaatggccatttttgggtcaaatccatgtataatgtgatcatcaattccaatgtaagaatctgttgacgaaaaaatcgaacataccggcctggaagatctgcttagctccagtgcaggtccaaaggttgatgagatacgggcgtgccagtcagtttgatcctgcaactgataagatatgcaaatagtagatcaaaacagccaatcggctgttaagccgatggagtagttccagctgatagccgataatagccgatgccgataccagccgatagcgatagggtttaagcaatcagctatatgtccaatgtaaataatgatatgaaggcaatcggctgatgatgatgtaataaaataacaatataatccagtagaaaccaatcagctagaaacaaaatataataagcactgatccgaatgttaaagcatacatcagctggaggtccgatgtcatgaaatccacaagattagattaaacagtgaaacctttgtcgtcatcggctaaatccaacttatatgtatatgcaatccttatgagccgatgcaacgtccagataactcaccggctgaaaccccgatgaaaaccttattggcagtcaaaaagcaagctagagattatggttctaagcacgacttagtagatcaaacttaactgatgcagcactaagtatgaaaagaaacataatatctagacaatcaagccgttgactgagttttcagggtggtagatatctaagctaatctaatctagcaacgcgatttagccgataccggcagaaatcctaaaacgagaagcagccgatagagctaaattgatatgctaaaactagattaatatagacatatgataaataggtaggcaaatatatcatccaaaccagagcaatctaagaggtcgaatgtactgatgcagccttgaacgatgccgatgtagatgagacaattgcctgggccgacggaacattggacttatcccttcgccggatatcgaagacgatgcagccccgcgtcgggtgccaagttccgccggaacgtaaaaaaacaaaagtagaagtaaaaagggtggcgatgcgccgaattgtattgatcgtagagattgattacaatgacctcgagtgtacatatttatacccatagggagacactagtccttgtcggataagaaagaacctaaaaaggaaaagataaagtccttatcggacactaaacacactttcctaaggataaaaggaaaatgacaaactatgcctaattaatagataactgtcatgtcgcattcttcttgaactcgaactcttatagataagcttcctttgattgatccgactccaccaagaacacgacatcatggcgacttgactcccatcggctgattctagaactttgaagccgatactgactctaaaccgatggtaactttgggcttaccaaatttcactgttaacagaatccacaagaggatcttatgggaggtaaacgtaccactaaaaatcaaagtatttatgtggtttcttcacaaaaaattaatcttgacgaaagataacctcataaagagaaaatggaggggaaacaagcaatgttgttttttaatacacaagagaccatccaacatcttttctttgactgtcatgttgcacgttttgcttggcgatgtgtattctttgccttcaatattccccctctccacaatgcaaaagatatttttggtaactagctaaggggagtgcctagacaaaaaaaaagattttatttggagctagtgctctatgttggtcaatttggcgttgccataatgatatggtttttaaccataaaaaaatgcctaacatcatgcagattatcttcatgtgttccaattggctccactcttgatgtatgatgctttcacaggaacaacaagatactatgcgcagtggtgctacacgcttggaattggtagccaaggaacttttactccagtttggatggcgtagtacctacagaattttgtgatagactctacgtgattttaaaaaacatgattttagtagatcatattatcggtagaagttgggggtttgtcccatctcgccttttttaacctcttttatattcacttctggactttttggctgtgtgcctgtgggcagaggttagagatgtaacccatttccattatctaaaaaaaacttcagtatactacttgtaccaggaactgttcacatatccgggaaagtattttaaactcttgagggaatattcctttatcctttacatgttatccaaatgattatgaaatttttttaaaaaaattaacaagatggattaatatgtgataaatcactctacaaattacaacgagaaaaacaaatttgaccgtgaatacacgttaactagtcatagttccatttgttttttgttgtaacttgtagaagttaaattttaacttgcttgtttgtaaagtgatttatcacatattaatctatcttgttgaattatttttcataatcatttaaatgatatacaaataacaagggaacgtgctcatgagagtctgaatccactcccttgttaatttcttctaacttatttgtctcgctgacatatgatccgttctcgaacgaatccacatatcaagtgtctcgaagccaaagaaaaataagttagatggtcatattccgaacgtaccggcgacgctcccaccatactgcattactgcggtgtttcatgttgctacatcgatgtatttctggatgaatggaccaccggctgcatgaacatgacacatgtacagatgtactagtactagtactaggtactacgttatacgtactactttctctgtatcatactccctcaatcccctagtaaataaatttagcactgaatgtgatccattttagtgcaataaatttagatagagatatgtccaaatttataatagtatgatgtatcacattcagtactatgttatttttttatgagacggatggagcaataaattttatttctaacttctatcatttattctaggtaagtttattgtaaataatcattggaccggagtttgtaaaagcaatgaataactatactggaagtagataaattatgaaatagttgtattccgatttgataaaatatatgtattctagtttgttagttttgtattgatatgtgtgataaattatttgtttttgaacggatggagcagtaattcgtagcaggattaactactaatccgaacaaaagatgtgtttgggagctccgctgtttatccaacacgctgacgtaaacagtagtactagtacagcacatcagctaaaagctagtgatgggctatttgacttagtactctctccgtcccctaatataaaagatttaaacttttttatcactgtttgccgtcttattaaaaaatagaattattatttaatttttatttattttattatctaaaatattttaaacactttcgtatttttatttgtatgaactttttaaataaggtgagtgattaaacagtacaaataaaatatcaaaatacttatattatgtgacgaagggagtatcttgagatggttatcctcaccgtgggtctaatcgagaagcatggtcactcacatgcagcggtgacggaaggggggaacaagacggatcaggaggaagaggctgcgcagccggccgcggcagcagacgacgccgtgcagtctcggttccctccatcgtcggcgcggtcatatctagaaggattcgttcatctctcgtaacgattcttttggcagcttatacggctgcacacaattgatgtggtgatagaattgtgcctaggaagtacgctctattcgctagggtttattcgctaaatttaaattctggttttcatgaaaaatacgtacaaaattataatgttatcaattatattagagatgtgtcactcgtttttaccttttcagagtatgttttagggaatatattcatgagtatgtgtatatacgatgttgtatatgtagtaacgtgtgcagacaatgcagttaaacaaaatttcggcagattgaagagactttgaacggctagtctgccgcagccgctgcggctacggcaaaagtggccgccgaacaaggccaatcgttggaaaaagatgagaaccaaacaagaatattcagataatatattcactttatatggcgtcacaggctcgcactctcacacacagctcactgccgtttgtcgatgttactcatgaggctgcgttcttcgtacgttttggtgtggatgtttagcggcggtgcgaaaggaaacagccattagcgcattattattatgttagttgagtattaattattaaaaaaaccaaaaattatacatttgaacttttaaaactttctatataaaaataattataaaatatcatttaacggtttgacaaacattctcacaatctcacggtaaataagagattagccctctgtagtggtagcagaaacgaacgcaacctttatgacttttttggaacgtaatattatcaaaacacatgaatagaaaaatcacgtaattcgaatatcatcacaccttaaattccaaggaataaaaaacatagaacaattacaaaggagaaagagatgaacacaaagcaaaaattccaagagcttggagctcatgctagtaatcctcccaaattcccatgaaacatgccattttataggaatatcaaacaaattttagagatccaaacctttattctaaagagcctcgtacgaatttttcatatagttcaaatcctttaaattttttaatttttttctttgtttcaaagaagccccgactcgtatcatgactctttttcaaggaaacctgcaatgcaacaaatgttctgctcggtgcaaaaaaaaaaagaaaaaagaaacaaatgttctgctcctgcaatgcatatgcacaagcacaaaaccgctacttatatctgggtgctattgtactaggtgtatagaaaaaaactttatgctgtagcggtttgtggtgccaaatatctttagatgcgtcgaacagggatgcattgctattgccatgaaaactagtacagtacaacccaacaatctatggagtagcaatagcaaccatccctaaacagaacaatctagcaaccaggttggttctgctctctgcatacagccatacacttgacagggacaacgacgaagactagtaatagtgtattaatactacatactccctccgtattttaatgtataacgtcgttgacttttttaatcaacatttgaccatcgtcctattcaaattttttatgcaaatacaaaaatacttatgtcatgcttaaagaacatttgataataaatcaagtcacaataaaataaataataattacataaattttttgaataaaacaaaaggtcaaacgtttattaaaaagtcaacgacgtcataaattaaaatatggagggagtatataataattatatatcttcgagaagcatgcatgtagtatactgcttagatgctttttcgctgcttactgcttaagggtattttgatttttgtttgcatgatgacagagtgtacataaccaaaaactccaaattttatttgttggaaagggcaaataatactaatctttcaaaatttataaaattacagtaaatatagtgttattttacctagtttgaggaggtcagcctctgatcaccgttgttaaactcttgctaccaatcacggagcaggtggctcagtcagatttgttaaaatctcagggaggcgtggctcgccgccacatggagagagcgagagagggagaggagaggattgaggcaaaatggcaaattaaggagctgacagggctaggtttgggtggatggggaatatgtgtaaaaattacattcacattacataaatttagtatgtgggtgtaatttagtgaaaaaaaaatcttaagaagtaagtatgctagtgcaacaacttgatatgccggtgtaatttagtgcatgaacttaataagtgagcatacggaagaagtagcaacttacaaggtggttgcattttggtataataatttaagaagcgcagcaacatcttaattattttgagtatttttaacacacattcagcttttaaatacttgcacagatttatatgagaatacttaaattttgtaattctagtaattagaagtcaattaaattttacaatatagaaatgcttgtatttcggttgagatttgagaatgtgacacaaattgttggtgcaaattggatgagtagtgtaattcttatagattaaattcaatactaattataagttaatatttcgccggattgctatgtgttggaatattaactttgtgaaaaaaaaaactcatctaccatccgttaaccaaaacaacatgtacattcttttttttccgaggaaaacaacacatacttaggccccgtttggtagggctccaaactccaactccaacaggagcttagctctagtgggagctggagcgagctgaaaagtgtttggctagttttgtcagctccagaactcctaaaagagaggataggagagtggttgacaatagtacccttgtggtttttgctgtttttgtggtatataagtgataattgtttattttctttagaatttcaacaaaattgtaagttaaataataattgacaaaatagttgacataattagcaaataatacaaatgttcagtacattaataatagtagcattgtcatcgaaatataaatcaaaggtccagtacataactcgctcgatggcatagatctgatattaataatatgctctgtcacgatctcttaatatttcagcagcagaacattgagaggtcttttgttcacaacatacaagtagctgccagctgagtatctttaggcaacaaaaggttcttccagttagaggatgacataaattcttttatgttgtcccgtgcaattggcatgagtttgctgcatgaaaaacaagcaacactctgaatcagtggtgaatgaatccaatagaaaaaagaacctgcggtgtcaaactaaaatacaaatacatcttttggtctgggatgaaagcaggggagtagaatgactagccatcaagtggagctcaaatattctctaaacttttgaagacattctagtggcaaacaactcataacttgcgttttttctgacccaactgcatatgttttacttatgaacatataaacagtgcaaccaaattcatacttcaatcaattcatcctagagatctatctgacatttgacaaccttttattggtcaatctcatgctagagatctgtaatagaggttcattgcaagcataacatatggcatatcacagatccaaaactgaaaggcaacacatttgtcattttcaatcagaaactaaaactgaaatacattttgaaactgaaacgcaaatacattctgaatagaggttactagttttcagatgatacattcaaacactcacatcacacttgcgcttatatatatgcagcacgcatggttacatccatatatgcatcacaatgaactttagacaactgtatgcatccatatatacatccatagttatcgtaagattaagtacatccaaacatccatatatacatccatagttaattttcttgtttcattttctaccatacagatctggaaaccttgcacacagatttggaaacatgcacaccgatgtgaaaaccttgcaaatatgaacaatcaatccacagagtaatgaaccaaatcactagggtttggaaaataccttgtacacagatctggaaccttgccgtgctctgattccgccgtcgtcgccgtgctgcatcaccccgctgctgtgagctgtaatgacgccgaaagccgtagcaccaccccaaccgccgcgtcgagaggacgagggaggtctccgtcgccatgcgccgcgccgtgtgcctactccgccgccgtgcaccaccccaaccgccgcgctgtgcgcctacgccgcaccgtgcgccgccgccgctgccgtcgtgcgcttccgccgtttcctctcgcggtatcgcctcccttgtcgctctcgagagagaaggggctgcggctcgggggtggggggaatgggcggtgcggtttgggtgggtcaagggtagggcggtggcatttttcctgtaatttcgacgaaagatggtgggtagagctgtaattaattttggagtggatctgcggagcaacgtttttgccactccatctcggtagtataatttctaggagagattcatcccgctccgctctattttttggtgaatctagaccatttgtcacagctccagctctaggtaagttggagttggaagttggagctgtgccaaacgagtcttagctacactaaaatactaaattgttaagttcttgtttagaatgcacccactttttaagttattttatttggatgttcaatttaagttatagtactagatagattgtatccacctaacaaattattgtaccgtcaacataatttacttttatttcattcatacaatagaagaattaacatataacctctgcaatgacgaggtattttgcattccctaaggtggctacacattatgacttataacaggttatattgctactatctgtgtccatttactcagctactataagaaaggcagattcagcttccctatctgaatgtagtgatcaccgagagattaattaattaatctcacgtgtaattttttagcagctggtgcctggtttctataataacttctatggtagtgcatccttgaggctcctagcatacttctccagccttttgagcccttgtttgggagaagctgcttcacccaactgcctcaccattgcgctgccaatgatcactccatctgcaccccaatctgctatctgtgtccattttacaattacatttttttcagaatttgcaatcgttgagaaggaaacttagatggtacaaacatatatgcatgataaaatgataatttaatcacctgtctaacatgatcaggggttgatatgccaaagccaacacacacagctttgtcagtgacctgcttaatctcctgaaggagatgctcaacacgcggatttacgttttggatagatcctgtaaccccattgacactaacctgcatgacacgttttacagcaagcaatttgttattatttggtctttttcagaaagctacttaaacttataacaagtaaccagggtttctgaagatttgttatagtgtatttaccagataaacaaatcctcctgaagccgctgtgattgccttcatcctgtctgccggtgtagctggtgtagtaagcagcacctgcacccattaattcacgcatagattcaatttattggtaattaattaaatagattaattcactgatgatcatatagtaatgaaatctacatagatatataccagctctaggttgttcttgatggcttcactcctgaaagtggatgtctctacgtaaggaagatctggtactataagacctggaacacacatgtgtaacaactgcaaattagcaaactactacaacaagttacaactaaaaaaaaagaatgcctttagattcagatgaccatggacagaatgttaattgttaggtacagtatattactttctccatccttaaatatttgacgccgttgatttttttaagcatgtttaaccgttcgtcttatttaaaaaatttaagtaattattaattcattttccatcatttgattcattgttaaacatacttttatatatatatatatatatatatatgtagttttacatatttttgaatatgacgaatagtcaaatatgtttaaaaagttaacggcgtcaaatatttaggggcggatggataatatcatataccttgtacgccggcttctttggctgcggcggtgaagttggccggacctcgccggacgatggggccgaagtaagagaagagcaccaccgggcatgaaagctccggcgtcaccttcgcgagcatcgacatgaccccgtccatcgtggcgcccgcggcgagcgccagctcggcggacgcctggatgacggcgccgtcggtgtaggggtaagagaatggcacgccaagct

SEQ ID NO: 27951 - DNA, 7242 bp, Oryza sativa
  unsure (1)..(7242): unsure at all n locations
cgacatggtccgcgacaccgacgacgacatcccgcgctcggcgccggccggcgccggcgcccgatcgagcgtcagcgacgccgccaccgccgccgccgggagcttccgcgccgcgacccgcgccgcgccgccgtgcaacgcacccgtgaggcgcgtcgtagctggcgacgacggcgacgacgccttcaccgtgaaagccatgcacgtcgcggtgtgtggcggctacgtacgcgcggtggaacgtaaccgcggcgtggcgtgcgcgcgcgcggtgtgtacgacgtacgtacgcggtacgcctactggttcgatcgatcgggtcgcggtgggtgcggtggtgaactgatggcgttcgcctctcggcgtgtgcggagtttatataggagtagatcgcagcggcggcgaggggagcatggcgtgaggtggtacttggacctaggaacgaacgaagagacgagccgccagactgtccacgcaagcatgctaggctgcccatgcattttctctctcttttttcccttgacttttctattgcatgcatacaagatgaacccatgacccatttacttttaagtttgtggtttacaaatactacttcactttctacttgaatacaccgtactctctattttatccatttagggtttagaggcatatagtaagtttatagattttttacatttttttatttttaaaattccttcatacatttctttaaaaattcatgtcaaaagtttatatgtgtaaagtttacatatataaagttaccatgtataaagttactatgtactatctgcgtataactttccatgtcgaaagttgcaacatacaaagttagtatatataaaatttatatagataaaattactatgtataaattagtagtacatgtatcaagctataaattagcagtatacgtaaagtagagaactctcgatgagcaagagaaaatgcttgagctagtgggtctataaaggttttgcacgtgggctagagaagagggagtcaggggcatatggctgaaagatcagtggctcgttgcagttgctatgcgcgcacgagaatacaaaggaaagaaacagcgagcaaagccgatatgtacagctgaaataggtccggacccgttcgtgtagggcaaacgatcgtgtattagacccacccgatgccgcttgcttcgacgacctccgctcgggattcctcctatgaatacatgtgaaatggtgaattactactgtgcctctttaaaccttccaaaaaaattggagatacttacaccgtgtttagttgcaaattttttcttcaaacttccaacttttccatcacattaaaactttcttacacacacaaacttccaatttttctgtcacatcgttccaatttcaaccaaatttccaattttggtatgaactaaacacacccttagggcatgcacaaatgtagagtctaatatgagctctctatattaattaatgtcactagagactatcctcctataataatagagacaataagatttctaaaccattaatgcactaaatattttttttattatacttctttccttttttacaccctcatgcaacaaactttccgttaataaatgctaagagtcgactctgagccgttgcatgcgtagcaacgttgtttcttatttcttccatctctttcttccacatcatcaaatttacttgcatgacaacgaaaagagcccgttattagaaactattgcacatgcccttggtggacagatgtgatttgggacctccattctttaaagacgttaaaaactctttttatttaatttgtagattttatattttgcggtggagaaatagtaggaaacgtctgcttgataggtcgatgtcgtgggcacgcgggcacgggcgcgtcagctcggtttcggtttggagatgtgtcgggtcggaatagctagccccgccgtgcaaaacgtgcagtgttaagcagcaccactctctgttaatttgttcgtggccacacgctcgcgcgacgaccgttcgtcgcggatggcccagacacgatccaatactccatccctgacacttcagtacgagtacttgttcactgcactgaccagaccaaaccaaagcaacaatgaccaactgaccattccaatttcctctcgaccaccggcagaaacgaaatccaactgatgaacgtcaatgtgctcaaaaaagggggggaaaaaagctgatgaacgtgaacacaattagtacgattagtacctgctgatactggcgttgtgatagtgtctgcatgctctgctgactgctgatcaaacctgctgacgtgtaaatgctgacgtcacgaaaggagcagtacactagtgctccatcagcttagctagtgacgttctcctaaccgtccgtcgtcgatctctattcggtagatcggcgtatgactaaactaattggggaacaaacggagccatcgtttcggtgtatttgtgaacgaaaagtaatttatgaataaaaattttttatacgtgttcttagcaatatatttaaaagcaaaagctgacaaataaacttcaatgaaaaaaaccttaaaatcagctttaaatttaaggttaaaaatttaaattttggctgataagcataagtataaacgaaaagatgtggctctaaatttgtaaatcctaaaaaaagtgagaggacaaaaatataattgagattgaaaattgagacaaacaaattctccgattaataatactctaggttgtctctctacgtatatactccaattaatagtacatagcttgagagggacatcaaagactagtactaatacatgtttatgccttctagaagcttagcatgcatgtatttggccttttcggagtatatgaataatgtgctagaaaaaatgagtatatgaatttcacgaggaacaaatcataacaaaggaaaggcgtgtttcctgctgattgctaaattttgctagtactgatttgtttagacacttccaatttccaaaccatattggccttgcaaaaggctatattcgagaaatgttgcattccagcacccgtgcatataggaaaacacaaatcaatagcgcgtagaacatgctatagcatgtgaacatatatatgtcatttttttctcaaagagagagaacagatatatgacatttttgtgcactgtgcaaattaaacagggcccatattgttgcgagtgtacataatgcaacgtattttgcatttatgaatctgactgagcatatctgatactttgatttttttttttcaagttaaacttatttaaattatatatatatagggcactcatatggggcaccatggtataaaatacacaaattcgtctaaatttttcaaaaaatttaaattgttagtatatacctagttataagtattcgattcatacctatacctagaaacaaaacaacttaaattcaactttatttgacaatccagtattacatacctaactaattatatatttggatgctatatacctagaatcaaatcctaataaaaacatgtttaaattcaatttaaacttgttttgaactagttgtatagttaatattaatacctaaacatttgaaaaaatttcatactcatttgaattgagtatatactcaatttgaatcatggagcccaggcaccatggagcaccaaacaaatttatatatatatatatatatatatatatatatatatatataatttttttaatacaaatcaaatatattattaaaattatattttaatgttatatgttgctaaatttttctaataaagtttggctcaaaacgacatacttacaatatgaattactataacggaagaagtatcttggtagtgcacgtacgctccataatgctgggataaacttacattgatggatgggctaattaattcctaataattggtccgtttattcgcgtaaacaaacgtgtcctaattgcgaccatcatgatggtgatgtcatttccaaattaagctcttcagaattttgctggccgacaccacgtggaagacaaggcctaagaatagtcagagcggtggcgtttaatttccttttgttttaaatttctttcagaaattatatcacccacacatgcgcagtgcaacgagaatcacaaacggcgtgcacatatatggggaaaaagaatccgtgagcaccgtagcaactactccagcaactgtgttttcaattctgcaaatgctattctctgttaaaaacaagttctatatgacaatatcactccgataaattgtctaatctaaaaaatatttctgtagactttttttaaaaaaaatcatacttttaaaagcgtggtaagaataatctaagctatagactcatacttttgaaagcgtggcacaagaataatccagacatacagaacgtaactcaacttgttaattaggtttttctacggtggaaccaacacactcatgttaaatcatggacttcttgatatgatactcatattacaactaatttttttttagtggtgtgaagacttgacctgcgtcttttttaaaaaataaaatccaaatatacacggtgttactggatctcccggccctacagaattgggcgagatggtgactgatctcatgggccatgacgtatacaaacctatatgggccttcgctctatttactggcccggtttagacattggcttcctccttacctcgggaggcctcatttatatggaccttgatttcagttcagattccaagcttacccacccacctaaaaggccccaatttaggcccatcacatcgaggccgaaacgcgaagtgacagtgacaagggaaggacggcccacgtacagcccatcaaggcccatatccacttcgcctcttccctttgatgttgcgagtgaataaagtcgaagcgactcctcctccgatccccacctcgcttcacactagccgaggagacgcgagcgcgagctgctctcctctcctcccgccccgcgtcgccgacgtcgaggcggcggtcgacgtcgacgtcgccggggatggccgggcagcagccgcagcagcagggcccaccggaggacgactttttcgaccagttcttctccctgaccagctccttccctggcgccgcgccgggcggccgcgccgccggtgaccagcccttctccctcgcgctcagcctcgacgccgccgcggcggccgaggcgtccgggagcgggaagaggctcggggtcggcgatgacgccgagggtggcggcagcaaggcggtgagtgcgcgcgcgcgcgcaatcctctctccctctcgctaactttccccatttttgcttttgcgttggctctcctcgttcgagtgggaacggaggcgcgtgtgcttgcgtgataagcttcgagctcgcctctgtaggatcgggagaccgtgcagctcaccggactcttcccgccggtgttcggcggcggcggcgtgcagccgccgaacctccgccccaccccgcctacccaggtgctctgttgcagcagcggattgtgtctcagttcgaaatcggcagagctggtgctaatttttgttgtatttgggcggccttatggcgaatttttcaggtgttccacccgcagcagtcgaagcagggcggagcagccgtcgggccgcagccgccggcgccgaggccgaaggtgcgagcgcggcgtgggcaggcgaccgacccccacagcatcgcggagagggtaatcaaatcagttcccgcagttacactctcttagcttatggtctttcatcttgggtattttactgttgagaacttgtgatctgcataagtcactgtaccattcagacatgctgtttggcgtttgtaaggtgatcagggtttaaatttcaatgcaaatttttgctaggtttagaattggatttggtggttcctacatgcttgtaatgcagaggaaataatcagttgtctcatgctacgagtgagtcaccgaagcagttctgttgtaatgtgagactgtgagtgcaataatgcactctcttgttaggcaagtcggatcaattaggactttcaaattcgaagggattgtcacccgtgatttttttttctcagataaatgtacagaacaaatccaatttgtaagaaaaatatagcatgttctaaaagaggatgttactttagatagatgatggccggccatttggcgcagttataaggtgttttccttctggtctgtactattataccacaagtcttatctttttgacaattgatatgtcatgccgcaatcctgtcatatagcaaatgtcatgtaattgttatctagctgtagaatgcttctgctttaagataggttctcagtactttgtttctagcagttgtagatgtgtccgatgctcatttgctgttatttatatgaatgaccaccttactttaggctgcatattctcacttttcatatttttttttaatttttggacaattcttctaagtgtttgatcagcagtgctctgaagcatatttgttctgatgcagctaagaagagagagaatagcagaaaggatgagggccctacaggaattggtccccaatacaaacaaggtaatattatttgttatacttttaggttttattataagggtaaagacttctgtggttcacatgctagccattgaaaaaattttggcaagtggtttgggtcatgatgtgctcacaatattatattaattcttttttaatataaattttcttctttaaaagagtgtttcggttcactgagaaccatgcgatcaaatcttagtatgctgtcccttttgagataagcaagagcgcatccttagggttatatgcatgcttaaaataacatgtgattttactactataatacagagttccgtaaattgcaacatcagaggttgactatgggggaaataactctgatgtcttcttgaactatgcagacagatagggcagctatgctagatgagatccttgattatgtgaaattcctgaggctgcaagtaaaggtttggttcactatgctattatctagtaagcataaaccacattttgtgtttttagttgtttgatagagcatgattctatggtggtaggttttaagcatgagcaggctgggtggcgcgggtgctgttgcacagctggttgctgatattccactttcagttaaggtaaatctgtggccattaactaatatatagnnnnnnnnnnnnnnnnnnnnnnnnnnnnnnnnnnnnnnnnnnnnnnnnnnnnnnnnnnnnnn

SEQ ID NO: 27952 - DNA, 7180 bp, Oryza sativa
  unsure (1)..(7180): unsure at all n locations
nnnnnnnnnnnnnnnnnnnnnnnnnnnnnnnnnnnnnnnnnnnnnnnnnnnnnnnnnattcttttaaattatatgctacttgttcttgcccattctctctctcccttctcctcctcttgctcctccctcctctctctgtgtgtgactgcagagaaattgatggatgtttgctacatgggaaagcatcagcctgtacttaaatcagatctccatacaaaataaaagcacctttgtctttgtttcatactgacaattactctgtatttccactttattcaaacaaaatatgaatcagttttcccttgcaagaatcattctacttctgattcctctatttttctctcgtgaagtttttcacttctttcttctagacagtggtgctgaaaggcagttcccactcaccaccttattttcactgctggccttttattgatttcttgatctaattgtctatgtcagtgcaatccatttgtacttttgctatcagtgacagtgattgtagcttttcctgtctcttcttgaacataaaacttctatgtctatagtttaacaataatgaatagtgttaaagtcttagcaagatgaagatatgacacatttctaccatatgacaacatgtcttgtagatcccacattaaaatctctctcatctctagtttcctgatgagcacagtgtctccattaggcttttgcttgcttcagagcccaattacaaagacttgtatacttcctgatccccatcgatcgctccatagtactccttccgtttcacaacgtaagtcattctagtatatctatctagattcattaacatcaatatgaatgtggaaaatgctaaaatgacttacattgtgaaacggaggaagaagcaaaagaatggtgtgcattatttctttcgtgaacgatcacaccttcactcaaggaatcaatttgagagtccttttccgtctctgctctttcatatcttttggttgttaaactgtatcttgctttattttcgttagggggaagcaagcgatagtgggggcaaccaacagatttgggaaaagtggtcaacggatggcacagaaagacaggtagcgaagctgatggaagaagacatcggggcagcgatgcaatttctccaatccaaagcactctgcatgatgccaatctcgctcgccatggcaatctatgacacacaacaaacacaggatggacaaccagtgaagcacgaacccaacactccttcctagtatagtaatagcaactgtaagtctgtaacatgaatcgttacaacccctagtagacatcaacctatcaaagtgtaagataaaacagctcgttttgattcactaacaaggaggcaggaaaagacctaagagatcctctccacttgaagttgtaccaatggtatatgatgtcacctttcgttatcatcttttgttcaaaggtgctttgattgcaaggatatggtaagcaatagcctgctcatcctcctacacctttcaatgcccctatgagcgcgggtgattgagagagctactaaagagtctggcatgctctcacattgtctcttttcgagtctgtagtgcaccaaccatacactttgtggtggggactgcttttttggtagtgggtgtttggactaatcaaaagggattgatgtatgcctgtgtctgcagcctgcacaatggttgacggaatttgaacacaagatgaaatggaagatgattttgatggtgatgttcatttatctccatttttccaaagtggaggcggaggctttggtcaatggaggctgagcgtgcgctaagctgatcgctagtgggtctgctatctacatctacatgcactactgttgtatctattgtgacatactcttgataagaaactgcggtataaagtttaatctttctattggcgattaatccatagaattactttgtattttctgccatgagttctcaactacccacattatttgtgaagaacagctgttcttgtactgttcactgccctctaccacagggtttcctgagtttgtggacaaattgtgagaatctacagcaaggactattgagtttttttttgtcaactgacgatttgtttggatgttactgtaagcaattcacccatctcaatacttgatatgtgctcacatgttaataattcatgggttaaatatctggtcaagtttatacttgcactaaggttgtttatcctgcatctttgattttaaaaagtttgatttcaagtgtgattacttatctgggaactgttctataaaaaagtgacggctaccttttatttctacaggctgaaatattgatttgcaggaagaaatgaagtttgttccttccattcatatgtttgtgctatactgcagaaaactgctaccggttttagtgcttttggtactccaatggtgctatccttatctctctgatgatatacataatttttactcatcaagcttactttgcattttctaatggcacagtcaatggtatcatgcactcatatgctgtgcttggctggagaggaaactgctgggctgactatacagcagtcgaaattttttgtgctctgctcatgtctgaatactatggttcattgattgatttgtgtattgcagagctcctggtaaaccaggtaaatctgctttcaacacattgtgtcagactttttggtgttattctgcagtttttttttaaaaaaaaataactgaagatggctgcattatgtccggcaaacttgtgaaaatgacccatttgcccttgtcaacatagataggggtcattttcacgcaaaattggcaatttgtaaagatttactctctctttccaatgatatatttgtaaattcatccgaaagaatagcatcttatgagtgaccgtccataaaagtaccaaatagtcaaattccccatcaagaatcaggataactcacaagggatctgaaacttgggatcccctggagcctgggtcgttgagacggtggatttttattttaattttatatggttgagagagtggataaataggtgctttggccacggctcaccgaataggcaatgccatgtcgacccacgtgctgagactggagcctaagcatggcggccatggcccaatgagatgttgggccatatcgtgttaggctagtacgtattggggtacatgtgttgtgccggaggtctgtagcccaaattcgacatataccaagaaaaaaatgcgaatagtccgttgcatcctgccacacaaacttgggaagatctggcgaggtcctccgctcaccgatagcacattcctcttcctcctcgtcaagcactgtcatggcacttcgtttcctacttccttcgtctcgaatcaatgagctgccaatgatcgacacgctcagtggttgtgctcacgactgggccggccgcaccactatgatgttgtctctttttcatgtacccttttagtgtaatctgttggcaacacctggggatccaatggaatccaaatctggaattttatcagatggtagtattggcaagaattcagttcgcgcataagggctttttggaaatcttcttcttggctgcttggcatatctagaagcaaaggaatggtttcatcttccaaaataatcaccccaccttccaatcgtggagattacttttcaaaaatgaagttcttctgcatatgtgcagaatgaaggatcctctcaaatagctggttttagactggttacaaactatataggaatcttgttttcgtttccttttttctctttgtaactttgtatatattcttttcatttataaaattacactgctgggcaaagccctggcagtttccccggtcaaaaaaaaatgcctacgttgatgagcatccaccatcgctttcctctaccctgagccttggcttcctcaattcttccgttcttctttgctccttgctcttgctcggatgtcagttgctcaactgggggttgttcaccggtcgtcgatcgtcactgtgtcgcatgggccagggcatgccgtgccattcgggggccatgtcatgctagcttcccacatacaacttgtcgtgcggggttggggtggcggcccaagcatggtatggttagatgggtcgtgccatcatgacccatagctaaacagggtgtaccattcctgggtcgggaactatacatacatgcccgggctaatacggaaaggcctagcccattttatatcctataggaagattcggcaaactcatagaagatgattagtaagctagatgttccacctctttatcttatatggacaaaatttatggccccatctttttgcttatgctgatgcttatcaacaaaaaattgaattttcaaccttaaatttaaagctgattttgagtttttttcatcgaagtttatttttcagccttcgcttttaggtcgctaaaaacacgtatgtaaaatttttattcacaaattacttattgtggaataagccaaacaatgaggccgttagatgtctggtactaatcacccttcctttaaaacttacactaaggctacaccataagaaataaaaaaccattttgtatctctgtaacatccatatcggtttgaagcctgcatatgaaaggctaaaaatatttttttttagtgtgtcccaccttaagattaagattaagaaaagaccataaatattgtagcataataatgttattagtgaaagaccatctccatgaacttaaataaactgaggatgccctaggccgagcgttgaacgcggacggggagcaaattgcctgagagccgaaacgcgcgaaacgacccgcccgcccacgcggcccagcccaaccaggtcgcacaacgcaactcgcgagggcgagcgactgagaccgtctcctctcgtctcgtctccccgctagggttcaggccatggcgcacggccgcgccgccgccgtacgccgccccaagtcgtcgtcggcgtcgtccgcgggggcggctgccgaacggaagcggaagcgcgccgccgccgccaagaccgtttccctcaagaaccagatccgctccaccgagcgcctgctccgcaaggtaacttaacctacctggggttcgggtttgggttggaaagcgctgcctctcgctcgcttctgctgctgctgctactgctgctaattctgctcccatgattaacttgtttagtaatttagttagtagcttactatctactgctccggtgtgtggagtggtggtggggaacaacgataaattcgtctccgttgactgaattttgctttgattagtatcttctgctacttgctacggcggggattatggaatggattgttttgaggttccgagcagcttggctcgggttattgcagtagtttcgtgaatggtcattcgcctcacgaattgcaaccctcccgtggggcattgcttatagggggaaaaaagataaacgagcctgatgttaagtatgcaaccacaactagatgaatcagaatgatgttaatagaagtgatgtgtttgctcatttcagagtaggatggtaaaggttgggttgatgatgattggttacaacatacttgtaggttggcagctttaatgtaggaaacaagtagggattgagggacaattgattgtagaatgtagagcaccttgcatgctggtcatagagcacattgcatgcatatatgtctgcccaagctcgcatgtactatacccaagggtaacctttacaagattccaggattccactgaaaatcaagttaaaaacacctataaggctgtatgcaagaagacagcctactgttttggtcattgtaattcaattctattcgaggacactatgcttgtctgtgcaccagtgcttgatgtcaacggtactgacaatgcacgcatggtgtgttttttgggtaggcttgcaggaatcccttcccccccctaaaaaaagcaatgtatcaaatggttataaccatcttctgtggcaacactgctagcagttttaagtattcgtgcatgcttaagagttagaacttctccaagtattggggttgatcatttgttggggtctattctaatcggtatcatttcccttaacatgccttagtgccaattgttacatgcatgcattactctgtttttttttcccaggcctgttgttaaaatgctaatattgtatatttggtcaggaccttcctaatgacattagggtagctcaagagaagaaactggaagaattgaagcggcaacaagagcttcagaatcaactggctattcaacgaacagttcagctgagagatagaaagataaaattctttggtctgctggacattctgcttcattcttgctcctgtatgatgacctttaactgaacatatgtacttatcattttgtttgtattggtatttgaaaactttgaagagaggcgaaagattgagaggatgatcaggcgccttgagaagcagcaacgttcaaatgccgatgatgccagcaataaactgtcaaaattaaaggaagatcttgagtatgttagggtaagcttactgttctttatcccccttgctgaatcagtatctttgcattaatttactacttacctcatcccaaaaagagtttacttttctactcgaatatagacaagtggttgtccagattcgtgtagaaagtgaactctttttgggacggaggtagtacagtttttgtgtggactatcctcaagtctcattcttaaacgactcttgaaataggtgttcattatttttttcaaaattggataaaaaatcattgttccgtctgaacctgcttgaattccaagctaaaattatgctgttttactcatgtgcagtttttcccaaagaatgagaaatatgtctcactgttttctggagggaataccccagatatgttagagaagaggaataagtggcgtaaacagataaaagaaaatttgatggctgctgcagaaaatggaaaagacttggaaggtgtgtgtttacattaccgtttactagattacttatgttctatttgtattcttcatgcacttctagcttttcatttgaaaattgtactgcctgtttggctacatatctactctgaagtactaaattttatttttctcgtcgcctaacagagacagcaagcgatgatgatactgtggatgtgagtgatgacgacttcttcatgtcggggagttcaagtgatgaagagg

SEQ ID NO: 27953 - DNA, 17595 bp, Oryza sativa
  unsure (1)..(17595): unsure at all n locations
actcgattatttgttaaagatagcaccttttgagatcatagctgttttgtgcgcctggatcataggcttgtagtttgtccttttcagtctcttatgttaatgttgtacttagtctaaaactgcatagacattctgcagaaaaggcatctttcctgattttgttagtttaatgcagagaaccagcttccagtgcttcaggtaaggcagcgtctggcatgtcaagcgatgaaaagaatcaggttgttctctctatactggtatttcaatttacaaacttcttcaaatttccagtaggttgctttggtatgcttccctacatttaatcccgtctgttttgcttttcagcgtcagagagatgctcgagttcttatgccaccacctcgttcattagcaccaaatagaactagaccaggggtgaaacacgtgttatccagctcaagcaatacttcaaatagcacaagtggtggcactttcaaaaataggagagcagcaaatcagcctggagatcataacagcaacctgagttcaaattctgatgctcataaaccacgtcgcaaaaggagacatcggaagaaaaagaagctggtataaactttgcacccatgctatgaacttaattaaatttatttttcgtgatatctgtatttgacaaaaataacttgtgcgatttaacattcaaatgcaagttatatcgacattatctatgacctgcatacattatatttgcaattacgacacttatgtgaaatgcgtgctttgtgtgaaatacattatctctgaattttagttttactgaaattttatctgattgtacaaatgccttaaggattttatatgcacattgtatgttccaccacaagtgaagatcatacaaacagtaacaatattgaaacatgcatatcgtttttaaggctatagggaggaaaatatttctgcatgatgtgtgtataactgtaagttggttatgcttgattttttttaaacaaaagttgttgatgatatcattaggaatgataacttggttggtttgctttgtacattgtctgcctgagaaaaaaaaatggcatgcactatcagcttgtttccctgatattaattgtcatgctacctgtccatctcaacaggcatgaatattctggagcgtgaggtggaagctgattttattcccgcaccaaagtgtgtactaaggctggttactatcaaaagaatggagacaacatgtgtgccctgaggaagttgctgattttgtgcgccctctctcgatgtaaaatgaatctcctatcgctcttcactcaatcactcatttgttttacagtaaccatccaaaaagttccgattattaactgaatgcatgctggtctttaccatgaagctgtgcttttccttatttttttttccttcatgacccaccatcaatcaattcacgggtacctgaaagctgtaattgtggttttagggacagctccatgaattcagaatttcggtacatactgattcttgtcgggaggcaaatgcatatgcttttatcattgctaggctgtgagcggttgtcgttgtctgctcccaggtctgggattacatgacctgtaaggcgtgatatggatgttcaattgtctccctactgtctgatccgcatctatcatgtgggtctagtgcacgttgtctgtagtcactgtagcaccagcattttcatattctccctcccatcactttgcaaaattagagagacccttctcactggactgttgccacactgtatttttacctactagtatcaatgttatacagtgcagctacattatctctgtcgtttgctggcattttggccaggttttctcttgcagccatgcatgcatgcatcgcctatgtggtgtagtaggtcagtatcagtaggtcccggttatgacctgtgctgctgtgcacagtttgtgacattctgggctgcagtaaagttccaggtaccatcgttatcagtgtggctcactcgcctctgcatcctatgctatgatccatatgatgtgtcgtcattccatgcatgtagttttcccacaccaccttaaaatgagttcatctttaacctttaccatttgtactaaaataattttacttctttctttttatctattgcatcgatgagtttcatttcttcaatacccccatctacacatccattaatactatttttcttattaatagaaggtactttggtgtttttcactttgtattaatttgcattccaacgatgaaagatgaagttattttgggatagaggtagcttgtttttcttttgattttgccgtgcatttggatgcttctgctgctgtgatctctcttgatgggtactatgtgacgtctctgttattcttttcaagcgtacaccctgtgcaagactggaacgtaacaggagctttgggaaaatcgaatggatggatatgcatctctctctttggaaaattgaatgtactatccttgtactacaatttcctgcctagcaggtgtagtagttgagacttaatagtaggagcatctctgaaggcgattactcagtgagcaggtaataatctgatggctgatgcaccgtcaggtgcagtagttgcagtactgttgagatggtgagagagactgcatggccattactgccagatttgtgagattaatggacagtagatgcgtgattgattacaagaattaaagcagaatacataaatgagtagtatgctgagatctggcgccttcaagtgcttgtcgttcttcacttgtactccatatacgatagtgaacttcaaaggcatactacacatgaaaaaggaacagcaacgagaaaagaagattggtcttgtttcagagaaaagaaaagaagattgggagacaattcttgatgtgacaaggtctcgttttgacagttaacgtactgttcttgtttttttatgactctggtcagcatcagtaaatcacacagagattaaaaggaatcaaacagctgggaggaaattaaaatgaccaaacttccaagtttctctttcttcagctctcagatttcttcagtgacacaacagaagctagaaaaaaaaaagctttaaaaaaaaggcatgtgtacacaaatctgcagaactagcagttgccatttccaacaaccaaaatctcagctagattattctgtacataggagtactgcagctctgctcgatcgatcatatcctcctcctcaccaactccgatccaactgaatcctgaacttttttagaattcagatccttggatatctcatctacacatctacgtagaacaaaaacaagatgcatccacgtgtaagtgtccttcttggccagccgtccgatcgccatgcatgacgatgtccacggatagatctcatctctctcatgcatgaagccttttttctgtgagatgtctactccatgcatgcatcggcgaaaattttttcttcagctcgacgcctttcgatttcgatatatatcatctcgcctcagatcctcgcattatccgcagcttcttgcaagaagagatgaacatgctgcaaaagcacaaaaagattcaaattagagacaaataaacacacaagattttccatggatggataattaacatgtgtgtgtatggtgcttactcccagggcacgtcgccggcgagcatgaggtcgccgtccttgtcctcataggcgacggcgaagtgggcggcggaggcggaggcgtcggcggaaaagcagccgaagagcgcgtcgagagcgtccctgagctccctgtagccgccgtacatccggaggtcgaccttgcggaggtatggcgccccgtccatgctcaccttcacgtacagccctcctcccttattcttcctcccttgatccgtctcgccgccgcccttccccttcgccgccgccgccgtcgacgacgacgaagactggaacgtgctcctcctgtacgaccccaccggcggccaccccaccacctgcactctgctcacccacacaagaaattgtaagattggctgcaaatcgagctggcacacatggcgagagagagagctagagctagaacttacttggacgccggcgaggcgccgtcttcgacgtcccgggcgccggcgccgccgcagcaggccgtgccggaggcctcgctcttcaccgtcgacgacgccgaccgccgcttcttcgccgccacgccgtcaccgccgccgctgccgggcagcccgaggcgcagctccgcgtcgatgctctccgcgccatggccatcgatcgagagagagagctagctcgtcggcgttcgtcgctgcgacactgacctcgtcgtctcgtgctgctttggttgcgcgtcgcgttatatagagcggttagttagttgttgcgtgcgtgccctagcatgtgagtatgccaggtgggcccgggagacagggaggacgcatggttgggtgggccccatcgggcagacaggtggggccagacgcgatgggctaggtcgggtacttactcgggtcgggtatagattccccgcggtgggcgggggcgctgttcgtgcacgtcgggggcagcgcatgtgggggtgacgggtggggcccacatgtcggtgtggggggggggcacgcgtgctggcgggggtgccacggtgtggggctcacacgtgtcgtcgcgacgcgggcagtctggttttggttgcatggggccacgtcacgcgctccggtgtgcatgcgtagctggaacggataggcacctgtcattgccctgcatacgtcatactcattctcgcatttctacgccggtttccaagacgataatacatccctactccctcaaaaacccaattctcccgataaatttggagatacataatgtttaaatcattattattagaactaagttgtagagagcagatattattttttttaaaaataaagtacaaacgtagacgctcacaacacgtgcacactcatccctataaatacatgcacgtacattctacctctacgagcatatctgtaagattggacagtatattttgagattgtgtcagcatagaatggggggacggccctaatgttgtgttggccgggttgcgagcggataaaagcggacgtggggactcgggtcggggcacagcgtaactaagataagagagccattccatttagggcgagacagaatgggcgggcacaagcggtctggtgtccgagccgattggtcagacggtgaagaagttatcacgaacaccttattgtcgagagttaattatctgaatattcttttgattatattattgggaattgatttttatagatggatatagtccgaagttagtttttttttttaaggatcgaggggattggtaaattttgtagcacctttttgccgagagagtttggtgtggttcaaatccagatgagtgagtttattaacccaaactttcatgtgaaccgtgtcggatcgtcaaaggtgatacgcgtacgtgtgcatgcaaatatgcaatgcaaagcatggtatccagctaagcgcaaaacggatccgggccagacatgcacacgcaacccaatcgcccacgaaacttttttgcatgcatatggcaaacggaaaatatggcattcatatgtcttaattatcactgaaaaggcaaaaaaaaaaagaagaaaaacacactccctcgcttcatattataaattatttatctttttctaatcaaactttttataaaaatatagtagtattttcaatacaaaacagacatattatcaaaatacatttaatgttagattaaataaaactaatttgatattttatatgtttctaattttatctataaatttgatgagagttaatagggaaaaaatcaaattatattaaaacggagggagtagctagtagacgaagctaggtgaggaggatggtcacgcagttatcgtgttgcacggttgccgtgacaagcaaccaacaaacccaaccaggtgatctgtctatcccagatcgtaaaccggagggggaggtgcgaaccaaacatgcttttggtgttgggttggtgtgtgtcccctctcgacagcgatcgagccgtgcgatcgagcacgcacgccaccgcccctccatcgcgtcctacgtctatctgtatctgtcacctctcgcatgcaccgtgtgctccatcgctgtcacgtcaccaacagctaagctgactccgatccatctcgttaatctcacgaactactcctactcttcttctttttctgatgaagacgacgatggaatggatgcatgttcaggagacggcattgccatatgtaaaccgtggaaccaggatttaagtatgactgtatgagagacctaagagtatggtggagtctagagagggctaaatatactatatttagattaattagataattatatgtgaaaaaaattgttggaagagggtcatagggtgctcgtatttacggctcattattctttcagtggtaggtggcgtatccgtcgacagtgagacgcctgtggtgacttcgtcaatctcaagacatgtcggcccagtcttccgaaggtgctcatatggataagtgtgctcacgttgtgagcagctacgtttgtactgtgttcctttaaaaaaatgtggtggtcgttcccgttgtcctgtctcagctgccaatggcggagccaccacccgactaccacatatatggctgtccagactcatcatcaaaagttccattaaattttagctgttgaaaagaactattatgcaatttctataaagaatactcgacagggtagagctactgtgtaattactcggggtttaatgagtaatgaccccggtgaagtttcctaaatcccatggtaaatcatgttagtcaccatatataaataagaacagagtgactccatggtgcaatatgagtgaccccgtgaattttctgtctggatagatccacccctgatactcgatattgttgagttttgtcggggtttaaacatcttttccttctctgctactagtctgagagaggcgggcgatcgagtgcgagatcgtcccgtgattctggggagtttcgcgcgagcgatatattgattgctagtagctacttgctgttgatttatagctaaaaatatttatatttaaggatgaagggagtaggtggttacattgctggcattgctgcgcgatacaataatggatcgatcgatcgagttgcgccaatgcaacttgcgattattcagacatgtacattcagtgcagtgtgcaagtggccggccgtgtgatcagctagcaatatgtactgtttcgtgtcacgatctctgatgatatgtgatgatcagctgccatgcatttgttgcaatgacgctgcaggctagatacgcgcgtagagtctctctctctctctctctctccctccctccctctcgtgatctcgtgtctgacgattagctctcgcagcttcacactgcatatgaatagctgaatatgtagcgcgtaatctggcgaaaaagttccagggggagaaacacagtacagtacttggagggtgcatgtcatctgatcagacgtgcatagttagtgatttgacctcatgcgtccttcttgaacaacgtgtatttggatctaagcaggggcggatatagaacaagatttaagagaggactcatcttcttctttcttcttcagtctttctactctttattttctccctgtttttctcctttcatcttcaattctatcaatggtaatccagcgaggtaaggaggactcgagtcccctcagcattcacgcttgattcgcccttggacctaagtatgctcatggtgatggctagctgctaatagcttaactaattaagctgctcaatgacgagaaatgaaccatcgtttaaacatcccccaactcttcttcaaatgagtaaaggtatccatgatggagagatcgatcagaccatacactgtagatgacgattttttgccgtgaaatttgggagatatttatggctacaaaacgagggaaggcgatggttcctcgaaatccagacatacagtcatcattcagcatgaccatacagtatacacactatacatgagaccggcaacccatccagggttccagcgaatgcggcatcgaggcatggatcgttggctgctaattggctgcatcccatgccgcccccgggtcccgcccctgccggtactttggttccatatttattagggtgcagctatacaacggaatcctgttttcaaaccgaatgatcccgagtagctatcaggtgtgatacctatcaagtattagacgattctacacacgtttcaggtgatacttacaaatatcatgtgatacttattaggtatcatgcgatttctatcacgtatcgtgtgatgctcgtgaggtatcatgtgaaacctgtcaggtatcagacgatttcaaccacatatcgcgtgatactcacgaggtatcatgcgatacctgtcatgtatcagacgatttctaccacgtatcgcatgatactcatgtgatacttgtcaggtatcagacgatttttaccatgtatcgtgtgatacttacgaggtatcggatgatacctaccaggtatcaagtgattcctactagatataactgagcatcctgttgggggaggagcaccctgacacgcgcggcggccccctgcagccgtcccttgtagacgaggacggcaatggccgcggcaggggacgggtgcggcgacggcggcggtagcgggggacgggcgcggcggcggcggtgggggatgggtgcggcgtcgtcgatgggggacgggtgtggcggcggcggcggcggaggcgacgggggacgggcgcggcagcggcgggggacggcgacggcggcgggtgagcaggcctggtgcatatatggataagaatcgcgttatgaaggaggagctatcccgttgggggacggtatcgcatcccctagcattcccgtatttcttaacgtgttgagtaaagttagaattaaacttttacaactttaatgatatttagcttaaagttattacaacaatatatataaatttgtcttataaatactatatataaaaataaaagtttatctatttattgtatatattaaaatagaaaaatatagtcaaatatatatttcggatatcgtgctattatccaaaatataaaaaaattatgatatcagaggcagagaaagatatttttacccggcttctacatccaaccagatatatgcaaccttttaaatcaggaacttagccccttaaacaatccaatctgtaaattcgcttatatgaagagttgaactcgtaaccttgatgtgctattcaaatcatcgcacctactacatgctctttcgcatccatgatccacgataggtcgatccgatcagacactgtagatgacgatttttcgccgtgaaattggaagaaattcctggctacaaaacgagggaaggcgatggttcctcgaaattcaggcatacagtcatcatccagcagaccatactgtatacacactgtacatcaaaaccggcaacccatccaggccaggtcccagcaaatgcggcattcgggcatggatccaggcgcgcctgcttggctgcatcccatgccgtccctgccggtcgacgtgtacatacgcgcgtagtggtaattacagaaaatctatcgtacggtgtcccgtggtggctgtgcgggcggtcacgggataaattaaacgactggataacgttttacttcttatccattccttttctcttctctatccaaagctttggtcaacgccttcgtgtttgggcaggccaacacccgccattccagccgtgcatcgctacaagagaagctcaagagagaagttcccggcggcaagatggctgactgctgcgtgttcctccgatggccattgaccttgccctccctcctcggttaccgctccctcgacaacagcaaggtggccggcttgtcgtctccagcagtgacggtcgtcgttgagaaagagtggtaggtgttctccgtcgaccagctcatgctcgacagctacccatcccggctgctcctcgagaagcggtgaggaaggaggagagcaaggcgacgctcttcgtcgatgtcgccatccttttcttgtcagtgttatgtgcaaagtacgtcacgactgatacctaggtatcaagtttggtaccaagtaccaggggtcttggggtctgtacggcgtacaccatcacgcgcctgtacagcgtcttggggtggatgaggcctagccacggtggcaagaggaggtggtcgcgcgagcggaatggggagcgccatgctgcgggcggtgctggtgttcgtgttctctgccgccatgctgatacagctgataccagtatggtaccaactgcatggtacatagtacctgtgacacctggtacccaatacttgtgatacctagtacctgatacctgatacctgtggcacctggtactcaatacttgtgatacttggcatctagtacttgtgatacctagtacctgatacctgtgacacttggtacccgatacttgtgatacctggcacctagtacctgtgatacctagtacccggtacctgatatatggtacctacagcatggtgtacgctaatcaatcacacattaaaattgtcccgtgactttagtttttcacggtatcccgtgggctagcagccctcggtaattgcggcattgcgcgcgtatgttcgcgaggcgttgcatactaaattttggcaatttaacagtattgtcaagttttggcatgatttcttatatatttatcagagtttggtaaaagaactaaatagatacatatatttgaaattaatggcaccaatctaaacaaccactaaaaatacaataaaattgtaaagatatgtaatgtttgcatgatatttaaaatactctagataataattattagtaggtgatgatgtaaaatactctagataacgactgtttgtggatgatgatatgacacactttatggtaagctttaggagttactccctccatacttaaaaaaacctagttggtgatttgacaccacctaggacaataaatttgaacaacctcatgtccaaatttattgttattgttggtgtcaaatcgtcaccatgtatttttttttttgagacagtggaagtagttagtaggataagatatgagtttacttgctttgtatataagtacgttaactaaaaccactattaatatcatgttcaactggtgactttgaaaagcttggagtcttcttcttgtgcttcatctcttctaccttagctacctattcaccatccataaccattgcaccagaagcatcaagcgcgaaatatccataatgttctccaccatctattgacttggttttctagtagcgagaaacacccagtggtcttttggctagtttcacagggtggtgagctagccggcctggattttaaacctcactttttctatttatttgatattaggtctttctctattgtttgttttttaagtagtacctccttgattggatggcttacatttgtttttcttattttgtccttttctcaatctgatggtttatattttgttccctacgtagaccaatgaggtgttttaaaatcatttggctttcactattttagatttggaccgacatatatagtaccaccttcaaatcaaaataagtgtccttatttagtttaaatttaaattaaagaagtgcacttattttaagatagaaagagtaatatgttgacgtcaaaattcctagtgccaacctccaggagctatggttgctagctttagctgccatggttggcaagaggttgatgccaaatcttgttagcgtcagtacattgttagatttttatccagattcgtggtactaaaatatatcacacttacttaaaatacattatattttttaacggtgagtagtatataatagtttcgcttgcaacaggttacataagccataacacttagtgatttaaaaataatttataagtattttttatatatatttgtgtttttagtgatttaaaagcaaacgctgaaaaatagagtaagataaaaacccaaattaactttaaaaattatgctttaaacttaagttttaaatttaaattagctgataagtaaagaggaaagattgaggctgtatacgtcggcgccggtgatgtccagtgtagcgtccgaaaacccaacaggcctgccatcttgtttgcatatcacaccaacaaacgagccagcttgtttgcagtcagattatttttggtgttaatgtaacaagccaagccaatggaggtgggcagaaaaaaaccgaaccgaaagaccgaaccgaaaagaccgagatcgagaaatttaaacaaccgannnnnnnnnnnnnnnnnnnnnnnnnnnnnnnnnnnnntcagtcatcaattcggtcctaggtagtgaaagaccgaattttgttcggtcaattcggttagtctcctcaggtaaccgaatagactgaaaagaccgaattatcaaaaaatgtctaaatacaacctacaatccactatgtttaataggattaaactctaattttcacatccctacttcttctaggcatgcaacataataaaagtctttactcataagtgcttacgaattttttttgtgatttttgtgttgaaaattttcattatttctttgcatatatggaaatgttgttgaatttcggtcaggaccaggaccgagaccgagaccgagaccgagaccgaatttgtcggtcctgatattttttcactgaaattcggtcttcacttttcaaagaccgaaaagaccaaaagaccgaagaccgagaccgaaattttcggttagaccgaatgcgcaccctattcatctatctataggctttggcagcaaagctctcgaggtaccagcagggtcggaatttcggtccctatgatactattacttcgactgaaatttttcaactttttaatttttttcatgaattctgataatatttgcttaaattcaactaaattctgtttaaaatatcggaccaaaattttcgaaatttcggcatttcggtgagacccgatcaaattggccaccctgggtaccactcgacaacgtcgaggccgcagagatacgtccatctggaaagtcagcgccgagccgccggcaccggcgaactccttccgggccgccctgatcgcctccctcatcgcgcagtgcaccgacgacgccagcagcggcggcggctcaccggacgctgcatgccatgatggaccgcaaaacagtttcagatttcgagttcctttacgatttcaatgctcatgcgtttgagaacaaaaggatatgatatttcgagttcctttacgatttcagtgttcatgcgtttgaggaaaaaaaaaaggatcgaaggaagaagacgatgatttcacctttggaagataggacgcgcttgtgatcgcgggcgctgttgatgagctcgacgttgaactgcttgaggatggtgtccacgccacgtgccgtcgtggatgaccagcccatcggagttggtcgcgtactcatcattcgtgaagaagccgatcccttgcacgaacgcgccttaattccacctaaccaagatcaacaacattcagtttacatgtttagtatttacatctcattcttgcaatgatatgcaacattggggaaaatccccctttttttgtatgttattcaaattatcataaaaattaaaattaattaacataatatatcaatacgaggaatgtcattttctacaaaacatgcaggctcaaaatagacttacacaaataaaaaataaaaataacaaattttattgcagatattacataatattcacgttaaattttttatttttgtttctatttgtattggttgaatttgaacgtgcatgtttgtaaagtaatatatcacatattgttctatcttgtcaacttttttgagaaaatatgatggtttttttagcgacatgcataaagtgataaaacgatggaacgtcccctcgaataatgttgaaggtaattagtagattgactgactgacctggcccaagtccacggcaggattgaagctctgcccacagtcatacactagaaaagaaatgcagctttgccgcataatggcctagccaataggaattaaatatcaatggaacagcctgcacaacaatttaatggtcaattatatagagttttgtgctttaatttattaggccatccccaacccagaaactatctagtagtttccatatttgtcatgtcatatagacactatgtgtagaaactatgtattcaatggatggtgtcttcaaattaaattatcatccaatcacctctcttctctctccttttatccacctatccccttaattttattcttggttcttgtgtagaaatggtttcttgcatgagaaatgatttcttcatctttttacctctctcatcattaattctcttgccacataggatttttgcttatgtgtcaatgtatttaatgctatgaaaactagatgacatggagggttggggatggccttagtatccagatcaattccttctcaacctttctcattcgttctgatcaaccatcacccgcattgctatcagcttctacttccttccttacgcctgtcctctccggctttcattcgatgccatcggccgcctcacccaataccaggccctcctcctcgaggcagtattgctatcacagaaaaagaagctcgagtcatcattaccccctcctagtttaaatatgatggttgttttagctctatcaccaatagctatttttctagctcaactggcgaaaagtcaagaaaatgatgccctttatgctattaaataagcgattgccaacttaaataagagaaaacttgatgcccacatagatcactccacaggaacattagatttctagaagggttataatatgatatcgggatgtcgatttctatttctataattaagttgattttcatcgttgcaaatgatgtatattttatctcagttgattgtagtgtatctctataaatacgcaacccacccaacataacataattattggtgattagaaaatgcatttgtatatttataagtaataattttatgtattatttattaatggtacttaacttccttaaatttgcttttttgttttgatttttttctttatactatttcccccctacgtcttccctcctgcctgtttaccaataaataattcttctatgttaatttactttggtaaaaaaaagagagtaaaattaactataggaagttgtgcatttaaaattatgaatcatactattcatctagaaatttaaattgttccatgaaaatagaagtttacattagaccatatagctagaaggactagtattaatattggtaaaattaggagctcacactaacagcaaactactcacatgaaaattgcctaacgctccacaaaaaggaaatactggtactacaattttatagaacatgattatatatagatcacatgatagttcattgatatatgcctctcgatctacagaaattggcagccaactttattttatttctgtgtttaaaacatttttagtaagtccaatataatattgcatttatgcatataaatttcctttagttcagagaactatattgatggaggggagtttaggcatcaggccaatctaagctcttgtttgctcaaactaataatctaaagaatccatacttagttgttatgaatatttgtatttgacaactcacatgcctttttagagtaaacaaaatagagaattgaaaatggaacagttctcactagctattacctgagaaaggaacagaaacgtgaacttacttgctttgcccttctagaagttcaggacttgacggcaacaattgtgggcacgaacgccggcgtggcgacactatggtggaaggcgtgaactgctggtggagttgatgacgatggatcttagcaacggtggtggaagcggacggcagtggcaagggatttgggcgagtgatagcgccgatggtggaagtggatggtgatggcggatggatttgggtgagaaatcgatagcgcttgtgctggtgatagatctaaccgagcgatggagcaatggagagatcgatagctagctggattgattgttatgtgtagagtaggaatagtaaccttctccttcttttactgccctatgcatggaggggaatgggatagtaaatagtcaccttccgagtatacaaagattacctcttcatcttctttaggtaacttctttacttttctaaagaattcatggaccaactaatttatttatttatttttcttcctagagcattcatagatatagtacattggagcatctcctcggagtggacacatggcagatattgggaggggacttttgctgatttctatggcgccacgtcgcccaataagatgcaagatcttggactctgcattaggtctttaagatgagcctgctttaggtctttaagatgaggtcgctccttaggatggtggttgctcctgtcagcatatccacttccacctacaatgttcatatgtaaattttaggtcaagctctgagatttggtttggcaaatgcattttcagagcttctgttgtagtactaatatggatcagggtatttgtagtgcgtacctcactaaccgcaggtccatagttcaagtagctagggaacgtcgggtcaggggtccagtacgtatgctccgtcagcttcacactcgccatgcttgcctgaaagcggggtggagcaaattaaatcaattcccattacaaattacaaatttacaatgcatccagaagatgatcattcagaaaataagatcagcctactgatgcttgcagttgaaaaaaaaaagattcgttttgaaacggaggagcagaactccccagttccatcaatggaaacgcagcagattgatcacatagaaagaaggaaattatagccacgaagatgtcacaggaattggatttcttttttttaaaaaggacatttacaaggcttaatactcacctgggcaatcaaggatttccatggtagggtaccagccttctccttgatggatcatgctcagtgtgtcagcctggatgaggatgacatggaccttgtcgagatcatcgcacaactggcccagcgcgaacgcggtcatctgcttcacctttgtccatagcccctgaccgatctcgaagccgccggcgatggagccatcgttcatgatggacaccttccccagagtcgtccggagcctcacgtcgtaggtgatcggcacgcaagaaatgccccgcgcgcttcttccaagctgcagcagtagcagcaagggagagagatggagcagattaactcaccggctggcaacgccaactaggacggcgccgttgtcgctgaccaactccactggctgcgcgtaggggagtgcgtcccctctctttttgacggccgccaccgcctgatctggtgctagcaagtggtgaggccgccggatctggcgaaaaggccctcgccagcctccttcaagagtaggccacgccaccccactgcgaggggagggggataccggcgccagttccgacgctgctgaggggaggacgaag

SEQ ID NO: 27954 - DNA, 3891 bp, Oryza sativa
ccaaatggcacacaacgccggtggggggatggcgtatggcgtacggcgacggcgagggtaggcggcggcatacgggactacggcggaggccggatccgctggccaggagggcggcgcccggtggtatgacgataggggggaggcggcgacggcgggaaaagggcggtcgttgaaggtgatggcggtgggatggcgcacggcaatgatggggggagaacgtaaggccgtgtctaggggaggtcggatggcggcgaagggagggcggacgacggcatagacagggctacgccgccggggattgggatcctcaaacgtgaagtcagagggacgtggtgactgatatgtgggccccaccgctcgtgggcccacctatcagtgaccacgtcatggggcagttcacgtcagagggaccctctccgtgccgtcgatgcgtggcgtgggtggggcgctgttgggaggaggtgggaccgtgggagacggcgggtagagttcgggaggggatatattgggttctttttcgagaaaaatcatgtgttttttctattttacagcgctacctaggaatgcaagcagatcaatccgcaaacccgcttatataccaatttgatatataaatgagtttatgggtagatccacttgtttctctacaatgtggcaagccaagttaatacgtgaaaacccacatattaccctttatttaacatataagtaagttcgtgggtcgacccgcttacatcccttgagccgctaccgctagaaacggaattttctctttttcgtgttgtatttctgtgaaacacgagggaattttcagataaaacacaacggagcatcagtccattcgaggacataaaatacaaccacacaaaatttgcgtggcagacatgcacgctgccagtcacaaccaggagggcgggaggggggggtgaaacggtcaccacatgcatggctgcacagggatttgactgagcatttgctccctgccagagttcgtagcctaatcgagaagcttttgcgcctgcaaactacttcctctgtaaaaaaaccaacttagaagaggatgtcacctccttacaataaatatggagtatgtgccacaagtaccgtggagaaaaacaattaaaaaaatgagaaaaaccgtatccctagacctgttatttattgatgatgaccagtacgactctacaaggatattccaaaaaaaaaaaagtctatagaaaccatcatgatcccccgattcacatagctgcggtacgtccaaaaaaccctagccgcattgtacatgaaatccgaaatccaactattttaccttccgtttgtattggaagttggtggacgtaaacatgttcagattagaaatcgagtcgctgtaactattggcagggtaggcctaaaatggagacatgcaccatatgttttttttttacaaactaaactgttattagtactgggattaaggcaaattaagaggagagcagctgacaggtcttacaagagaagctagggctgacacaaattaaagaaaaagtgtgggtggagatatgagaggatgtgcgcgaattaagtcttttgtcctactaacttcattttaaaatgtgtgtgttataaaatgattgctacagatagttcaacaaaaaaattataactcttataaaaaaagggagagtgacatttgtcatgaatatggtggttgttatacactataaatattaccaaaaacaacactatctttaaacacatatattatatgttaaatagtttataactgatgataagagtatgagtatttatatttctaagtaataatgtagagtacaacaatgacatgtctttatgcaatttcattaattaaaaatattaaaataaattatatatatatatatattattttgtaaataaatatttttatcaagctgttattaaaaatctaagtttgctactcattattagtctcttattagatgaatgtataatacaatttatccatatgtataaattaattatttatagtaatcaaatattctttcagtatccaatataaatgatattcatctgtcgtataaatcaatttttacacaaaacaataagaatatctaagtgtgaggtcttttttttcgtccatcttattaatctaatttgtgttagctcgatttagttaacatccttaaggattgaaggagtttaaataaagttaggtaatttttaaactatcattttgtattgtatcataaaacaaataatgttactatacaactattaataattatttataattttacttatatagaaaggaatatcgtattttatatattccaaatttatattacttacaaataagtggatatatatatatgatacaaaaaagtaatttatatttaagatgaattaatataaatatttttatttaaaaaataatattcttttttacttaacaaacatattaatttagtgtattcaaaaataagaaatttaataaatatgaatttattattgttaacgaaaaacacagtggcttcgaaaatttacttaattacaatgtaggtccaaagttttggtttaagaccaataaacaagatatattagatgcggaacccaatcatgtacaatatgactaccaagaatggtacttaatatgagtacgaccacattcaaccttactctcaacgtaatacatctcacaaccactatcaacaatactgcagctgttcaatgctaattattctttcgttaattattttattattcttaatatatgtactgggattatttacggagttaattttaggaaggacagatacaccctttcctagtaattagcatgagagagacgtcttcttccatagtttaaattagtgagtaaaaatatatttttaattgaacaaactatatacactgcagtgcatcaatatatgcaagtgatgaagtgaagccataccagcttttttttatctcgtttaaacaatgtacttttgcagtcatttaaagattttagagattattgtcttatcttgttgaggaagagctggatctaatcgagatagccgttaggggaaaagttgatcgggtgggcaggaaatataaagtgttaccatgttacttttgctagtaatttaaagattttagagattattgtcttattttgctgaggaagatctggatctaatcgagatgaccgttaggggtaaagttgatcgggtgggcaggaaatgtaaagtgttgccatgtttgagttgtcaataggttgtataagggcaatatcaatgcacgtggaaaaactacaacggaagactaatttattccattgaggaagagagactaataattcaccggaaagaagaggggaaagtaccacatgtttcaattggttgatccacctaacttacattttcattttgttatcgtcatgcgaactggaccccctctgcctgcatgcttcgtcaatctgactctcaagtctctagcctcgtggatccacaagcaaaaagaactgcctgcatgcttcgtcaatctgactctcaagtctctagcctcgtggatccacaagcaaaagaactattcagattttagagctatgtacacagaattatagaagggcgtcgtgattgaaattcggtattcgttcgcaattccctgtaattatcaagctgtcttttaacaaattcatgtgttaaaagaatggtttctgcgagtgacaactgctttcataagtattattttagagaagatatatattccctccgtcccattttaagtatagttatggtttttcgcgaccaactttgcccgtctgtcttatttgaaaattttttgaacttatatttgcacttaaaatgggacataatgagtagattggagtaggttgcttacaaacttgcaatgtttcttggacag

SEQ ID NO: 27955 - DNA, 7693 bp, Oryza sativa
aacgtgaactttcaatgctatataaccaattttagctttaattagttaaggcacgtcggatatctggttttaacattttttagcttgatgacaagttgagggaccttcggtgtactttttcctttgtcctgcgtttccgggtcacggactccaggtttcggcccatgggccacggcctcatatgggacgccaccccacgtgagtgttgacgcggcaactgggccgttctttcagctcaatggttaaatggtacttcatctaccctaaaatataacaacataaaaatcagatggaatataatctagacataccccttacatattcatactattattctacttcctccctcccaaaaaaaacaccatctaagacaacgaatccggacattgattttttttcggacggagggagtatctgattctatgttcctataattttcatgatggagatggtaccattattttagagtaggaaagaaccaataaaatgatataaatactgaaaatagattaagaataatattctaagaatttaatctgtaaacaattttttttagaaattgcacgtttagtttttgttaaaaaaaataatccttagttcctctcatcacgaacaaacttacccagggctgcaagcatgtgtattggctttgtagtgccctgcccttgagaaaaatagtagagtacttcattttacaatcctttgattgctgagatgaaattaaacctgtttaggacaataatagtggtagctagtactcgattgttcggcctcgcttaccatatcatgcattccatacggcaaagtggaaaatgtcttgggtccagaaaatctaaggcgcgaggaaaatagtacaggctggttttgggaacaagggacgtggtggagagcaaggccacgctaagccaacacgacctccacggcatgagtaaaacatagttgcaccaaccgtcaggcattcatttcggatggtttctcacgaggacatgagagatctcatagggtgtgtttggtcgctcttgcagcgaacatggaagagagtctcctatataacacttcgagggccatatgccatgtagaagcaccgtgactgctcttagggcaggagcaatacaacacacgcaatcacgcatagcgtgtctctagccctcctgaagatgcgagattggtccaaggccagcattttcacagtgtaggcgcgattttggatgcgacacgaggagacgaggagacgaaggcacaactgtgaaaccttgggtgtgtttagttcacgttaaaattggaagtttggttgaaattggaacgatgtgacggaaaagttagaagtttgtgtgggtagaaaagttttgatgtgatggaaaagttggaagtttgaagaaagagtctggaactaaacaaggcccttttagcttgctaagcgtgaaatgtcagatatgactatccctcaaaattcttcgcgggcattttgccactattgagggaattcaggcccaaatttctgaacgagagttcagcccaggggtggatctacaggagaagagccggtgtcagacgataccgacgactttcggcaaaaactatagcgaaactgcttatccatatgctataacatcatgatctaaatataattagcatactatgacaccgataagcacgttctgacaccaacaaatcgattttctggatccgccactgcttcagcctatacgttttccttgaacatttgatcagctcctccaccactgggctctcgtttccacatgtgcttgaccagccgaaaggcgagactgtctttggcagtttcagcgttgcaaaaacacaaatgtttcagtttcagaaacgaacccaatcgatcccccctactactgcagttgctcacacacccacaccccgactgcacacgtcgcctcgcctcgtctgcgtctgcgtctgcgtctgcgtctccgtctccaacccaggcggcgtatgggaaggagaaggaaggagagatcgcgcggcgcgctggctgtcgctgtcgccgtcgcgcaggctcgtccacctcgcgaaatcgtgagctcgcgcgccgctccgggcatgcagggcgccacgccgggcgatgccgctggagaggaggtgggaggcggcggggacgtggtgatggtgaggcgggcgagcgtggcggcgtgcctgacctgcccgctctgcggccgcctcctccgggacgccaccaccatctcggagtgcctccacacctgtgagtccccctcctccaccctgctccgctcacagtccccacgctttctcgccccgcgcgctggggaggtcgtccccacgcgtcaaatctgcacatttgcgcggtgattcggggtgggtttttgaggtgacgcatggaaggtggcagtttccgccgttccatgagctatttctgcgtgggcttatttttttttccccgttggtgcgtcaaaggtgggatgattttcatcgttcgttcgcgaaataggaatttggttgtgccatttccgtggggttttgaggtggtgcgtgaatatctctcgatgtcggcatgtcgaggagggcctagcttgtgattcctgggttcgttgctcatcagctcatgtgttctacggggatttgggatgaggctatcaggccagtggaagtgatcggttgcggtggacttttgtgcggtgacgaattacgtttgcccagaaaggggcgcacgctacttatttaataatatttaatttcatgatgatctatttcttcgatgcgaggattagaaaacttgtcaggcaaatatacaaaaaaagattaatgaaatttatgaagagagtaggaaggtcctccctattttcatcaggaagaaaaggggcaagaggatgtgtaaaaggtggcacttttggttagtgtagtgtatgccattttttttttattgtcaggtgcttaaatgcatgaagcaaaggttgcatacacatcgttttttattgtcaggggacttcattctttgaaacatgttgagtggccttgttataaacaataactagttactgttcattcttggaaacatgcttagttctttttctttctagtttgttgaaatatcgtaactgtgccattgtatggatgcttggcatgtaatactgatcgaatgatgggtgagctcattaggaagttaggcaaccaaatatatagataatctagtattctgtattcggttggtccttcttatttctaagttattctggaataagagaggagaaaaatcctaatgtgggcacactgattcattccatattttttatgactcttgcaacgtattcataaagcaatagtattggagtaacaactctacccagtgtccaaccaaaattttgtaaatttggggagtcttactgccaacagctgccaatagaaacacttgatctgttaccagttaattcttgtaatatcgtgcttcaaccattgatttatacctttaaccagtctgcagaaagtgtatacatgaggagttcgtcgataaggagtcctgctgctgccctacttgcaacattgatctggggtgtgctccgttggagaaactcaggtttgtctttgtcactgtttccctgaaatattttatctacactattgcatacttctgaggcttaaaaccattgttcagttattgtattattttcttttctatgtcatgcccccaatttgatattgcgatttcaatgcagcgcatgtacatacacctaagaagttagtgacatttgggagttgggagagttttttctttaccacctctgctctcttgcatgtacaaatgagatagtcttctgtgagcaatcatccttcctccatcaatataacaactattgtgtcctgcttttttgatattattatgcatacaacactatgttcttcctcaattgccagtgataatcgtgattttgcaataccagcctagtgctgtgccactgttctgtttgcatcacatggactgttataacatcataataatctccatctgttcaatcttggcttggatggtcttaaagactttataattgttttgtttttgctcggtttattttaatgattagttgtttgttcgttacaagttataacttcgaaaggggtgagatgagcccaaacttagttcacacgatcacaccttgattaatctttagccgcttgataccgagttatcagcagcatataacaaacaagttttactttccctttttgtgatattgtagcttatggtattttcaattgtgttttgttcagagttgatcacagtatgcaattcgtaaggtcaaggatatttcctttcaaacgaaggaaggttgagaacccagaaatcatttgtccagttgcgtcacctgtcaagaggaaagaaagatcactatcttcacttacaatccctgctcctcaggtgtctatacagaaatgtttgacaaagaggagaacgaaagcttcgtgcttacgcaactttcctttggtatgtagttctcttgtaatagttcccctgagaatcggatgtgtgaagaattctaatttcttatctgtaaatccactattagaattgttcaaatgaatgtgactctgcatcaccagaatgctgtaagcaaccctataggttaggtcataccatgtatttccattgttttagtgccatagagccatctacatggtatgccagctattgtcgtattattgcagctggcacaatcacagatgtgtgctaggtaacagttcttggcactgtccgcatgtgttattggtatgctaaaggttgtgatagtcaacatgtgaatatttacgggctaatacataacaaatggttatctgaatcttctgaatttatttatagtccaggcgacattaatgatagatgcacaatacttttattttgccttcaaaactcaaatagtttcctacaaattgaggcaatccatagaaatttcatactccaaatacctttgttccaaagacatataggaaagtttcgttaggattgaaattcttcaaaaatcctccaaataccttttgttgcaaaggagatgttatgcatgaattaaatgcaaccgatgcccctcccctccaaattctaaatcgatgcgatttttattgctgttgtgtagagtatttttttctggtctgattttaatgaataaattttcttttccccgccttgtgatgtagcattctacctcgaggggcagtaaagatacatcaaagaaacttgggggttggagaccattgggttgtcaacttaagcttggcaaagacaaaaaatctctcaaatcaagtgtaaaagatacaaacagaaccaaaagtaagtctggtgatacagatgatggtgctcctgctagtaaagcaaaggctagagaaccctttacaagatatgggcgtgcagctaagaggactggaagaaagaaattgctcatgttgaagaacaaaaagaaaaggttcaaggcaaagcagcccagtaaaaagaggagattccgagcactatggttttatctacttgctgcttttgaccagtgagaaacactagacttgtcttgtgagatttgtgccgtttcttcaaaggaaaagcagaaatcatgctttgtgtttgtaattatttcaggagaggagtaccaactttaccacaactaccagcaaagtatttgaggatcaagtgagttatttggttgcacttttctagtcaaaacagtatttgttaagccacactaacaactgccttttgttatatttgtcaaagggatgttgatttgcctgcttctattatacagaagtaccttgcacagaaacttaacctctcaagtgaaactgaggtatgtctttacatatttctttcttgtagtgatcatcaaaaccagtctgttttttgtgccagtatccagattagttagaatcagcagtgagaaagaattccatcaatatttggctttcctgccagggacaagactggctaactggagctaaaatctcacaatctaaacatagttagatgtagttatggcacattcttagctgttctttggaggaaaacaacttacttcatgattatatttgaaaaggcaagaaaattcaccatactgtttccaattggtgcttgattgaaggctgaagctgaccggtgttcagttgattttgtgctgtagatacttttgccactttgttttgcgcataaccacgtttgtctttgcaatgaacaacataactgttcgctgcttcaagtttcatggtgctgcttgacacttgcaacatgtgaaattattaccctatattgacaaaagttgacagaacattctgctcattgcacagcctattttcttctgctctcaccaacgagtcgtggttgcaggtagaagtgttgtgtggtggcaaagtagtgaaccaagggatgacactgcatgatctagcagattgctggcttgagaaaggaccaaagagccgaatgcgctcatcggtaggctccccggccactggattcatggtgacattgttctatagaaggccagatgtggatgtgtcctcatccccagctccaccccaacctgacactgaaagttgccatagctgatgcagagctttgcttcgtttctgaaccatctgtgattggcttcactcattgggctgtcagcccttgattgatctgcgaatcggttccaatttgtgtgaggctcaagccacaccaattcactaatatgtagataaatgctactaattttacaagccatgttgggcttctgatcatctaccttcttcaaccattattttccttttttttctcttcaaccattgtacctaggtatgtgatctgtaatgagatgttaatcgttaagtatcagttgttagagctagggacttcatgttgtctccacgtagctagtagtactagattatgcttgtgtatttgaatttgctggtgcattcatcatgcatgtatatatataagctctggaattccttgtagttaactggatgttaagctgagaatgtataagctctagattatcagtttaccactccatgcgtgatgaaacgtgctactgcttactctgttcccaaatataaataacttgaaattgtttaccagagatcaaggtttgaaaagaaaatgctacagtgtttcttattaaggccgagtttagttacaaacttttttttttcaaacttccaacttttccatcacatcaaaactttcttacacacataaactttcaacttttctttcacatcgttccaatttcaaccaaacttcgaattttagcatgaactaaacacgccctaagtggagagtggttagggctcattcgggatgtaggttgaacgaacacagtgattggaaaaaaaataggaatgtgataggaatacatgtacaaaacatatgatttgaatatacataaatttcgtaggaacagatggctaggtgaatacacagtacagggtgtgtttagttcacgccaaaattggaagtttggttgaaattgaaacgatatgatggaaaagttgaaagtttgtgtgtataggaaagttttgatgtgatggaaaagttggaagtttgaagaaaaagtttggaattaaacttggccacaatctaattaacgcaatataaattcattttgtatttcattctcttctttttctgcttattattattaccccctatgtttcaaaatgtttgacaccgttgactttttagcacgtgtgg

SEQ ID NO: 27956 - DNA, 1674 bp, Oryza sativa
cccaaaaactcaaatcccccgcctttttgtcccctccgtttccccttccacttccacccccacgtggcttaacttggcctcctctccccctccaaaccccaccaccacagagaaaaccccagggagaaggacaagggctccacataccaacggcggccctcctcctagactagctcccgccggtaatcccctctccccctcctcgcgctgcttcgattgcttggttcgcgtggcgcgattgcgcgtgcggtggtgggttttggttggtagttttgtctctgccttggttgcttgtgggggttcgtcgctgatcgtggtgtcgtgggaagagctgatcgcggtcgcgtgatgcggtgtgtctgcggcgtctcggtcggctcgcgtccggcttcacgctgtgttgttttctgacgcgatcgtacattcgccgagattttttttttgggtgtatcggcgtggtgggtgaggcggcgattttgttcgtctgctccgtatcatcttcgatcgcttgttccactgctgatgctgtgcgcgagcgtgtcctctatttcgtctgtgcgaatgtggatgagtccatttgagtttttggtgccatttttttcatgctccgagtagcatggcgctttgatggttaatgcggctggttttgttgtgcaggggttgcgaactcggcgatggatcagtgacccgccgtggtgaagcctgcagattctacctataaggtatatcgccccacccctcttcctcggatttactagtagctgaattgttgttgactggtgaatgataatcgagcggaagctgttcaggattttgcactgctgcttgttatgctctgtgtggccctctagtaatgtggctttcattaaatcagtggttgctgcaccactgttgaaaatgcattgcactatttacacattcaacaatctatgtggtataatactaatgagaataaagtgtttattacattattccattatctaaataaattatttaattttagtgcactgtagtacgttacacattcagcaatctatgtggggttgttaacttagcgcatttgtgtttgcacatgggaatgggatcaacttgtgttgtacactagtataactgtagcttccttatggagcctagctcaatatgctatagaaaccgtctgctgaaactaataggattctccaagaaggagatgatgcggtgatggtgtgttgctgttattattttctttttgtaaactgtttttgatgtcatacaaacttcttgatgtacttgctaaactcttgagttttgcattttggttcctatatttgttttgaacttctaattgaaatgcctgcttgattccaaatttacaggggagctatggcgaaaagtccacgttctgttgttaccacaggtcttcttctgtctactttgtaactgcttatctcactttcacataacatctcatgcatttatgatttaactaagttttagtcagatcgtaaggcagtttatgcagtgtagcttacagcttatttttaccattgtgagttactgaattcaactagagccacacacatatataattatatgcctgcatatatcactcataatcacttggagttatcatgtttgatcttgcttgcaatctagaatcttgcaatagctttctacatatacatgcttgacagt

SEQ ID NO: 27957 - DNA, 12335 bp, Oryza sativa
  unsure (1)..(12335): unsure at all n locations
gattttgcactgctgcttgttatgctctgtgtggccctctagtaatgtggctttcattaaatcagtggttgctgcaccactgttgaaaatgcattgcactatttacacattcaacaatctatgtggtataatactaatgagaataaagtgtttattacattattccattatctaaataaattatttaattttagtgcactgtagtacgttacacattcagcaatctatgtggggttgttaacttagcgcatttgtgtttgcacatgggaatgggatcaacttgtgttgtacactagtataactgtagcttccttatggagcctagctcaatatgctatagaaaccgtctgctgaaactaataggattctccaagaaggagatgatgcggtgatggtgtgttgctgttattattttctttttgtaaactgtttttgatgtcatacaaacttcttgatgtacttgctaaactcttgagttttgcattttggttcctatatttgttttgaacttctaattgaaatgcctgcttgattccaaatttacaggggagctatggcgaaaagtccacgttctgttgttaccacaggtcttcttctgtctactttgtaactgcttatctcactttcacataacatctcatgcatttatgatttaactaagttttagtcagatcgtaaggcagtttatgcagtgtagcttacagcttatttttaccattgtgagttactgaattcaactagagccacacacatatataattatatgcctgcatatatcactcataatcacttggagttatcatgtttgatcttgcttgcaatctagaatcttgcaatagctttctacatatacatgcttgacagttataagtaagatgctgatgttgatttacttgtttatatttttaacgtgcttggttcatctgatggatacatgcttgtatggtatccaattatttcaaattgtaatataaccaacaccattttgtctctcaggaacaaaaaggcgtagagcaaaggttcataaagaagatgagcctgttgagaatgaaaacttggagagtgaatttgatgtttccaagaaagagagcaatggtgccactgaacctggtaatgagcctgttgccagcaagagaccgaagagagcagctgcctgttctaacttcaaagagaagtcattggacttatcagaaaaagattcaattatcacaatcaaggaaagtcgggttgaagagaaggaaatagaggctgttaatttgacaaggacgggacctgaagatggtcaaccttgcagaaaaatcatcgatttcatcttacatgatggagatggtaatctgcaaccctttgaaatgtctgaagttgatgacattttcataacagctcttatcatgcccttggatgatgatctggaaaaggataggggaaagggaatatgttgttcggggtttggacgaattgaaaactgggcgatttctggctatgatgaaggtgctgcagtaatttgggtctcaacagaaacatcagattacaaatgtgtgaagccagcaagcagttacagatcttattttgaacactttagtgagaaggcacgtgtctgtgttgaagtctataagaagttagctagatcagttggtggaaatcctcaggtggacttagaagaattaattgctggtgttgtccgttccattaattcaaacagaagcttcaacggaacagtaaccaaagactttgtgatctcctctggtgagttcatatataaacagcttattggattagaccatacagctggcaatgatgatgagatgttggccacactgccagttcttgttgcactgaaagatgaatgtaaatcaagagcaggattcacacatttgccagctatgccctcgaatggaactctgaggattaaggatgggcaagacaagggactgactgaggatgaggatgcaaaattagcaagactgttgcaggaagaggaagaatggaaaatgatgaagcagagaggcaagcgtggaacttcacagaaaaatatctacatcaagatttgtgaaactgaaattgccaacgactacccacttccagcctactataaaccatataaccaagaaatggatgagtacatatttgatagtgatattggtatgtattctgatgatgtacctgtaagaatccttgacaactgggctctatacaattcagattccagactcatttctttggagctcatccctatgaaagctggtgcagaaaatgatattgtggtatttggatctggttttatgagagaggatgatggtagttgctgttcaacagctgagctagcacagttacattcttcctcaagtaaatctggccgggaagatccaggagttccaatttatttgagcccaattaaagagtgggttgtagaatttggtggttcaatgatctgcataaccattcgaactgacgttgcttggtaaataccctggcagttctattttctttttgtattaccattatctccaaggggtaccatattttagctttgttagtcttgatcattgccagctcatgatggaaaaataaactcaatgcatttcggataacatatcttacacacacacacacacacacacgaatttggcattttgtttgaagcatggaattttgcaaccatgttgtgtttaccttctctctaatttacatctggtaatcaattcaggtacaaattacgccagccaacaaagcaatatgctccatggtgtgagcctgtgctgaaaacagcaaggctagctgttagtatcatcacccttttaaaagagcaaagtcgcgcttcaaagctttcttttgctgaagttatcaagaaagtagcagaatttgacagtagacaccctgcatttatatcatcgaaagcaccaaccgttgaaagatatgtcgtggtgcatggacagataatacttcagcagtttgcagactttccagatgaatctgtcaaacggtgtgccttcatcacaggtcttctagcaaagatggaggaaagtaggcacacaaagttggccatcaagaaaaaatctcaacagatgagaggggagaatctgaacccaagcgcaaaaatgggtccaatactgagaaagaagcttatgcgtgctacaactacaatgttgatcagcaagatatggggtgaatactatgccacttatttccctggggatacaaaggaagaagatcagaatgaaccaaaggaaattgatgatgatcaagaagaaaatgaagacaatgatgctgaagaggaggtaaatgttcaagatgagaaggccacaaggactccaccatcaacacggtctagaaagtcgtcagcagatactcgcaaggaaatcaaatgggaaggtcaaacagctggaaaaacagtgtctggagaagttctgtacaaatgtgttattgttcaagacctcagtatttctgttggtgcgacagtcacaacagaggatgattcaggagaaaccatcatgtgttttgttgagtatatgtatgagaaacttgatggtaaaaatatgattcatgggataattctgcaagaaggttcacagactgttcttggcaatgctgcaaatgatagagaggttttcttgactaatgactgtttagaatttgaagcaagtgacatcaaagagttggtgactgttaatatccaatcactgccttggggccacaagtacagaaaagagaattctgaagctaagagaattgaaaaggccaaggcagaggagaggaaaaggaagggcctgccagtggaatatatttgcaaaagcttatactggcctgagaaaggtggattcttctcccttccgtatgataaaattggaaatggcacaggcatctgtagctcctgtgagagaaaaccagttggcaatgaattcaagttactttctgagagcagctttgtctttgagaatattacgtataacatccatgactttctgtatatcaggcctgaatttttctcccaaggggagggccatgagacctacaaggctggaaggaatgtgggtctaaaaccttatgcagtctgccatctgctgagtgttcatggtcctgctggatcaaggaaagctaatccagaatcgacaaaagtgaaagtaagaaggttttaccgacctgatgacatttcatcaacaaaagcctactcatcagacatccgagaggtttgccttttttccatcatctgcatcattggcaatactgtgatttcacctaaacctatcttttttggcctttggtatttgattgttgtgtactttgtgatttgatccaggtgtactacagtgaagatataataagtgtacctgtggtgatgatagagggaaaatgtgaggttcgactgaaggatgaccttccaaattcagatcttccagcggtggttgaacatgtcttttgttgtgaatatttatatgatcctgctaatggagctctcaaacaggtcagctactgccaaatttttcttcagaatccctagttatctgcattgtttccactgggagatgtctttgtattattgaccgagcttgtcttgcatgatctttaaccagctaccgcccaatgttagacttgtgacactgacaaggaaggtacctgcttcaaaaaagaacaaaggaaagcaaatttgtgacattgagctaggtggttcagacaaaccaaaggatgggcaatcagagaactgtcttgcaacacttgacatttttgctggttgtggaggtttatctgaaggattgcagcgatcaggtatgctttgctcatgtagatgttgcttcataggaacattttgactccagttaccttctgaccattggattgtacaggattgtcacttactaaatgggctattgaatatgaagaacctgctggggatgcatttggtgaaaaccatccagaagctgcagtatttgtcgaaaactgcaatgtgattctgaagtacgccatttttgtttaccctctttgatatgcttatcatgtatatgtaaattgtatcttcagcacgtatctctatacgatcatgcagggcaattatggacaagtgtggtgattctgatgattgcatctccacttctgaggctgctgaacgagcagctaaactttctgaggacaagattaagaatctgcccgtgcctggcgaagtagaattcataaatggtggccctccgtgtcaggtcagttgctatgtggcttttgcctgtataccagggagctcctaacaacacattcgacattgcaagccaattgcttgaccttttgacctatccttttttagggtttttctgggatgaacagattcaatcaaagtccctggagcaaagtccagtgcgagatgatcttagcattcctgtcatttgcggagtatttccgtcctagattctttctcttagaaaatgttaggaactttgtctcgttcaacaaaggacagaccttcagattgacactggcatcactcctggagatgggataccaggtgcttgacacttcctcttcacttgtgcttgtgctatagcatttccatttctgtatacattctaaccttgtttacatgttcttaggtccgatttggaattttagaggcaggggcttatggtgttgcgcagtccaggaaaagggcattcatttgggccgctgcacctggagagactcttccagagtggcctgaaccaatgcacgtctttgctagccctgagctgaaaataactctacctgatggcaagttctacgccgctgtcaagagcaccgctgcaggagcccctttccgctcaattacagttcgagatacaattggggatctaccagctgtggaaaatggcgccggcaaaccaacaattcaggtataccctacatatcgcactagcttcactcgccaagttctcctgttcttaagctgccgctttatgtcagttgaataaactttgtatgatgtgctacagtacggaagcggtcctgtgtcttggttccagaagaagattagaagcgacatggcttcactgaatgaccacatatctaaagagatgaatgagctgaacctcataagatgcaagcacattccaaagcgcccaggttgcgactggcatgacctgccagatgaaaaggtactaacatttggccctctaattaacttctcctgcctcctgttttatttttaaactctgtaaacaccaattactgttcattgactgtgcaagtacaggtgaagctgtccacagggcagatggtggacttgatcccttggtgcttgcccaacacagccaaaaggcacaatcagtggaaaggactgtacggtaggttggactgggagggcaatttccccacttctgtaacggatcctcagccaatggggaaggtcggcatgtgcttccatcctgagcaggacaggatcattactgtccgtgaatgtgctcgatcccaggtacacataccaattttcacaccccatacattcactgctgcaacaggttaatgatgcttaactaatcatcaagtcattgactaacccaaacaaacaaattttcaggaagttttatccttcaaagtaaatttagtactacattttgtctcaatcagcactgtagcagtagatttagttctttaaccataaatcaatggatatattgtcatctctcttttcggcagaactgctttgtccattccttcttgaacctgttcaaacatgcattcattctaccgagatgccattattgcatctgcaactttgttgccctttttctgaatcttctgatctgtttctgaatcttctgatctgttcctacatgacactgtcaccattgtatgcacgcagggcttccccgatagctaccgtttcgctggcaacatccagaacaagcacaggcagatcgggaatgccgtgccaccgccccttgcctatgccctcgggaggaagctcaagcaagccatcgacgccaagcgttgagtggcttttaacttcactgcatcgccctcattttttggtcggtccaaataggtttaactaagcattacagttttctatattttgtgagcaattggactcctaaaattaattctgggatggttacatggattaccttttgtatatctaacttgctggtaggactctgataccatcaagatattggttcatagaactatagaagttcagaagagaatcatagcactgggggggggggggatagaaagcttttgtaaacagtacaactcttattaatatgactgcaatatgatgaggattagcataatcagaattaattctcgttttccagagttgtgtattggcaaactggcaatatcagcttttgtgctaggcaaacatgtccctgcttcaaggtcagttgccacttgataatatacagctttcttacacagctaattttttcaaaataaatccttttcttgacctgttggtttattcatatgaacattcgatgtattgcattttgatcttgatgttatgttcagttcacaacttgatttttctttctttctttttattttgagaagggaaggatggatggcttacagttaggcaggctgacaattttcctccaaagcaacttgaaatcatcataatcagcccaaaaaattcacccaaatgagcatactacatcaaacaaatgtaaaactcccttgaaaaatgaaaacgaaaattctatacacaacattgcaagctacagaaatccaagaacacaagcacaagatcagaatcacatcaagaatcctcttagaagaagaaaaaaaaacaccttcgtctcatctcatttcagtgtgttgatgcttcttcatcttgggagcgcgtagccgccataggagctccccatgaaggacgatccgtcgtacgcgtccctctcgtcgaggtacacgttcatccggaacgcggcgtgcgcgccgatggcggcggcggcgaggacgagcgagacgagcaggttgaggccggcgcgggagagcgcgacggcgaggacggtggcgacggagagggcggcgagcacgacgcggtcgtcgacctcgcggcccatgcaggcgagcggcggctcgccgtcgccgcggccgaagtagaggccgagccaggcggcgaaaagcgcgaggaaggcgagcatggagaccgggcggtagacgaggccgaggaagacgagcacgagcgccggagcgcgtagttggcgcggaagtaggctaggtttcgccgcgcccgcgccctcgcctccccgcagctctccgggcgcgagaacgccgtcgcgtcgagcacctccctccacgccctcggcctccccgccgcggcgcccgccaccgaccttgcccgcgagaagaacgccaccccggccttcgccgccgtcgcgggcgacggcgagggcgccgacgtcgccgtctacccgtccccgcccaccaccacctcctcgcgcttcaggggaggcgccgccgccgccgccgccggcgggacggtgccgtagcgcgaccatgaggcggtggaggcggccatggcgaaggcgaaccctaggctgcgatcggagtggatctaggaggccgcggattctagctggaggagacgaggaggggaaatgatttggaagctgtttttttttctttgaataaagaactaaagatccaaattgcaattggggatttgcgagttggagggggtttatttatttaaggagtagctcgatcggcatcaagtgggaaagtggcttgttgttgttgtatcgtcggcagatgaaatcgggcggaattaatgtgtgcttcaagtgcgatggaccgtgaatgtgtctatcaagaggacatatggcgtgttagcgttgagcatctactcatgtcacatgcaacaccatgtctcttagaaagccgggtttcaaaattctatattttcttaaagttaataaaaaccttattgatctcaatcaattatattaaggtgataaaattactccgagaacactttctatctctgcatagctaaaatgcacataaccaaaacatacacccacacaacaaaagaaagagatcatatggagtattaaggatcataaaaaattatgtatttaaaaagtgttcaataaatcggtcaattcttttaataaaaaaattaacatagtaacattacttttttaattatgtcggtttttgtcgtgaaatcacttaggagctataattgttcggtggtcgcgttcacatcttgtgaaagattcgtgtctctcaaattctagttaaagtttactcatataaatttcatatagaacaatttaattttccataggaacaggaaaaaccgtagcatacgaaatagtactaggaccttgtctgtttttcgtcgagttgttgtcaagcctatatcatcacagtgcatttgctaacgaggatctgaacactcattccatacacaccgaatatccaaggcatcactcttagtacacaccacgaaatgcctcaaaaattatccacaggaatcctattttctccaggcaatataaacagttaaacacgttgtggcattttatatttttttcagcacagtttgtttgcttgacagcgccaatcatgtccggccatggcaccctaatgttgggtgattccggacaagagagaaacgtccaccaccactaccattttggattttgtacacttgcacgttgaactgatcttcatctttcccgtgtcccaaccgatgtaccaacacacatccatccatccagatctctgcagatcagattggacagcagcaacagaagaagggatcgaggcacgcttttcgcagcctcatcacgccgcgaaatgggcgaggatgacacacacaccatgtgcgtgccggccccgtcacccaaacgccgtccaaagagatgtagaaagacggccccgagcccacgatgctatagtaatactttgaccatttgtttaatagatgacgctgttgattttttctcatatgtttgaccatttatcttatttaaaaattttacgtaattataatttattttgttatgagttgttttatcactcatagtactttaagtgtgatttatatcttttacatttacataaaatttttgaataagatgaatggtcaaacatgtgaaaaaaagtcaacggcgtcatctattaaaaaatggagggagtactgctcctttcgtccaaaaatataatactccatctgttctaaattaatgatctctttaagatttatcacaatagagtaatacttgttccctcaatcacttttaattcaaaaatttctcttttctaccctcaatcatcctctcacatccaaccacacataatttaacaaaggacggtataatttctttcttaaaccttaatccatactaaacactttagaacgacatctaacatggaacgaggtagtacttatttttctcatcaaaactaaggagtaattaacccatctaccatgtaacaaaagcaatgaacggtagtattgtatacacatgtatcatgtatgtaatcaataagtagtagtaaaataacttcttgggttccaatcaacaatttaatttagcacataaaaattacaaatatatcttaaacttttgaaaaaaccaagaaataaaatagatattgtacttttggatagagagattaacaaaccatgcaaaacgtgccgagatcgcttgtcattttttttggttcaaaaggctgcctcgacttgttcgccgctgatacttcaaattttggggtatttatcgtgattttctaatctcaattacaagctcacacgtctagccatacatagtgatatacttaatactccctccgtaggaacatataagtactcatagagattaaggatgaaaagaaaaaaaatacgatgtctcttttaaaactatagggtttgggaaagttgggcgatgattgatggtaagattatttagtaaaaaaataaaatagaaggtaggtggtaggtgaagtaatacctataaatatttgtattcgccgttaaatattaaaacctctaaaatgtcaaaatgcttatatttaaaatcagggtagtctaacaagaaaatgtcgtctagtaggccagccgaaaaccctaggtgtttctcaaattgagacacattccaagttaacatatgagcttcactattcgaatcctgaacttgatactattcgaatcctgaacttgatgacaaaaatcaacaaaccctagagaatttgaccttacattaatctactggacttcttcaaattgttaaccacttcaagacaatcagaaacaaccttacgccgtcggaatccagagtctaaagccgacgaaattgcctcattgcaagccaaatcaggattcagtgaacttatttgcatgaaagccaaatttgggcctttttgcttgcctgcgttttattgggctccaaattttctacagcacatctccaagcctctcaggccttttctggccaacgctcaaatctcggcctaatctctaaaagatgggccgtaatttcggccttccaaaacgacctcgaagtttattgaacagaaagttgaaagttaaggtccgttcagattgtagccaaaataaacctagcaagatggtaatattatcaaaattttgacatgatttcttatttatttagcaaatttagcaacaaactaaacgtagatatttttttgataactttgctaaaaaaatggtatggttgaaaatgacgtcaaagtgaacagatccttattttaattgaactattcgtactaagataagctgtattgttcaacaaattaatgggagacctacactttgattgattgttattgtatcctacaacgtgtaagtgctctatgttttttttcctccactacctggggtatatttatgggttcaaattatgccatgtattcaatcatatcatcagttaaaaggaggttggcttcgataaaaaaaatggagaatttcatatggaattgtttgtgactgacactggtggagatgacggctggaatcgaacagcaagccgatgatatagtatttccaccaaacaaaaacaaatgaaatttctgttgacttccaaaatgttgatccattcatctgccagtgagctggcaaaaaaaatacagccaaagcgacttattcaattcagtttttatttctcccaaaaataatgccttactgaattttagtgtctaagacttgcagtcataatcctataaataaaacagctataatggtttttaaaggaaaatgtttatgagctcatcaacttctttcaagtccctgtacttgataatgagcataaaatacttgaaactgcagaaagtaannnnnnnnnnnnnnnnnnnnnnnnnnnnnnnnnnnnnnnnnnnnnnnnnnnnnnnnnnnnnnn

SEQ ID NO: 27958 - DNA, 7590 bp, Oryza sativa
  unsure (1)..(7590): unsure at all n locations
nnnnnnnnnnnnnnnnnnnnnnnnnnnnnnnnnnnntagagaaatctgtttcatccaatcttacaaagctccttttttttttcttttttcattttcttggtcaaatttgttcttcatctttgatcaattcagttactatttactacctatgatctgctcatttctgctagaattcattgatttctcagctgaaaaacactcactgttccattgcaacaccaagggtgcttgaattttactcggttttcgccatggatggggtggaggaggcgaacatggcggcggtggagagctcgaagaagctcgtggccatcctgtccaagtccggcgacccgttccggctgatggcggccgtcgcggagaccgacgaggcggtgtcaaggttcggcaaggtggtcaccatcctcagcaacagggtcggccatgcgagggcgaggcttggcaagaggaggagctcgccgccggttgatccgggctgcctcatggaccacccgttggcggcggcggcgagctctcctgctcccagcaatggccgcctccatttcagtagtagtgctgctactgcgtcgccgtctccggcaacggcggcggcggcttcctccgccgcgaacgtcacgccggcggtggttgaccggagcttgtttcttgagacgacgctcttggatttgaacagtcgcggcgctcctgctccagctgcatccatggcggcggctgccaagaacagctcgaagcttgcacctgcacccatggtgaacagctcctcctccgcaaatcacatccagttccagcagccgatgaagagctttcagttcgagcagacgccgatcagcgacaagttccacatcgagatgccgagaggcgtcggcggcggcggagggaaggaggtgatcagcttcagcttcgacaactcggtgtgcacctcgtcggcggcgacctccttcttcacctccatcagcagccagctcatcagcatgtccgacgccgccaccaactccgccgcggctgcggcggcgccgacgaccaagaagccgtcgtcgtgcgccaggaaggccaccgccgacgacgacgccggcggcaaatgccattgcccaaagaagaagtccgtgtcaatctcgccaccgtttctcggccatttctgccatgatcttgaccgtgttcttgcttccgatttcttcgcaggaaacccagggagaagaaggtggtcaccgtgccggcgatcagcgacaaggtcgccgatataccttcggacaattattcttggagaaaatatggtcagaaaccaatcaaaggctctcctcatccaaggtagtaaatctcactactaagaacaattaatcatctcaaaattcagtcatagcttcataatactcgttcatctcagttactgctactgatcaacttctttgcaattccaattactatgatcagtttcaacttaagacaagaataaccatctcattatcatctttaaaagacaatagctaatgatcaacttatctgtcatgcctattaatacggccacttccaactgatctgcaatctgtaccctgtactctgcttaatcatgatcaaatgttcagatgaaaaaaattagacaaatttgatgagattgattgtgtttgggtttgatgcaggggatactacaggtgcagcagcaagaaggattgcccggcgaggaagcacgtcgagaggtgtcgcagcgacccggcgatgctgctcgtcacctacgagaacgaacacaaccacgcgcagccgctcgatctctccgtagtgcagcaagccaccgctaatccccagacctgatgatccttagcttaatcaccatccgtgtatctatcagcatcactgcaaatgcaaatgcaaatgcaaatataggattctggaaatctgaacttgtccatgaacagctacttggtaatatcaaatttgtgactagcttgttatgtttgatcatgtacgagtagtagctctaaaaacgtataaatgcggacgctcatataaaagtgcacactcacaattatgaacacacatacatatatacagattaacgaagccaccaaatacgtctatcatgtttaagtcttaacagtttctaccacatcaaaaccagctgagttacgctcagttcgcactcactgatttctctttctggaagttgcaacgcacaattcgtcaattcctagtgtgtctctttccgtctgatgtgtagatgtcaagcatgagtgtggttcgaggggaatgaacagatctaaactgctgaatcattgcaaattctagatgcaaacatcaatgattagtgtggctaattgcatttcgtttctgagagatcaacgtgcggttaagcgcgtttcttgggcccttattgtactctgccaccaaccgattcatgtgatctgtttgttactgatgagtcacgataacactgacacttcggtgttttgagaaatgtgtttttctgccgattcctagagaaaacgaaccgtttctcgtcaaattcttgcaaattttatttgaaacttaacccttaaccgaattataaatgtagatagctggatactatcgcattctgaataatacaacggtgctgggtggttgcatggcaagcattggatagccttaatctaatttgcccaatagacttctatatttttttcaatacaggttatacagcatatagattataaaaaaaaacacaagtgaatcacattgcagccgcaaaccggccctaaatagctagattaatatccaaatcaagatactaaacacttgctcatgctaaattccaaccctagatcaactaggttcatcatgtgaggtgatctacctggagctgcttatgacacccacaagagaaactagctggaaacattgacaaaatccaatttaattccatccaggcatggtgttttcacagatgaaacatatatattcagttaaacaaaaagcagatgacagagatgctaatctgtctcgatcagtctctgacaaaaccacatgaagggaaatcaaatcaacaaagtcattaaggcattaaatgcacctcccacaaagagcgccgataattagtggtgctaagcatgtgcacccgtgcaacttagcttatcaattggcaggactgatcgagctggccaaacaattatttcggctaggattaagcttaattatattttagttgtttgtttaactggaactcgtgcgtgctcatgtgattgattttctgcgagctcaaatctcttccagggtgaacaaatctaaatctagccttgttaaataggagtacttatatatcagacaagttcagagctaatgcgacgtccatatgggcttcgaaatatgattagttgatgtgttccttaatgttctttatttagctcagttgctttaccctcgactttttatgccttgattaccttgatgagaagcatatgggcttcgaaatatgattagttgatgtgttctgtgcttaatgttctttatttagcttagttgctttaccctcaacattttatgccttgattaccttgatgagaactgctcagatatgaacttgctcaggatataaactgtgcctatatacggtatagcaacaatcatggcctttggacaatttgaaatgggccttcatattatgcttacacccaagtttcagcatgttttccagtgtatcagtgcaagaattgagtgttcttgataaatttttgcaacccttaggcctacagtacgttgcagttgcagatccgagagcgaacaagcacgatcttcaggacaagctaataagggcatgtttttcacagctcaagaacaatcttcaggacaagctactaagggcatggttggcacagtttcacagaaaaggagtaaaggaagtgctctcagaaaatgaattggcatagctctagctccagcctcacctgtcctgaagctggaacccaaccaaaagaaacggtttcagctccaccaaaaaaaaagggttaagtagactggggtgctctagattcagagagctccacaactgcactccaaacacaacttcaagattaaacttaagagttgaaatcctaccaaccaagccctcaagtaaattctatccaccagaatcattggttcatgccataggtaggttaacacctcatcatcagggatgacagaacactggttcagttcaacggatgataattgcaatagaaataacatgtttggatataacttcaaaatatctggggaaataacatcagattaaccaaggttcaaaaagtggctgctcggtggacacgctattaataaagtactttggagttccttgttcgacagctcaagctacatactggaagcgcaaacagctgcagatgatctctcacttgagagggataaaccgtgaggagtgggtagcaccaataccaggcctaccgtgcttgactggcttgtacgagatggagaactctgcgaggtagtggccaatcatctcaggcttgatctcaacctggttgaaggtcttgccgttgtagacaccgacgatgcttccgatcatctcaggcacaatgatcatgttcctgaggtgggtcctcacaggctctggcttctcaccagcaggtgcatcctttttctgtttgcaagaattttacaagagaacagaagattagcaacctactagttaagtttgcgtgcaaagcgaacataaagacaagatgattgtctgaaaaatggcataaaagaaccagtaaaggcagagaggattggaggaaacaaaaaaaaaagaatgcactaatagaactcaatataccccacactcatacaagcttcacccagatactttgctgaaccagccagagagtaaaaagaccagagttagctaaattttttaatctaccagcaagaaccacattctagcaaaaatatccacaaaagcaacagttcttatatagactttatacatcacacctacataactcactacaaagtaacttccagcttcatagaaacctagtctgaagacagtaccttcaaaattactgccctgatagaataacgacacgccaactaacatttttcagaaccaaaagggtaaaaagactaactaagctagcaagcatggaaatgtgagacccaaatagcaaggaaacagtaataaatactccctccgttccatattactttttggattgaaatttgacagtttatagaaacatgttttccacaacaccaaactagtttcatcaagtccaccatttcccaaaacatgtctatagtatatttgctttgttttgggaatattgctaattttttctacaaacccaacacatcctgtaatatatagaacaaagggagtacaccgcgacaaataacctaaaaccccatgatttggtggtattaataattcactaagaaaatatcagaaaccagactttgtggagtgcaggaaaaaaataaagcagacaagccagaacaattaatgtgaaaacaatacgtaacacaaaaatactgcgttcctccaactgacaaactaaaaacaaaaaaaatacccacagcataacctataataaaactgagacactaaaaattgtggcaaaactactgccaacatgttaagttgccacaaacaagctctgggtagatttaaagcactggaatgaaccatgttataggtttcaacatttccagtgcaaatacacaaaacaaattaatgtcagcgcattaacagaaagtgaataataaatatatacaaatcatatatcaaacatgtaaccaaaaaaagtgttgttctgcatcagttattcattgctaaatgctaaaagcaagtccagaggcatacattatggtaaataacaattccaacctctaaagactgcatcaaatcagccttacatttccaaaggcaaatttgcattgaattgtaaaacctaaatgccgacccaccacagcattcttttgagcgagtgcagtattaaaacaggcagttagtagcactacggtacgaaatctaaagagacgcacaatcaagttacagatccccaaaatataaaaatagcaagataaatacttaacacataagatctgtatcgattccacattttaacaaactttccatcaactcagaacaaatgactgatgagtatatcaacactcaccgccttgcggagcttcttgatgagcgccatgggcttcctcttcaggcccctctggaacctatcgaaaccaaaaggcacacaacacatcagatcaaagccacccaaccacaaacaattgcaagcattccagcgacgattcaaccttctgcgggcgcgcgcggggaagagctggacgaggtcgtcggtggacatgtcgaggagcgcgtcgaggtccacgccgcggtagctgtacttgcggaacgtcctcttcttcggcgctccggccgcggccacctccgcctcgacctcgacatccgcctaccaccaccacccaaaaaaaaaaaaaacaccaccacgcgcggcgtcaggcatcacgagcgaacgcgccgacacgcggctagggttgcgggagaggcggcgactcaccattgttgaaggggttggggagagctggagctcgaggcgaggggtcggaggcgcgagctgcttggatgaggaggaggagacggcggcggcggcggttagggtttgggggaagagctctcggaagcttatatagtggttggtggtgcgcgtcaagggctgtttgagtgggctaggcccacgtgttccggcccggcctggcctggcccatttcgacgctgtaacgaggccttccgctgcaagcctgcagactcgggcccagagtgaacgctgccgctcgtggtcagcggcgttgtgttgacattttgcttttctatttgaaaaaagaagacgaattgcatggtttgctttgtgcactggacggttgcgtcagctagattccgtactttaaaatactgtgtaaatggatggattaacatccaatccggttacttgcagaaaagaaagttgcgaccctggtttcacaataccagcagattcaatctcttgactatggtatgtatgcaaaatagtatattatggataagtggatttttatatgaaacagtgcagtccaggtagaattcatgtgtagaccatcgttccaaatctggcatggatgtgaatggcgtggaaatggatgctaggttcctcttaccatttttggcgtggtaaccacgagataaaccgtggttttaaaaattgaaaagattaccgtgcatggtaaccgcgataactgcgcggttttgtaaaccctgtttaggtctcaaattcagcatcgctttctaaccgttgccagcacctccaacaagccctatgtccgctcctcgtcttgctcattaaaagagcgtcgggtctgactttaggttggatcctttctctccagttgccactagcacagccaccaagcttgtcattgtcgtactagctagagccaccttccaatccacatggttcgatttaggcctataaaccgacgatttagcagccactgcccctaaggtcattggcactaccatgccgaaaagcaccgccacaatagtcatcaccctcaacgtcacacaatcagatatggatgaaaagt

SEQ ID NO: 27959 - DNA, 28291 bp, Oryza sativa
  unsure (1)..(28291): unsure at all n locations
tgtatcctaaaactgtcatatgcaactaatttggtcacaaccgagaccgaattgagtgatctcgattattttctaatgtaatctggtcttcagtttcggataatcaaaacttcctaaaagacgaaagaccaaccccaagatgatgctatcagctatccattgtcagtagcagatccaggaacttttctaagcctgagaagcatgacgacggataacaagtatatgcaaagattatccacatatgcaatgtttatatatagaacacacacgagagaagatgtgctcgcaattgatgccactgttactgcatgatgtcgaaccatccgttgaatgaaccaaaatgggcctcattaggcacaacgcgtccagactcgatcatctgccaagctaatgccagcttgtgcgctagcttgttttcctgtgaaacccatggatttgcctatagcatcaccggtggagcaaagcaaaagctccatagctatccggtgctgttgggccctaattctacccttgtccactaccacgacacaagtttatcgatttatcccatgaaaaacacaacacatcgaggcctagaggttggcgatgggtgggcgacgggaaaggcaggcgacgccagtaatggagtggcggaggaagaggagtgaagtcttttatccactcatatggatgtccaccatgggccgggttagatgtcacgcgaatgcactaagattggtgcgtacacatatactccctctgtactcataaaggaagtcgtttaggacaatgtttaagtcaaaccttgggaatataaatcatgaataactctcaagttgttgagtttgaaaatgtaaaaattatatgaatagatttgttttgaaaaatactttcataaaagtatacatatatcacttttcaataaatatttttatagaaacaagaaattaaagttgtgttttggagaccgtgtcgctgtcctaaatgacttcctttatgagtatggagggagtactccacacgaggaagatgccatgcactcggcggtcgtgggtgctagccccgatcctcagagtcctctacttgttttattttagataatgaattttcattaatccggtctctatatccatgaagaatatactcggccaaaaaaataataatacaagtgcacttagactcataccttaacaagaggagaacacacaactaagagaaaaaattacaaccctggcaaacacatgtttccagacatacttttatgaaacggccaaatttgacgagtgaaagtcatctagacgctgctgcctctagtgcatcttcgttgtgaacagttggtaccatcttcatctgtttcgggtgagctgatgccatgcgccaccggatagcccatctttatctgtcgtcatccaatcagaactagcctgacgagacgcgagtcgacgggatacactttcgctttattagattgctaggtctccgctgcccatagggccgtcactgtcgtaaggatcctcttctgcctcccagactcccagcccgccaccacccctagggccgccacctctgctagagtccacatatttttgtcgaaatctcagtcctccaccactgtcgctgaggataacctcttccaccaggaatcccatgcctccgccgcccttagggttgccaccgctaatgggatccacctctgcctcttcctccccaagaaccttgtgccaacgcacaggccaccgccaccgccgccaaggagatcctttccgcctgtcttggggaggtccccactgcctgtgggactacctccgcctaaaccaccttctccatgccgaggattggccgtcaaagctcaggccgctgccgtcctccgccacccctgccatcggtcgaaggggcgccgctgccgactcctcgctagtcgccgctacccgtcgccctcccaccacttccgctgtcgtcaccaacaaccacagccaagcgtaggcttggtcgcctccgccgtccatgctctccttcgcaccgctctaaccaagcagcaacgaccaggacgagaaggcacatatccaagtgagggaacgccagatctggcctcatcagctcgtgtcgcgcctcgccgactgccacaatgcctgtatctttcagaaggaattttaccatcattgatacctcctagtacctgccagtacactatgtatctgaaccatccgtttgatttgatctaacggttcataaagaccggtaccaggaggtactgcctagtgagaaacgaaggttggttcaagtactaactgtgaaagggcagctatgtaattggagtaagaacttatctctcccatccctctctgttctctcttccctaccgaccaaacagcccgtggtggctctcgttgaggtcatggccgatggaaggggccatctatacgagaagaggatgatggtgtccaagtcgtctgatgttgcaaggggcttcatgtcacctcccgctagagatccaagtgccatgatgtcctctttatctcttccacctgatccatctcacccgcctgcaaatggaggccaagcaataagttgccctagtgagctcccttacatgcaacgagctactacccccatagtatccacagttatctgaatccgaatgtagcaacaaccatgctaaaaaacgatgattcggcagatatctctttcttgtaataacgctatagtagtctcttttacttgatataatataatcagctctgttgcgcaaaaaggaatatgagaatttaccgcctccttaaaatttttataaatctattgtaaaccacatatccaaaatcacatccaagattgtagtaccaagcgataacgacataacatatataggccacataaatacataatataagcaataacatgagtcactaacatgtaggcccattaaatatatggtccatatcggcagctcaaaattagaggttcgcactgtagaaaatctgttcacggacacgtgtcgaaagttagaggattgtaccgtagaaaatccgtttacggacacgtgtcaagtgtcgaccacaacatatgtacagtcatcgtgccattggtagcaacgctagcagcagtcctatgaacacgacatggaccggtagcaaaccgagcaaacggtgtagtactacatatatgtcgttctccctgccaaaagcaacacgtagtcacattgctgcagttgccctaatgccgcgatcagatgcaatgcaaaccagcccccgaaaaaaaaagttacaaaccaaagtatatcccagataggagtacgtcgcaagctgaatggacatttacatttctgggtaacatagaatacagatagcttaatcatcatgttcgttcgatgtcgctggaccctgttactgaaagcggcctcttccaaaaaaaaaaaaaaagaactttcgatcgaagcgtgcagcttcaattgctcattttgctcgacgagaagagaaaaaaaatggagattggaacgatgtattatgagtatccgcgaccacgagcgctgcgacatgcttcgaaatggcccctttgacatcgcgtgtgcaggagccttttacgtgcagatggggttcaccaagtgtgtagtaattaatttcggtactgaattccgaatccataaggaagaatttaaagaaactaaccctcacaaggaacagcaatatagtattcagatagattttccagcaaggagccagcagcagctcgtcaattacaggctaaattatggctttattatgctgcatctttaactaattaccaagtgcctctctgtacttttgctcttcgtcatcgtctaataatgaccaacaggagcagaaaaaaggagagaaatatcccatgctctgtagatgatgcatatataaacctgagagataataataaaggagtagttcttcttttgctcacagccactcgccttcactgcaggtgatgctatcggctatatcccactgtcacggttgcaaaaactttcctgcgacgaaaacacgaccttttccggtttaaagatgcgaattttctcgctcagattggtgataatttaactttctcgtcgcaaaacgagattgttaatttgcgcgtgcagtagcatcagtttgagctgatttggccgtaattgcagccgaattttgggcatatttgtatcacatattttaggacatacatgtttgtgtgtgcagttcagttgctgctgtttgggcgatggatttgagatgctaaaaatgggtttaagttcgggagaaacacgacgaagtgagggtgcccaggtagaaaagctagggtggtttggaacgcggtcaacctcatgtttagtgctgtcctcgctagcagccaattcatatcccgtgcagtacaaaactaaattcacaattcgaaataattcatccttgaattccatcatatcagcgagtgaaattcatatttagcaccatggcgatagtcagatggccaaccataggtttcgtgaattaaaccacagcatatcatacgggtgagctgatggtacacctgtattgccctaataccatcttgctgtatatctgttcatcgatcttgatccaaatatgatttaaccaactcgaatctgcagatcaagataaggtttatttggttttgaaaacgccaagaaatgagtctatccatatgcgtgtccagttcttggtcgcccagacccacgatgaaccgagaccatgcagctaaccgatcctgggttcggtagacaaacaagtttcgaacaggtttgagttttttctgaacttgatgtccatctttgacacgttggaaacatcggtttgatttcattttgaagcaaaagtttacaattcgttagacgttctatgtgttggaattccaatttgaccagctcatgccaacacataagaggagtactgcaccttgtgcctactttgacctcttcctgcgcaaatcgattcgtcaggacagtaacgaaatctctcaaaaagttcaaaccaactcgtaattccatcacgaatccgacgcagaattcaaactgcggtgagaaaccgacggataaatatgagcaaaatttggatacatgaagaacaggcaaactcgtatcacctggtaggcagctatgctttccccaacggcagcaacgagcttttgattactcccgtgcagattaatccggtttccgacgtgctaatgcaaatgcagctgcagggtcgccgccgagatgaccggagccaccggcggaggccatttctccggcgagacggccggcggccgcgccgccgcgggggccaaacccggggcgaactcgcacaccggcggcgagagtgctccgagggtgtgtcagttgcgccgcgttcaatccggccgtagaccatcgaaacggcggcggatcggcgaggttccaggctcgccggattcccctgctagcctgctacatcttgaccccggctagccgggatgttcgccggagcaccaccgctcgccggccggaaatcccctccaaactcacacaaatccgccgcccagaccagtccggctttgccgatcaatatctcccagaatacccaaccaaatcgaacaaatttacactcgtttgaaagccatgctccgtgcctacaatctggaaaaaaacccattcaaattggtcgatccaattcggagaaaatcgggtgcaaatccggaggagaagcacacttctggatgggtggggatgaggccgggcggccaatccaacttgaggggggcagcaatccgtggcacgggatgaggggtgcacacgaccgttggatgggttcggatcgggcgggtgagattcaatgtggggcgcgtggggtggcgatccgtggggaggccgtttcggccaatcagagcgcggcgttggcgtctccccgtcatcgcgaggcatcccactatataaccaccgattcctccgccccgacctcctcacccacccaccggcgagcagctgctccgacaagcgctctctctctctctcaactccggcgaggctcacgcgcgctccgaagcttcggatagcggcagtagtcagtgcattgatggcgaccgacgtggcagcgactgagcccgaggtggcggcggaggaggctgcggccgccgcgcctgagaccacggccaccgccggggattccaagccggcgaaggaggccaaggccaagaaggccgccgcgccgaggaaggcacgctccaccgccacccacccgccgtacgccgaggtaagctttgattcgttgctgctgtttgctgtgtgttctgtggctggatctgacgtggtggttggtcggtgctcgtgcagatgatctcggaggcgatcgcgacgctgaaggagaggaccgggtcgagccagtacgcgatcggcaagttcctcgaggacaagcacaaggaccacctgccatccaacttccgcaagcagctgctcgtccagatcaagaagctcgtcgccgccggcaagctgaccaaggtcaagaactcctacaagttgccgccgacgcgcgcgccggccgcggccaagcccaaggcgaagcccgccgccgccgcaaagccgaagccgaagccgaaggccgcagctaagcccaaggcggctgccaagccgaaggccaaggctccagccaagtccaaggccgccgcgaagcctaaggcggctgccaagccagccgcgaagccgaaggcggcggctaagcccaagtctccggctaagccagccgccaagcccaaggctgcccccaaggctaaagccaagccggccgcgaagccgaaagccaaggcggctcccaagccgaaggcggcagccgtgacgaagacgaaggcgacctcggctcccgcccggaggccggcgaaggcggcgaagacgtcagccaaggacacgcccagcaagaaggcggcgccggcggccaagaagcccgccgccgcggcgaagaaggcgcccgccaagaaggccgcgccggcgaagaaggcggccgctccggcgaggaaggtgcccgcccggaaggcgaagaagtagagctctctctccggcgagcgagcaatctagggcttcatggttgttttcttagctgtttttttttctcttctctttgttgttagttgcgaggaggggtcaggggtactagcttgtaaatttgatatcgcggcgggggtacactggtcatttcgtacccaggtggtggtgcgcgacgatgatgacgacgacgacgagacagtttgtttttagggcaatgtatttctgagtagattggtggagtttttattgtggtaacaatcttgtgatatttgtcgaaatcactttagctaagtaattaattatgcagtaattttacttactgtattggcttgaccacaccctgtattcctctgaattttcagatctggaaattgaaatgaaatataggatttgtgacttggcgtgtgatttgggttcaaaacaagcatgttattgcaccgatcgtacgctgttccaaatttcaggtcgcgtgtggtaccgaactattgttcactttatgagctgtaaaaaaataaattcggtcttaaatctggatgtatctgttgtcaaatttgaatattcaatcaatgcaagtatccaaactgatattaggccccactaatttcgcttatccatttggtttatgggccttcctagtgttatcgggctttgaaacttcaaaaggcccgggcaaatttgaaacttcgagaagagagagagacgcttgtgggctgggctgcctgacaggtagcatacgtggccagccgtttcgttggacacgtggcagtctcgtcctaacggacacacgtggatgccatggacgccgcgggaggccgcctcgatttttgaaaaattgtccggaaatgtaggggtcggaaagtaagattcgctgtacataaccgccagtgtccagtgacctggaactatttggatgcgcgctccgtttggtttgaatttttttttttcacttttgaccctcttccgggcttctgctactttctctgtcctttgctttctctcttgcaagttgtgaaacttgcaattgcaatgctgctctctgtgaccttctctgctactctctcccgctgtctggcttggcctaggaggatcaacggtgtggccttttggctggcacacagaaacttgcttgttccgttaaccaaaacaagccgtttgcgtgcgtgttcgttcaatcccatgttggcattcacaggcttgtttgtttcatagcgatttttaggctatgcctcccgacacggaaaacaaaacacacgattgtagcgagattaattaagtattagccaaaaatacttaaaaaatatattaatatgatttttttaaagtaactttcatataaaaaaacttttgcaaaaaatacaccgtctagcggtttgaaaaacgtatgcgcagaaaacgcgggaagtgggttaggaaagatgggataataacagagccttatacctgtttattttcgttttgttttttttttttgcaaatggtaaggatgtggactagtaagtgatatttttttggcatttattaattatttttgcatggttagattttttttctctctccctaccacactcctgccgtacctgtatatttcatgtgactgcatctttcgtagcagtaacctttttgttatctcatgccagtagccagtgtatatctacatgactaatgaaaatattgtaggtgtaatgtgaatactcaatggctgtaagcagggtttcatttaccgccggggccgcggttaccgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaaacgcggtaaccgcggtaaccgcgcggtttaccgcggtaaatgcaaccctggctgtaagcctgtaacgcctaacgaccaaggcaatctaaatctaaagaaaaggttcagaacaaatggcccagtccagaccatccattggcaaagccatctttacacatcatctcccagcccaccaagcaactggcccgttaggccgtcacctctgtccaggcctccaacccaaccacaggcctagcagtagccagatcaggtttgtttgacagaacttcaactctaaatttaacttgaaaagctggtttagagtggagtcgtggagcagttaaaacacaacttcattatttttgtgagatcactctctagctccgcttccaatcagtgatgctgaaactattggttgagctaactacaagagaggtagagctgaagctagagctctgctaaattgaccctttattaatcctagtagtcactagtcaacggaagaaaaatgcttagccaatggctaatactcccttagtgacagcacgttacatatcgaaagcacttttggtatccttaattttgcggctaattcggtcggcgtgaaaggcctacggcggcgcctaatgccagacacacgtacgcgtgctgacatatagagtacatgataattaaactattaatatgatattaaaccactcttcgtttggaaatctcaaatcctgctttatgagacttcatctgtaagctctacaagatgatctcgaaacctgatttacttggagaaagataaagcgctaattggatttggtatcaagatatcatgatacagatgcattagctacccttttgcttacatgcatgaagggctgcctttcgtgctaatcaaagaagatacaccatcatctaaggtttttattatctctcttaagatgattatgttagacaacactactgtagaaaaatcattatatactaatacttctatcacatacgtcttttagtcagtgacacatgcgactaaagtaaattagctaggcttatatgttagtgacttaaagacttaaagttatatagtgacttaagtcaaaggattcttgtcagttttttctactactctgtaataatgtatcctgatggagattatttttgcagctctcattttatagcagtgcaggattgaatccttttgttaattagtaggcactcactgatcactaatcgtcactgctatatgtgtactactaatgtaggagtacatcggttagttgttggtgattagaatttagaagtagagcactctaccaaacacgtcgtggacccaaccaaacagcggcattaaaatgcttgatcactctggaaaaaccggccaatcgagaggtgagctgctgtgaggccaacggttgaccagccgaattgtcaggtagaagcatccgatgttagagctaagggtgtggtgtgacaggtcgcctccacattgtctccccagctatgaggttttggatcttctatgccaattattgcaaaggttcattgtatcagtgctgctatcactcacctaaattttatgtattagccttgacagtatgtagataacatgttgaatggtaaatatgagggatcaaattgacactatatatttgaatagcattctgggtgtgttcggctgcaagtttctaacagctgctgaactgcatgcgtgtatgcggctgcggcgcacagccaaattgcactagccacagctgcaactgcagccgaaaaatggctgccgaacacaccctctatagtttgctagccatgtctcctgcatttagacaattagccgtataacaaaataaccaattcataagagccgtatttgtatgatagaaatttcttgaattcgccttttggtgacatcgagttcatcaaaagaaattcaacacaaaccaaacaaaatatcagatcgaatagggtagcttcattttctcgaaatgcaaaatactatattatatatgtattagcataaattaaaaatgtccaacgatgaacatttctctgcgataaaaacatgtgaatgttgcagagcataacctgtgcttttttgctggcacaaagaggagaggagcccttgatgccaacgcctcatttaagcaaaagacaatcttgatcccggaccaatcaaatcatcaagccaagaaaaatggttgatgctcagcctaacttgtcaactggtttttcagagagagaacatggatggatagtggatttcttattgattgttgatcccacgtgaatagatagtagaggaaaggtaccaaagagaaaggtaggtttaaacacatctgtgatgtggtatttcttagcgttggtaatctaaaataagtgtaattttacaccgttcatacccaacgtttgattgttcgtcttatttaatttttttttacgattagtatttttattagtattagatgataaaacatgaatagtaatatatgcgtgactaatttcttttaattttttttataaatttttgaaataagacagacgatcaaacattggacacggatacctacagctgcacttattttagaacggaggtagcatgtactctagagtagtactataattttttgagctatagtactgtggctgtgtttagatcaaagttaactttggatccaaacttctaactttttctatcatattaatatctcatacacacaattttttagtcacgtcataccaatttcaaccaaaacttccaactctagaagcaactaaccacagcctgtattagtttttcttacattttttcagctgataaattttgattttgaacggcaccgaacgcagcaaatggcatatgaatctgtgaccgtgagctgggttccaccacttacacgtgggccctcccccctcgcccacgcacacggcacacctggggactctgaagaaactctcggcccctaccctctcgcacgagggagccacgcacattttcacacttcactctctgtctatatatttgtctcgngcgccgcgccgcgcccctcggaaagggtggtggtgggtgagcggcgagcctaaccgggccactggcggcgccacgggaggcgttccggcaagcggaggggaagggggcatccgagcgctgggggaggtagcttatcgggaacgggaacgggcgatcccccccggcggcttcctccccggtctctcctgtagctagctagctagccatgccgcgaaatggaagggtggtgccaacccgccggcccggagccggtgggatctgacgaacaagggtgccgaaagcatgtaatggcagtggcaccagctgcatttcggtttgtttgtttattatttttttttttttttgggggggggggggggtttggctcgtggtgtgccgatgttcatggagcaatgttggtgccggagttcatcttccagctgggctgctggatctgctcgatttgtgcttggtttatgcgagtttttggtgatttcagatgggttttttccccttggtctacacggggcagctagggtttcgttacctggagaagatagattggccttagatactgttgttgttgttgttgttgctggtataaatctcaatacggtagggtgggagacggatttctgtaagaaatgagcttttccggaggcaaacgaaagagggatttcaatattaactagtggaataaaaaaaaattccctgttgggaaggaaggatggggtagatttataggcatatcatgcattattgtcaaggtcattgcagtgaatttatgtgtgaactcgtattttaatgactcaacctttcttcttcttgagcatgctgatccattcaaggataactgtgagaaatttctgatgaatatgactttgaactttcctgcccaatttcatatgtcctgtgtcacatccctgatacatttttaattgcagctgctgattctaagattttgagacattgcctgactcttagtgggcttgctgttaggattgtgctggttgactttgtgtggagatatcttatgatctgctgatgcacaattgtgatatggccattttttatgcaaagctttcgacttttgtttagattctttgttatccgtattagctatacttttatttttccagggtaatttagttttaagtgttcaaatcggaagcactgaggctgagagaaatgctgactagtttatgtacttacatacctaaaaagccttctgtgtatgtgcaatattagataatctgtgtgggcatcaacttttgtactatttaggttacaagccttatttttgcaggaatgcactaaatgctcctgttctgtagttattgtttctgcatgacctgagtactttagtgtttctatatattgtgtagttgcttgcatgctatttgtggtgaataacttatgaggttgtacttttgttataattgtggttaatgtactttaatccttgcagtccaatggtgaaagaggctgtggaaatgtccacagacgaagaatcagacggtgtcgttatatgtccaccagatggcaacaatgatgatcgagaggaagccattagtagtaataatcatgataattgccaggaaggcgaagtcacttgtgttaaagacccggttatagacagtgaaacccaggaagacaagtgtgtgaaccaagattcagttaagttgatagatcaagagaagtctggtccacccaaatcaccatctaaacctggcatttctgggtcagataggtccaaacgtactgttcctcaaccatttgccctttcttctcaaagaaaatctcatggaggaaatagtaaggcggctcatccatctggcaatggagaaaattctggtgataagagcaactcctctccagcaagtttgacaaagaaggtatgactattgtcatatatacagtattatccatatatcatgatgctaccaatatcatttgactcttgttctggtttttattattgcttaccattttatgtttctttttattttttgtattctcaccctaaatcatatcatgtatcttagtactgcctaggttgtctcactgagtatatcatgttcaaggctctaagctgcctttagatatcaaatttattagattgatgagccccattatatgttgaaggtttgttttgcaagtaaacatcgtaagcttgttctgtgaagtgtgcctaaacctatttggtggcatacctgtcttcttagtaccagactaccagttgatgtatctatttgcctgaaaatgttatgttgtaagcctaccagagatagctggttctgttgacacaactgataattattgcagactgcaccgattactcccaagaagattgcacagcctgatcatatgcttcaccatcaagaggaggactcctgctctgtgacttcttcgtatccttcttctatctaataaaaatacaccgtgtttctattttttttgggttgtactgtgatgatgttttctgcctttatttcttgtgaagatgtttctaaaatattgcatgagaaaattcatttcacataatgatcagatatttggttttcaattctagagtgatgactggaaaaaaaatcgatgttaaaaatgattagttctgttaaccttaattggttttcagttgatttgatattattctttgtagtgaaaacattgccaaggtgatgttctttctactcattgtttgaaactattgtatacaatttggcccctttttttttcctgagctgtgtaaagaaccacaacttcaacaagagctggcaaaaccaaggcaactgttggtgttgccccttcatttgtatgtgctgatcgtgctgacaagagaaaggaggtgaatatgtagtttgattgcattatttcaagatggcctcttaaatgtgtttgttatttacaaatagcgatggcattttcttttctctaaaaatagctggtgctcatagtgattgctgtttcttcagttctacacaaaattagaagagaaacacaaggccttggaagctgagaagaatgaggccgaggcccggaaaaaggtatgaatttccttgtgggggagaattgaattgtaggatacttaagttttgtttggtctgtgctattttactgggtctgttaaacatggttttaattcggtaatagctaaatttactctacgcttctgtgattctccttaattaatgcttatgaaatatttgtctcaacattcttcgcccagattcagccattatctctttttttttcatataatatattttggttcttagatatatcatggagagaggagtaatacaacgcctaagatttatgtgctaggcagaacatttgaatatgatactttttgttgcccaaatctttctataagatgttcatgttgatggacaactcctggcaactatttatttaccaatttacctcaacattcatgttcatttttttttgtgtaggaagagcaagaaacagccttaaaacaactaagaaagtccttagtcatcagggcaaagcccatgccaagcttctaccaagaaggacctcctccaaaggctgaacttaagaaggtagttctgaatttctgatgttttgtgtttcttttggaaacatgtacttgtgattgtcagtcttggcaatgtggagatatattgctaacttctaggaggagattgttggttcactggaatgagaggagtccttaatttacttattttcactgaacaacatatttgccattttgcccaaaatgccaaaactagttagatgtacagtgataacacaagaaagctacatttgagaaagcttttccttctttacaaggaatatatacaaatctatattatttcttgcatcatgtatcttaagcacagttttaatttccataattgatgattctactggtgggcaatatgacattcacttgtctttgttctttgaaggtccctccaactcgtgctaaatcaccaaagtttacaaggaggaggagctgcagtgatgcaccgccgacgccagaggcagcaaataccaccgcagcatctagtcgatcacatcgtcacagcattgcgaaccctaaagatgctaacagagtacaatgctcaccaaaaaatggcgtcgctgccaaaactagagctgtcaaacctgtgagctgaaggccctctggagattctagatcagccaagtgttgcgaatgtcgctgtacaaacctaactttagccgtctctcggtttcatggcattttgcatttgatttatacttcctgtcaccaaaagaaggccacagtgccgaggccggtgtgcttgcagctgaaccctttcatttcttttcttcttttcgcgttgctgtgtaagaactctgttgctgggaccatgtactgtgttccttgttgtaaatggtcgagggtttctgtcagaactcagaaggaagacactctgcccttttaaagcccttgatgaaccgttgcaatgttttgcttgatatttacctgggtttgcagatcctctagcattctagatccctgtcaaaattctatgctcccatcctgtgaagcgtttggttcatggtgtaattatcatttgccctaaatcaaatttaacaaggtgggggtcatttcattacacagctgacggctcatcgtctgcaacatttgagagatgaacgaatgaattttctgagtattgccgtatcggatagacagattttaccatgaggtggagtgatttaatttaatttaaccaatagctagtcgttattggcatcatttttgatgaaaattttatgacaattttcttgtctagataatgctcaggagtcgctgacacatcgatcggaggccgcttaagaggataatctaatctgacgaagttataataaccaaatcgggcccacgcgccagcgtcaagagtgcaaagttttacctgtgttgggtccggccggtgtgctggacatttcagccactactgtcaccaaacctggctactggggtacttaactgtccatgatcaccatatttttcccccaaagaatataatcatgccaactttagctctccttgcaaaatgtaaatctaccgacatgtttcattttaaatttgatcgttacctgtttgaactgcatgaattttcagttgaaatggaccaatatcaatatttccagggttgatattgttaaaggggagatgaagtataactgacgcaaggcatacattgtttgcagctaaacagccttttctgcttgctatttaattcataaaacaaaggaaatgataaagaaaataaaactagatgcgaaatatgacctctttttagttggaaactgtgaaagctatctgtttcagattgaaaagaaaagatcaacattaacatgtctcttcttttattcccttcaatcttctgttctcttccagcctgtaatgacgagttctgagaggctccccatctcgaattcatgctccatttgacaactctttctatgccctttttattttttttttgataaagaatgtagttattgatgcaaagtaaatttcttattttatgatttgtctattggtacctttggtagttgacgagtagtgctgcaaggacaaggaaaaggggagatctgaggagcagtttcttctttcctcattcctctctcctaccctagaacaagaaatgatccttgatcccttctaaaattcagacgcaggtatgctagatgagtcattttatttctcttcctttagtcaccgaggcaattggagaattcttgtttagtttgatttgctttacatttccgactagattttgttctgtgaacatgggaggcttgggctatgcaatgggttcctcatgtgggttttttgtgctaatttttgtagatgattttgaaagttaaaattgtccgcattcttgctatcttgcctgcttactggaagttggtcataattcgtccgtaattttggaccgttcagagttgtaagttgtggaaatagtacaagataatttactgaaattttactttgggaaatttgatattgaggaaattctcttgttctgctgcacagctgcaaccctaattcttgctaaaacccttgaccctgattctctctacaaaatggtagtttactgggatatatcaatctttagccgaactttttagtgatataacctcatactttgctgctctcatgcaaaatattatctttcaggaaatataaattcagtgacaaattttcatccaaaattgacattaatggctccaagaactagtactgttataacctggagatatcagcagctctttgttgtactatcttcagtaatcctggaatgggttttgatgcttcttctgctttttgaggggctactatcctatctcgttacgacattcgcaagcctttgcaagctccaccctccatgcccaatgtgcacaaggctagatcatgtctttggcatggcgcaaccaggcttctaccgtgaccttatgtgcaattctcacaaggcagaagcatcatcatgggcattctgccacattcaccaaaagcttgtagatgtccacagcatgtgtgagtcctgccttctttcatttgccaccaacaagaagtcgaaccttgcgacataccggtccctggcggggaagctcggtgtcggcatcggcaatgaaggtttcaggcctagcttcagtttggacaattcatctgaagcatcagttatcaaggaagatattactaatattttgtgttcatgttgctcaagcccattgaaagtgaaatcatatccttctatggttcttcagaacatagctagtgccattgacactgaggtgaatactagacatgtctcaagagatcagcttattgaggagatcagtcttgtcaggtatagtgagctgaagacttctgactctgaatcagagccctggcaacatggtggtgttgctagcttgctggatgatgcagttgataatttgaaggaagattttactttgagccatccaaaaacaaaatttgcaggtgttattcctacagatgacattgcacaggatcaagtggctaagaactctgacttgatacaactccagaatggtggttctgacagtaagaattctcaagtttcagcagagttgtaccacttcagagctgatggcaatgcagatcttcagtcaactgacttttccagcaaaactgttcagcatcctaccgaagattcagacacaacaggtttgcactatcctctccaaatgttaaaaaaaaaaacattgttggattaactattcacttgcttagagtattgacactggtttttcttttcttaagtagataaatctgaagatgatgtttggcacaatgctcttgattccatcagtgaattatcagtgactgataagcctgccgaaaccagtaccgcggagaatgaaccgaaagctgaatttaccgatagaactgcaatgaaggattctttcaaagctcatgaagatctgcagttactgttgtcacaagtttctccaaatgatgccatcaatatccctggtgtacaagagcaagccatactgaacaatatcactagagcactctctcttgacaggaattattcaggtagtatttctgagagcatggccattgatgaagctgaagaacattgtacagttgatcaactgaagaagcaaatcgaattggaccggaagtcgataagtcttctctggaaagagctagaagaagagaggaatgcttcagccattgccacaaaccaaaccatgtccatgatcaccaggctacaagaagagaaagcagcaatgcagatggaaaccttgcagtatcagaggatgatggaagagcaaagccagtacgaccgtgaggatcttcagaagatggctgccatggtgcaagagctcgaagccgagatcgaaggctacaagaccaagctgagagaccaatcgctcgttaacgagatacgcgacgcgatgcgcatttcacgttcagaggaatgtgagactagcatgtcaagaacagctcgatcgctctcattgttcgaagacgagaaggcgtatatatcaaaacacctgaagaaactaagacagaatctccaccaattctcaaacaacggcaagttcatcgacccgaaaaagattgacgacaaagaagacacatttgatgtcacaaacagtgaggatgtataccaagatgctgatgaagattcagaaatgaccaattcagagaattcagagatgaccaatgtgataagaaatggtcgcaacttcaggtacttatctaatggtacagagggattgacaaatggtaaagatgatcctgagggtcagtactatgcaatggtcagtgagaatgacttggttaattttgaagatgagatctctgaactcactgcaaagctgaaggcactggaagaagatcgtagcttcctagagcacagcataaactcgctgagaaatggccaagaaggcaaggagctgatccatggcatcgcttgcagcctcagagagctccggaagatggggatcacttggaaggattgtgattagctgaagcttcatcagaggatacacgtttgacagaggtaatgcagattcagttaggtagaagttcacaagtactgatctatataaattcatggcacattatacaatgattgttccttaattgatttctttatctctctcatgattgacatggatcacttatcatctcaatggcctcttattatttatctgttagcttatcagtcgcacagacaaaatttaaaatttcaaacttaatttatttacagttgattttcgagtctttcgtcgtagtctatttttcacctctgacttttaaacaactaacatcatgaatatagaagttttacacataaattatttttagttgattcttcttttttttacaatttatcagctgtagcttgaccgatcacttatcatctctaattgacagttgaccacgtggctgcaggatgtaaactgtaaagagtgatggattaagctgctgactgtatatgtgctaatgtgcatgtgcacacggcggttgctgtcatgtcatgcggtggtggtaggttttgggccgttgcaagtgcgccgtgctcttcgcgtggagtgttccttgtacaaatgcagtgtggattttttgagtgctcagaattgaccaatatgcatacacaccttttctcagtgcttgcttaatttgcagttttgcacatctttcatgtatttctttttatacttttaagtgggattgtcagcttgtctgtatatattgtcaaacaatccagcatttcatctcgacaagtcgacgacaggttgagtcaatcaggccaaaatgtcaaagaatcgactgcaaaaatttgctcatgcattgcatcgttaaacctttttcttttgtgattgtaccgatgacgcatacgcacacacaccactaacacacgctcaaagagacggaggcgaagacattatacatgccagttgtttcctgggtcctgtttttatttttctttcttggggctttttgcccttcgacagtataatgttgttttgaaaccgactcgatttggttggctttcttttctcgttcttggttggatgaggtgcttccctggctgctgcgacattgtaatgtcgttgtaacatttttaccgtattttttcctctaaattttattgaaattggtcggccaacctttggttggcccggtagaaaaaaaacgactcgactttctctcttaatacaattcggttggtcgattttcggctgaccgggcataccatcttgtcgaaacttaattttggcatgcagctaaggtagccggctagccgcaccggtcggtttcagcgcgtgtgacacgcagattcaggctacagatcgaagagctctgaagtctctgaatctgacactcacgctgaccagattaaccgaaagagagcaatgtgttaggcgagttgcatgatccaatcgatcgatccaattctacctgataaacaagcggccacgcgtacgtaacgtacatctctctttctctcaggtggactccaaatctatctccaattggcctagcttccaaagtgcgtgcatagcttaccgtttctctgaaaactcttgccgacaacgtcttctcttccagcttcaatcccactgacaatcacacacacgacaatgcacgcacgcgcacaacgatgagagagaaattagagagatggatagagagagagagagagagagattgacacgtgagaaaaggaaaggaatgagaattcaccacgcattacattagtttccttgctgtttcttctcgctctgaagaagaagaagaagatttgctgaattagtcgcatcctgtggagtgttcgtccagcatccaagggaatgatcggctgctagcgatagtcaaaccacgatccaattacgtctctctcatttccaaatgaggcacgctcgatcgtgcattcatgtgcccgtacacctgcgtgcgtgtatatatatacacgcacaagaactgaagaacacaacaaaaaaggcactgcaaatcttgttcagataacagcaagtatatattcagattgttcatagttcatttattgttcataattcagataacagcaagtatatatatacagatacagatagttcatagtcgattgatcgatcgaccatgaggcatgttactttcttcgcggcggttcttgttgccatcttcctcacctccggtggcgggaggatgagcagcacggcggcgcggccgacggcggtgggcggcgccggcgcgccgccggccgccgtggcggtggagctggccggcaccggcaccggcaccaacgcgtcgtcgcagccgtcgaactgcacctacggcaacaacgtcggcggccagtgccctcccactcccggcgctggccattagcaagagcagtgcacgtcgctgccatcaaatcgtgcagctgagctgcgtaattacgattagatattgtattaatcttgtgaatttttttttcatccgatcatgtagtattaatctttcctgtagcttgaaggtgattgcatgatcaattgagtctgtaattctgttggtttggttgtatttttttttaacttttttaggtaaaaagtcgggtgaattgatcacctgtttaatatactgtaattatctgttgcatggttaaacagcagtaattgcttcgtgcaagttcatttcgccggtttggattaaatgattaattacttcgaccaagatcaattcgctttaaatgattaattagatcaaagatcaagatatcacgattcacaaggccgagcccatggagagattcagctgggccatgggcttttttggtccatatggtgacagcttttgcgtcccttaatttgcagctcgctctgtcgaataatttcaacgtagttgtctgttactctgctagtctgcttaactgcagtatcagtttactttactacttgtcgtttatactataattttgctaattacagtgtcaccttatcttgtttggtaacaattcgtcagtcaagaatggcaagtactcctatttgtgaacggactgagtcataggaaatgaagcagactatcttttttttaacagattcatcaggtttcagtcgtgagaatctgtcagctagtttctgttgtgaaatatgaaatgtagaggacacatatatagtatttcttttcttgtactgctcattgcgtacatgtgcagctaacaactcagccgttcagaggagaggatggataaacaattcgtgcatatatacccaacaaaccattgctttactaaagcttaattataaacattaagcattagttgcgaacctgttttgatcatagcaatcatttgcgttttgatcatagcaatcatttgctcgaacagaagtagttagagcatctctaacaggctctccaaatctgactctccaaatatttatttggccatctctccatctaatttgacaactcaaactcttttttactccaacagcctccccatctatcatctccattacaagtttatgacaaatgggacccatatgtcagcctcaactacccttcttccatactgattctttttccccacctatactacatttcctttcttccttccgtactactgccccttccccgcaccctctacctcggtgcggcgacggcgacggcgacggcgacgacgacttgcgtgcgcgcaaggcgcgggcgggcgaggcgacggcgactcgcgtgcgcgtgaggcgatggcgaacggcagcgacgcctcgtgggagcccaaggcgacggcgggcacgtgaggcgggcccgcgaacaacagcgaacgtcgagcggagatggcaccgagccggcgggatgcatcacgcggatccgctcctcaccggcctcccttgccgtcgggccctctcccccgcaaacgatggcgatggtggcggcggcaaatggcaacgacgacggcggccccgggaggcataggcagaggcagcggaggccgccgctgccccagaatccaccccgccagcaaaatatgcacgaggtaggaggccgcgcggcggaggtcgccccctcctcccgaatccacgccgtgctgcccgaatcccccctccccccgagtcgaggtcgggtggaaccggaggcctccagacgacggcaatggatggcgacggtgcagacgacggcggcggcggctggcgatggagaccttggcagcaatggaagatggtgtcctcgatgacgatggtggcgtcggtgcttctcacactgactaggggcatgggaacagagaaaagggcaaatgagtgtctgacagcatggggcccacggttggtaacctggtttggccagccgtggaggatggccaaatttggctagttgggaagccagcttggccagccaaatggcttgccattcgtttagcaaggctgttggagtgtatattttcatcaaaatagctaaattttagcttggagagtctattagagagtctgttggagatgctcttactacttactactggctagtactccgtattacatatgccaagagagaatcgttcatcagcaggcgaggaaacacaatgcatgaagagtgtttgtgcttgtgaactatatgcttttttttcgggaatacgcaaaaggtttgcgcactttttatattaagagaaatgaaatttatacaaatggcaaacaaagaagagagatagggaaaaaagggggaaagggaaaaaaagacttaagcctactctcgctaatacaatgtgacgactgaacgaccaaacacgctaactagggagcactggtgacaggggattggactataagctttgatgagttagtttttgtttgagatgttgtttgtttttaattcgactagagccatgtgagaatactctacctccaagagaacacgagattttgtttccatgcatgcatggacaccattaacatccacacaacagcttattacataattcaatcatattaagttagacacgggagcgaagaagaattacgcattcgattgattcgaatcactagttgttcatggaatcagaaaacaagaccgacgaacagctgaacatcgatcatgcatgtttcttgcagaatattacaagaatgcaagagcacatgaatcaatcaaatatcccgaaactgatcgaaactactcgaattgatcacaaaatcaactcgatcgcacaaagaatttgatccgctacgtactactacaaactaatcttgctcttcttgcgattttcgcggctgcgctacgccgcgcgctcgacgccgtagaggatgaagcccgcgccgtcgaacgccaccctggccgccgccgccgcctgctgcttcgtgctcgcgcacggcgacgcggccgcgccggtagacgagccggcattgtcggcgccgaacgaggaggagcgagaagacgaggcggtggcagcggaggcgctcctcttgtcgccggacgcggcggtcgtcgccgtcgccgtcggcgggggcttgtagtacatgcgcgccgtctgggggcagtgcgagtaggccctgacggcgaccctcgcggtcatgcccagcaggtccccgtacgccgcgtacttccccatcgccatggatggagctcgacgcgatcctcctcctcctcctccggcaagaacaagaacaaagaaccagagcaagatcggctccaagaaccgcggacaagcggatgatcccctctctctctctctctctctctctctctctcgcgatcaagctagcgatcgaattggaaggattcctgtgtcgcgagctcggattctcctccttggcaatggatgtgtagggtttgggggatcggtgtatttgtagccggtggggagttcgattcggagtccgattcggacaaggatgatcttgctcttaccagccgcggcgcgtggacgccacgggaattttcccgggtgtcatgggcaaaaatctgggaataatgtccgattcgaggcccattatccagctcggcccacgaagacacgaggcccattcgatctctcgtcttccccctacaaggcccaccaaagtccatcaaagtccacgcctcgctcggcttgggctcgctatcgcgttgagtcgagtctgagccaccgccgaaagaaagaaggggggccgaacggcgaaggcgcgcaagggtttgggagccgccgccggcgaccttggccggagcgcaaaagactgaggaggcgtggtcggggcttgcctgctgccggcggccggcgaccggcgaccaacggccaggacaggtctaaaattttactgcctcacttgaatatttcgattactgaatctgcagagaggaagcgtattattccctctttttagctggatcgagtgggttaaagcaattacgatagtaaaaaagagaggagggttaggatgcagtttttaggggatcgaatacactgtggaacagaatgctgcattttgctctatctgtttattactagtacttgttgaaggatggaattgtaggttttcccctttataaattggatagaggacttatgcggattaccatatgttgaattattgtgcaagattttttttgttaattgttcaaaaccattgaaatattgggtgcctctaatagtggaggatagatcattctgttacaggcaggtcttctgtaggcttaggtttgggggtcctctactttgttctgggcttgtggctgtgtagtaatgctagttgctaggtgcctgaccatatgcttatcaccttagaagaaaagctgcttcaattctaaattctaacaaggtaattagtggtaaatcatacttattccattcaaagggctgtgaccttttgaagtcactcggtctgagatgaaaacccagagaaatattatgaatgaatcctgacctgttctgagaacaacatcagcctttgttttgggatgtacttaagaggaaagcaaatttttggcctttagatttaattctgttctatcatctatctgatgacaaatcaacttagtatgattttcttttatttgcagctgtcctcaaatccatccctacattccaccaatgtatttaagctgttgaccacttgcacttgcacttgctctctgcctaaaatttgatgtataggctttatataagatggtatattgataataaactactgtttactaatcaactactaggctcctagcatgctttgatgtgtatttgccggcacccctatcaacatgcttgtgacacttttatttaatgttaacccgtttctcttttccaacagcttgtgcttatactgtcctgatggaaaccgacagaagccagcctgctccaattgacccaagaagagctcgctttccttgttgtatagtatggacaccattaccgttaatctcatggttgatcccctttatcggtcacattggcatctgcagagaagatggtgtaattttggattttgctgggcccaattttgtatcagttgataacttcgcgtttggagcagttgcacgatatattcaagtaaacagtgatgaggttagtacttagtattatgtggttaatatcactctcattgccgcctcctagtgacaccttatcaacatgtaatgtataattattgaatactttaatcatgtatagcactcaccaaacattaatctcttgtaatctgcagtgctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27960 - DNA, 440 bp, Oryza sativa
  unsure (1)..(440): unsure at all n locations
nnnnnnnnnnnnnnnnnnnnnnnnnnnnnnnnnnnnnnntattagtctcagttggctgtaaaataatgtcacggtagggtacatgtatgtgcagcatacaaggtatggtgagttatgatatggacagtgtgtacaccccacatttgctcactaaaatcaaaatattcaaacgtcacgtgatgatatggtggattgcattataccttgtattgtttattatgttacttgtgctagacaataatataggctgttcttttgggtgattttgtatgaagatgttgagcaagcacttctcgatataatgctagttttgttgacctgttccaggaagcaatccaatcgggagtcagccaggcgctcaagaagcaaaaagcagctcacttgaatgagctggaggcacaggtctgatagttcacatagttattttcgataagacataa

SEQ ID NO: 27961 - DNA, 838 bp, Oryza sativa
aatagtcatcaccctcaccgtcacacagtcagatatggatgaaaagtttccactagtagccactgctcctagggccatcacctgtaccaccaccatcattgtccacaccaacacgccgtaaagacaatactgtcccatcatcactcagtcaaatctaggtgtagaacccccattggtagtcattgtccctaggctcaccactatcagggagccacacaaaaccgcgcgattaccatgcacggtaaccttttcagtttttaaaaccacggtatctctcggggttaccgcgcggtttcgcgataaccaccttgccgtgggggtccaataaccacgccaaaaacggtaagggaaccctagggccaacactgatgagcatgttgctatgtcgagacaaccttgttatcgtccatgtacccttgcaacctaatctgggcactgctctgtccactcctcagtgccgagaagcctaccaacgcaaccacttgcgccgccatgcgactagatctaggcacgaagacccaaaattcgacaaccaccacctcaggctccactgagacatccaccaagaagcctagccaacattgttcttaccgttgtacggacgcacgacaactggtttaaacggcggccgcactaccagaaaactaattttcccaagcggccaaaactaattttcgcaggcagaaggaaggtccgcctgcaacacaacgtcgattttcgcagtcggggcaacggtccgcctgcgaaaatgcaaaaaaacgaacaaaaaaaatcgccgcacgcggctcgccgccgccgccacgcctcgccctcctccccggccggatctgagagggga

SEQ ID NO: 27962 - DNA, 616 bp, Oryza sativa
  unsure (1)..(616): unsure at all n locations
nnnnnnnnnnnnnnnnnnnnnnnnnnnnnnnnnnnnnntcgttttgacagttaacgtactgttcttgtttttttatgactctggtcagcatcagtaaatcacacagagattaaaaggaatcaaacagctgggaggaaattaaaatgaccaaacttccaagtttctctttcttcagctctcagatttcttcagtgacacaacagaagctagaaaaaaaaaagctttaaaaaaaaggcatgtgtacacaaatctgcagaactagcagttgccatttccaacaaccaaaatctcagctagattattctgtacataggagtactgcagctctgctcgatcgatcatatcctcctcctcaccaactccgatccaactgaatcctgaacttttttagaattcagatccttggatatctcatctacacatctacgtagaacaaaaacaagatgcatccacgtgtaagtgtccttcttggccagccgtccgatcgccatgcatgacgatgtccacggatagatctcatctttttcatgcatgaagccttttttctgggagatgtctacttcatgcatgcatcggcgaaaaatttttctttagctcgacgcctttcgatttcgat

SEQ ID NO: 27963 - DNA, 592 bp, Oryza sativa
  unsure (1)..(592): unsure at all n locations
nnnnnnnnnnnnnnnnnnnnnnnnnnnnnnnnnnnnnnnnnnnnnnnnnnnnnnnnnnnnnnagattctttgttatccgtattagctatacttttatttttccagggtaatttagttttaagtgttcaaatcggaagcactgaggctgagagaaatgctgactagtttatgtacttacatacctaaaaagccttctgtgtatgtgcaatattagataatctgtgtgggcatcaacttttgtactatttaggttacaagccttatttttgcaggaatgcactaaatgctcctgttctgtagttattgtttctgcatgacctgagtactttagtgtttctatatattgtgtagttgcttgcatgctatttgtggtgaataacttatgaggttgtacttttgttataattgtggttaatgtactttaatccttgcagtccaatggtgaaagaggctgtggaaatgtccacagacgaagaatcagacggtgtcggtatatgtccaccagatggcaacaatgatgatcgagaggaagccattagtagtaatatcatgataattgccagaaaggcgaagtacctgtgttaaagacccg

SEQ ID NO: 27964 - DNA, 632 bp, Oryza sativa
  unsure (1)..(632): unsure at all n locations
nnnnnnnnnnnnnnnnnnnnnnnnnnnnnnnnnnnnnnncgcagtcggatctgatttttgaagactaatgaccgnctacaaaaatataaattggggtgatgttcgctgtccgcctacgaaaatctattttcgcacgcggaccacttaagcggcgcctacgaaaatgattttcgcaggcgcaccttatatggtccgcctgtgaaaatgaggagcaatattaatagactaggctggagtagtttttttctaagtctcattctctccctcacttatcctctccctcacctctttcccttagatccctctacctcactcttctctcctctcctctctagcggtgcggagggaacggtggcccaccggggacggcgactgcatgcggcggcgcggcggggacggcaaggcccggccggcggcggcggttccctccgcccctccctcccaaatatggccggagaaaggaggggggaggccgccgggggtaacggcggcaacaacggcttgggccgttgttgccgccgtgacaacccccccggggcggccggcggcggcgggttcccttggccccttccttccaaaatttgcccgaagaaggaagggggaagcccgttgccgggaccaacggcttgaac

SEQ ID NO: 27965 - DNA, 706 bp, Oryza sativa
  unsure (1)..(706): unsure at all n locations
nnnnnnnnnnnnnnnnnnnnnnnnnnnnnnnnnnnnnnnnnnnnnnnnnnnnnnnnnnnnnnnnnaatccatcttttgaacccatctcgtcgaaatcctgaagcaccaaaatccccttacctggcgcgccgctgtcgacgtttgatgtcgcaattctggtatttgcatggtatggggatcgtcggtgctaggatatacgcaagactgaggtaaaagggatggagacagggatttttatacaggttcgggcccctgaacggtcaggtaataaccctacatcctgttggccgaagtcgggattgctcttattcatgataatcacaccagtacaatatttggggtagcctatctaactgttgtcgacatgggggtctgacgatctgactcgtagtcgacaacagggtagccttcctcctcgaatccgtgcccaacgaggtcagagatagcgctttcatctcttctgacagtattcggagacaccgtagggtactagacgtgcttatccctgaagtcgatatccggcggcgtgtcttggcgtatgtaggcttctttgttgattgtgttgggtgttgatcgtgtcgggtgttgatcccgttgggtgttgattgtcttgtcccccttctcctcctagggggcctgtatttatacccataggtgtccacttgtccaagtagaactagagaaaccaatatggatacaatccaag

SEQ ID NO: 27966 - DNA, 1229 bp, Oryza sativa
cccaccgcccggccaaccgtggccacccggcaagctcctccccggtgcccagccggccgaggcatcccagcgagctccatccgcgcgtccaggcggccgcggcctcccggcgagctccatccgcgcgtccgagcggccgcgacctccctgcgagctcctcccccgcgctcggctggccgcgactacccagcaagctcttcccccgcgtccagccggccgcaacctcccggcgagcttctcccctacggccagccggccgcggcctcccggcgagctcctcccccaccgccgccgctcgagccaatggaaggcggctgtgagagatgagaagatgaaagagagaggggaggggtgataggtgggtcccacctaatttttttacagtgaatgccacctagatgccacgtggatgccacataagctaaaactggactcaatactgccttgggagtcgatttgcactggtttttggagatgagggagtcattatacctggttttgtggtggagggatgttattcgacaaagggcaagagatgagggagctaaaatggacttattccttttgcataaaataatggaaagagtacaccgaaggtccctcaacttgtcatcgaattacaaaatcatccttaaaccataaaaccggatacaacacgtcccccaacttacaaaaccactaaagactaggtccctcgacggttttgactctggttttgtccgacaatacaatattatgaaatttttcatctcacgaaatgacaacaaaattaacataatgataatatattagttaacaagaaaaccattgcaacgcacgggcattatgctcttttacaaaatgtaccaaacttatgatattatgacattatttcttgaggcaaattcaagcatgcaattttttttgttgtttttaaatttggctgtttgaaatggcatttggctcgagatagggacgaaaacggcttggaaacggacggagactatagtttccataacttttttcggaatcggaatcggagcaggaaacctcaaatatgaaaatggtattgaatatgaaaacatagcgaaaacggtaacggatatttatcataatagaaaacccctcactgaatttttcaaactaacgaagagtgtagctcattacttttctaaaataataaatcgacatttctatattttttttatcaattttaaatataatacgactagttgtacggttcacttacc

SEQ ID NO: 27967 - DNA, 549 bp, Oryza sativa
ccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacatgtaatctgtgtaattagttttttttttttggctatatttaatactccatgcatgtgtccaaatattcaatgtgattggggaagctggagtaggtaaaacagtactcatcatagaattaattaacaatattgctaaagctcactggggctgggtgaaaattttttatttaggaactaaacagggcctaattaagctgtgtatagtaagcacaatttccacgccgacgcactgcatatttcacgcaactttcaccgcctattttcttcttttacccccacaaccacgaccacgacgacgaccaaagtaaacaagttttat

SEQ ID NO: 27968 - DNA, 8241 bp, Oryza sativa
  unsure (1)..(8241): unsure at all n locations
nnnnnnnnnnnnnnnnnnnnnnnnnnnnnnnnnnnnnnnnnnnnnnnnnnnnnnnnnnnnnnnnntttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccaacgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtagttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcacttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttacatcaattactcttaattgattgttggttgatggttgtgtagtggaggatggttcatggctacttgatgacaattagttgctctattcctcttcctattccattggtaacttacatcaattactcttaattgattgttggttgatggttgtgtagtggaggatagttcatggctagttgatgacaattagttgctccattcctcttcctattccatgactcttactcttcatcttccattcctcttataaaatgggaattgatttgatctcccgcgagaaaaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaatgtatacacgtcattttccgccgtaatgtatagtaagcacagtttccatgccagtacactgcaattttcacgtaaccggtaacttttttcaccgcccatttcctgttttacccccacgaccagggacgggcctcggattttaagattgggtattcgatatggaaagagggtaaatttttttttttacaacacgagcacaatatttggtacgtatgatcaatgatatggtattttagtactgcttattgaattagaacttgcgacaaggtttttagcaatttccttgatttactgtgatatactttgtaaaaaaacatatgcagtacaaacttgtcagggttatggataaggcatacctcatatcctacgacttatggaatatactgataaagtataccttcatgtatacggattgttcttgtaaatatcgcgtggagtccatttctaattatggaaaatatctctacgagtcaagtgatttacaaaatcctactcgaaagggatcgatagaatttatgttataccgttacaggtcctatatcctcaaacctttcttgggggtcaagatgatccacggtataaaagggaccccctgggaggggtttagggtatcgaattccatcaccaacgcacccaccaaagtttacgaagccgaagtacacggagccaagccgccgggagatcttgtcaaaaccttagactacgatctcgtcggtgtcatctgtttcgactactctctttgtaatctgttctcatcatcatcaatctcatataaactggactagaactgttacctgataaggggcctgaaccagtataatccttgtcttttgtctgcttgatgtcgtactatgtagggcctcgtttcaacgtacctcaatactctactcatccggtccgcgagtatcactcgtcgacaaatctaccaaccaagtatatatcatgtcatcacaacacggttaatgcacaaattaggcaaccatgcaaattaggttcgaatttgagggagccagcctgctaggcttttttgttgggcttcttttgatcaaaaacgttgttttctttatttctctgcgtacatacgaagtatataccttatatatgtattcttttttaaaaatcttaggtattttcatttgaatacccttgaattgagttggcccacccctgcccatgaccatgacaaatagagtaaggccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacatgtaatctgtgtaattagttttttttttttgtctatatttaatactccatgcatgtgtccaaatattcaatgtgattggggaagctggagtaggtaaaacagtactcatcatagaattaattaacaatattgctaaagctcactggggctgggtgaaaattttttatttaggaactaaacagggcctaattaagctgtgtatagtaagcacaatttccacgccgacgcactgcaattttcacgcaactttcaccgcctatttccttcttttacccccacaaccacgaccacgacgacgaccagagtaaacaagtcttattataaccacccccctctccttttccatctacctcctccaacgaagccttccttcgcccttgtcgtccaaccctcctctcctcccctcctcgtcgcggggctagggttacgccccctcctcctcctcctcctcctcctactcgtgtgggggcatgcccgggagcgaggcggcggcggcgcaggaggcggagatggacccggacttctcgggcgggggcggtgggggccccagcttcgagttcgccttcaactcggtcaacttctccgaccgggtgctccggatcgaggtcgtcgcgggggacgacgacgacgacgacgaccacgcgcccggctccagccgggacggcggggccggctcgctctcggattgggcgcgccaccgcaagcgccgccgcgaggagctcctcaaggagaaaggtgcgttgttgaaaccgcccaaattaaacgcttgtttcgtcaattttctttttaattttcgaattgtggacgatcgttttacgaaaatttcggtgccttcgatcatatattaggtggtcaatgaaaagcgaccagggtaacggagaatggatgaaaggggattttatttttctccttccaatttttagatgctctcgtgtacttgtaatagataccttttcagaatttgatattttgttctaggccgttggataattggtgatgcaagggatacaattgtgcaacctagaaattttggaagaacctgtaatcttgtactaattgattatacctgtaggatgatatgggtaagaataattcttttcatgcattgtatggataggcatggtttatgcatggatccatgtagcatactcgcctcgggttgaggggacaatgtggtcaattgtttgagataaagtgaggttatctagagaattggttgttgcatagtatataaacgagggataacgcctttgtagttcatacttctggttgggtgcacgcactagaagtatggaactgattttgttgaaaatttgatcatgaatgttggaaattgtatcatgcaatgtggctattgtgggcatattattgaacaacccttggttatcttggttatatgtttgtagcttataatatagtgattagttttagttgattttcttagattgtgttccaatgttcccccattttgtgtatacctgtacttttaatgagtaccttatgtaataatgtgtgcatattcagttggttatcatgcttcttctggtgaccaaatcagttcccactgactgaaattttttggctagtttatgtgtcaaacaaatgggtcaacactctgtagaaagagctaaagtgactgtgacaacaagccaaatcctcttgatacctagagttctctctttattttttcgtaggtttctatgatgttttttatgaaattcggagacctgcataagtcctactgcacttatgcatcttgtgtgagggcattttgtgctacacagtccacaatgtatacaagatactttgcatgaaaaatgggtttaagggctatgtactgctttgcaaagtgattgttagttttctgtttctccttatggttatatttgaaaggggtatggtgggggttggggggtaaataatacatttttataatgaagggacgcgtgaaaatatgctttgcaaaataccgttagtttttgtgtttaatcttcagacttcagttgcttgttagctgtgccgatcatgatctcaatgcttgttttgtgcttcttaggtcatgctcaaaggtagagcccggtatgggctcttatgcaaacatgtcatttagaaactgcccccttacaagagttgaggcaacaaaggctctaaccattaaccctcctaaatagttttttttattactcttctttcttttccccaccctcatgcagcaaaattttgttttatagaggctaagagtcgatgttaagcttaacattgatgtttctctctcctctttctcttccatgtcagcaaatttgcctagttggcaatgctatgagccccctactagtgactgttgtacataccctaattgtaattatgaaagtccttgattaccaattactgccacaagtcatgacttgtattttcatgttaccttctgttttacaattttctattttcattagtgatggcttcatgctgtagctataactgtgattacttgctgttatctacaatgtgccttgtaccttgatgatctttttctttttctgatgctttttttttgttacatatgattgtctagtgctacttatgcatccatccttgttctttgtgatgggagacttattttactaccaattgctatctgcagagtctgaagcagtcatgccagaccagataaattgcaaagtagaaccagaagaatgtgatgcatatgaagaaaatcaagaagaacctgtagcaatgatggacgactctccacccagtgttggccctgatggtatgtactgatgcaagttctgctacctagggtcagtctgcagtgtcgttttcctaacatgttatgttgcactgtgatgtggaatctaattatttagaatctttagtaaggctgtgttcgctatgggttgttcccaacttggaacagtagcacggaaaacggagcaatccattagcgcgtgattaattaagtattagctattttttttttcaaaaatggattaatttgattttttttaagcaacttttgtatagaaactttttgcaaaaaacacaccgtttagcagtttgaaaagcgtgcgcgtggaaaacgagggagataggttgggaaaatggacgtccgaacacagcctaagacttttctgttagagccaaacaagaaacttagaactaaatgctactattatgcatgcatttgtaaatccatcacaatgctgtcggtatgatttgttcagattactagaagcacagatacaagaaggattcaatatttcatattgttttgttatcattccttctgatagcttgtcttgattttcctgataccctgctctattaattgtatgtaattaatctgcactcatagagaagtacagtgtgctccaagtgtttttaacaactaaaaacctgtctggtgatttgtccctgggttgtgcgccttttactaattctttattgttttcccccaatattgatccgtctgtggtattttacaggtgatgatggaccaagtatggactcaccttggagtggtggggtgagcacaccagttctaagagtaaagaacatttatatcagttcagcgattcttgcagcaaaaagtcctttctttttcaaggtattctggtcaccttatcaagtgaatttgcactgtactctactcagtttgctgtcagcttcctagttcctaaaaactgtaatttgttgttcttagcttttctcaaatggcatgaaagaatctgatgagaggcaggcaacccttagaattactgattcaggtaatgcgatacctctagttaactcaaactttcttcctaacttattataatttgtgttgcagttgtgctataattctgcgtaatattcctaatttatactatattgtaatgtaatattgattttaggttttatggtgaaggtggtttctgcttctcctctttttgtctttgatattatgattagtctctttttcttcattggcttcacatattaaatagatgttttgtcaatctatctgccttcatgcatgcacaacttccttgatcatttacggaagtcaaatgatcaataattttctcttgaactctttccatatgcctcattatcttcattttacttggaacagaggaaaatgcccttatggagcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 27969 - DNA, 751 bp, Oryza sativa
  unsure (1)..(751): unsure at all n locations
aaaaacatatacagtacaaacttgtcagggttatggataagccatacctcatatcctacgacttatggaatatactgataaaagtataccttcatgtatacggattgttcttgtaaatatcgcgtggagtccatttctaattatggaaaatatctctacgagtcaagtgatttacaaaatcctactcgaaagggatcgatagaatttatgttataccgttacaggtcctatatcctcaaacctttcttgggggtcaagatgatccacggtataaaagggaccccctgggaggggtttagggtatcgaattccatcaccaacgcacccaccaaagtttacgaagccgaagtacacggagccaagccgccgggagatcttgtcaaaaccttagactacgatctcgtcggtgtcatctgtttcgactactctctttgtaatctgttctcatcatcatcaatctcatataaactggactagaactgttacctgataaggggcctgaaccagtataatccttgtcttttgtctgcttgatgtcgtactatgtagggcctcgtttcaacgtacctcaatactctactcatccggtccgcgagtatcactcgtcgacaaatctaccaaccaagtatatatcatgtcatcacaacacggttaatgcacaaattaggcaaccatgcaaattaggttcgaatttnnnnnnnnnnnnnnnnnnnnnnnnnnnnnnnnnnnnnnnnnnnnnnnnnnnnnnnnn

SEQ ID NO: 27970 - DNA, 626 bp, Oryza sativa
  unsure (1)..(626): unsure at all n locations
nnnnnnnnnnnnnnnnnnnnnnnnnnnnnnnnnnnnnnnnnnntttgattttcctttcaagttggttttctacctcagctttatagattttaaagaaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaatttctcgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatgggtcacagcattatgattattacacatgtcattcaaagaaaagcggaacaagccttcgctgtcataaccttttccaacaaaaggtccatatttagatacgacacatttattggactcaaacacaagtctaaaaccttctctacacaataaaagagccgcttactagattcttctttattgaagggacatg

SEQ ID NO: 27971 - DNA, 731 bp, Oryza sativa
  unsure (1)..(731): unsure at all n locations
nnnnnnnnnnnnnnnnnnnnnnnnnnnnnnnnnnnnnnnnnnnnnnnnnnnnnnnnnnnnnnacactctcactttatcgtatcttaatataattattgtctactttatctacttctgacgtatattttttatctacttccacaagctcttctaatgtaatgattatagacaaaataaacttatttgggacaaacgggtgaagagaaaaaaaatgaaattattctggaatagaaggagtataagagaattttggataatcataaaatgatgacacggtggggtcccacatccacgtcgggtggctgctaccgaccttgacctgccccagctcctcgggagtcgggaaggcaactccgcctcttcatccttcgccgccgccggcgccttcacgtgctccctctcctctgcgagtcggcggcgccgatctccatttgtcgaggcgagcatagcatgggagccgggaggggagggcatcctggtgaggtgagcatccacatcccctttctgatgaatcattcatctctctcccacctggagtagttttttttttgtctggaattcgctcgcgttcgttaaccctagctttctcttgtagatctggaagaagctcttctcttaattaacctgtgtaaaaggttgttgttcccccaaaaaagttgctttctgggatactaccaagaggaggagaggggatagatagtctgtcagatgatgatgatgccgctgcgttg

SEQ ID NO: 27972 - DNA, 512 bp, Oryza sativa
ctcgcacgacaacctcagatggtcgaggtacgactacagcaataacgcagcggtcctcgcaccacgacttcaaatgatcgagagacacctactcactggttctcaaccagtcaatcatagcgatctctcgtacatttacttctagtggttgagttacgactactacctggttctcgaccagcggggtagcgattctcccactatttccacttcaagtggtcgagtttagactactgcctggttctcgaccagcggtgtagcgattctcccactacttccactttaagtggtcgagttacaactattgcatggtcctcgaccagcgatgtagcgattctcccattcccctgctttaacaaagttgatatcaggtgcacaagatcgccaagtgttttacccagagatcccttacccagatgacacctagcgttgaaacctatactactgtccctttacgccggcttgacaaggcctccgaggaacctgagggaacttcagctggggacggccag

SEQ ID NO: 27973 - DNA, 773 bp, Oryza sativa
  unsure (1)..(773): unsure at all n locations
ccgaccagtagtagtcgccgccgccggcctcccccctccctcctccggccagatctggaaggaaggggggaggggagccaccgccgcggccccacgcgtagtcgtcgccgccgccgccccgcgccgtatttgccaccgttggcctccctcctccctcctccgaccagatttgggagggaggggggaggggagccgccgccgccagccgaacgccgtgtcgccccgctgccttccgcgccaccccgcgccatggccgccgtcactccccctccggtggctggggagaggaggaggggtgagggaagggaagaaggcgtgaggggagaggagaaggcgtgaggtgtggagaggggagaggccggccgtgggtggagacttagaaaaaatcaacctctaccaagtttatttatatttaagtctattttcgtaggcggaccgaccatttcaccctaatttatatttttgtaggcggtcatttggctttaagagtcnnnnnnnnnnnnnnnnnnnnnnnnnnnnnnttgagaaaaatactttttctagtagtgtcagatacaccacagagcctttttctctctcttggcaacgaacgtatgacaccaaaatagcacaagattaagctgtgtgagcatgggtttttccccctaacttgggtagagatggagatggagataaactgaccaatataactatagatctttgcgatagatgcagccagtgatgcaccgtgagtagattccacgtagagcaggaaaacgacgctcagtttggga

SEQ ID NO: 27974 - DNA, 738 bp, Oryza sativa
  unsure (1)..(738): unsure at all n locations
aaaagaatattacccaaatacccaatactatatattcgccttttaaattaacaatcacctaatctagaagccacttcagcatcatataccttttaaatttatggatttaatcaacccaactaactagcaaaataaggccaaatttctagttagggtgtaacaagtatcctccggcatcctctaaagtggaagcaccagacctgatcattgacattggcgcctttcagcctctgcgtgtatatataccttccaggcatcacaatgtactgtctcgacccaatctgcgacagaagaaaaataatcaaaatagctccctcgttattattcacagcgctcatacaaaacaaaacacagagaaaccctcttcagatgcactcctgcatatttcagaaatgcatccgaacaattctctgtaagactagtattgtatcattcgaaaacactgtaattctctgcgccgttttcttaatggtgtgtcctgtacatactaataatcggcgtgcgcgcattcctattggcgcgtgaatcctaagcttcttatgcagcatagagtaagcaacacaagcctgaaatcaaatgctcacttcaccgcaagaagcaacgcaactagcgccaaatgcctgtgtaatgatattatttaaagaattcgaggtaatgtagcatgaacaaatgtnnnnnnnnnnnnnnnnnnnnnnnnnnnnnnnnnnnnnnnnnnnnnnnnnnnnnnnnnnnnnnnnn

SEQ ID NO: 27975 - DNA, 912 bp, Oryza sativa
  unsure (1)..(912): unsure at all n locations
gcnnnnnnnnnnnnnnnnnnnnnnnnnnnnnnnnnnnnnnnnnnnnnnnnnnnnnnnntagcctatctaactgttgtcgatatggcggtctgacgatctgactcgtagtcgacaacagggtagccttcctcctcgaatccgtgcccggcgagatcagagatagcgctttcgtctctcctgacagtatccggagacaccgtagggtactagccgtgcttatccctgaagtgatatccgacggcgtgtcttgacgtatgtaggcttctatgttgattgtgttgggtgttgatcctgtcgggtgttgatcccgttgggtgttgattgtcttgtccccccctctcctcctagggggccctatatttatacccataggtgtccccttctccaagtagaactagggaaaccaatatggatacaatccgagtagtccttatcgtttccatgtagaactctagttatctttccttatccggaactccctcgaggtcagtttccgtataagacatggtatgtagtggatcctgccgagatttagtcaactactattaggtatgtggtatccataaccctgacagtagcccccgacttcgatgcaaatgaacgagttcatattctcaaccgcagactttggaggaactgttatcgagctcacgtgaccgttctcggtgagtttagagataacgttagacttcctttatcagcctcgtgcgggcaccgaaagggtttgtctaagtcaatctctgatgtcgaccgagaaagtacagagcgtacgactaagtctcccgtcttgctgcaatcgagaatttggattgaagtcatgaaattttatctcagcgggtacaccatnnnnnnnnnnnnnnnnnnnnnnnnnnnnnnnnnnnnnnnnnnnnnnnnnnnnnnnnnnnnnnnnnn

SEQ ID NO: 27976 - DNA, 359 bp, Oryza sativa
ggtaaaacagtttttgagaagaatttgaaaatgaaaatacactttcacactactagaaaaagtattttcgcaggcggacaaaagtgatttttgcaggcggagggtcggaccgcttgtagcacaacgacagtgaaaatcaacgattttcgcagtcggggcaacagcccgcctgcgaaaatccatgaaacgaacaaaaaaaaatcacggcggcggctcgccgacgccgccacgcgccttgccaccaccaccctcctccggccagatctgggagaggaggggaggggagccacgccccgcgccgtcgtcgccgccgccagcctcccccttcctcctccggccggatctgggagggggggagg

SEQ ID NO: 27977 - DNA, 573 bp, Oryza sativa
  unsure (1)..(573): unsure at all n locations
nnnnnnnnnnnnnnnnnnnnnnnnnnnnnnnnnnnnnnnnntttcacaaagtgtctggttagcatacctctgaggggccaaataagcacactttcaagttgccatcagccaatagtcgtaatctattgcaaccagcacaaaaatgctctgtcatcgatgtaataaacgaaattgttccagcatgaccatcaatcttgaaattctttgcggtctctgacggatgatcttgaagtctctctacacctttaaaacgttggcgctgatccccaaagttgcaagtaagaaaaattacttgtagcttccataataataataataaaaccacatgtacataaaatggctaggatgctagatgcaggcggaagaaagaaaggtaaaatgtataagggaagtgaacttttcagaggtgtaccttaccactttatccatcatctctgcataaggaaccaactttttgacattccaaacattaccatcaaacggcataaactctataaatctgacattgacaggcttttctctcgtcatttcaacaaaatcacagatctcgtcatcattcatttcacgcatgac

SEQ ID NO: 27978 - DNA, 646 bp, Oryza sativa
  unsure (1)..(646): unsure at all n locations
nnnnnnnnnnnnnnnnnnnnnnnnnnnnnnnnnnnnnnnnnnnnnnnnnnnnnnnnnnnnnnatctagatcaaataggacggtctaaagactttatatttaaaaataattcataactttttcatgtgaactctaatgaagacaaactttatatcaaacttgtagccctcgacacgatctacaactttgtagttgaattttttgttattttaagtcattttttgtccaaaaatataatattaaaattaaaatttcaaaatctataaacatgcaacaatattttgggaccctaaacagttttaattcaaaaacttttcaactacaaagttatgatataaagttttcaattttgatataaagtttgtcttcattagaattcacatgaaaaagttatgaattattttttgatataaaatttttagaccgtcctatttagggaccggggtgacacaactgaacaagttggaggacctaaacgagtgatttgcaagtttagggaccggaataacacaatcgaacaagtttgaggaactgaacggtcgatttgcgagtttagagaccaggatgacacaacggtacaagtttagggaccggtgatggactttactctttaaatatatatttgaaagctatgtgtttgcttatcc

SEQ ID NO: 27979 - DNA, 983 bp, Oryza sativa
  unsure (1)..(983): unsure at all n locations
nnnnnnnnnnnnnnnnnnnnnnnnnnnnnnnnnnnnnnnnnnnnnnnnnnnnnnnnntccatcttgtctaattagctatcgaactactccatatttaaccaactgacaatggaattagcatgtgcaagatgatgggaagaacaattcagtgagctactgtaattgttatctaatctaccggactacccctgtatactcgtctttgagcttattggccaattgtgtttagcagtatgcacacacatgcacgttgctgattaatttggtttataagtttagtttgtgaagcaacactaataatccgtcagctgcaatagatgcctgtaaacattaattgggacgttgctgacctgcttatatatatgtatgtaatctggctagttcgatgtaggaaattgtagttgatgatctctctagtgccatataatttcattgtgttaaaacaactttgtgtgttctttcatcattacgcctcatcttttttgtcctccgccctctctgtttgtgttattgaagtttcctgcattccttacatcaactgactggagttctcgcccctctttatttttcttggtttttcatttatagtttccttcggtgttccctaccagaacaagagaaggatcctaacgatgcgagtctactgcgctgctgatgaaggttagtctaatggtaactgtagattggcaagttgtagaagcggtcaaatgttttattttaggggcaaatgcaaatttgccactactttaaatcgttattgcaaaactgccactagaaaattgcaaaaatgccactagaactgtcattcgagtggcatccttgcaatattgaaaaaaccggtggcattgcaaatgccctattttacagttttttattctggagtgaaaattcttgtacccaagctcagatcttgaggtggttataaacttttgatgtatcttacactagggactactatttcaactcttttcttcttttttttt

SEQ ID NO: 27980 - DNA, 1157 bp, Oryza sativa
  unsure (1)..(1157): unsure at all n locations
nnnnnnnnnnnnnnnnnnnnnnnnnnnnnnnnnnnnnnnnnnnnnnnnnnnnnnnnnnnnnnnnnncaatcaacaacaggacaaaatgtcctgaaggaaccagaagcagcaaagcaatctgacgtttctggtgaatatgagtcagtacttgttggtaagcaaaatgaatccgctaacaatctgacaggagattctgcgaaagaagagccccctcttgtgggactgggaatggaagctgatactcatgaaagtgctcctagagaattgaaggatgaacctattttgccagagacggagagaagtgaattatcatgtgaacatggtgacatcacaggacatgaggattccgaaatgtatgcgccaccggaatgcgaaaccgatgtgcagaaagagagttgctgcgttgataggcgtcgtgcggacatgcaggtgccaaaggaagttgaatgcgatgagctgggagatgataatccgaaggaagatgctagtgttcagacagagaacatggcatctgaagaagcttccttggcttctgcaactcctgatggtatgaaagatgagaacaaggttgctgaagaaactacttcagattatgcgactccttatagttcaaagagtgacaatgagaacaaacttgctgaagaaaaccagaagctgaaagagatgctgcaaaaccttcttgcatctggcagcgatcagatgggagttatcacggaactgagcgagaaggtcaagacgcttgagcgtaagctggcgcgcaagaagaggccaaaggtaagggtacacagaccaaccaggcaagcaacggccaaagtccactgaagatgatctctgaagttttgagtttgtgtttatggattccatgtagctgtttgtaaccatgcctgtatgaatgtactacttgtaatgtacacatgagtgttgtggtactatgcattggagaatgtaagatcatgcctgtgttgggtccttgtaatgctcatgtagcctagtttaacacggagtatcaatgtcataagggagttgaatattttccttgtgtgctatttttctggttaagaaagctgctgctgctccatacatnnnnnnnnnnnnnnnnnnnnnnnnnnnnnnnnnnnnnnnnnnnnnnnnnnnnnnnnnnnnnnnnnnnnnnnnnn

SEQ ID NO: 27981 - DNA, 854 bp, Oryza sativa
  unsure (1)..(854): unsure at all n locations
nnnnnnnnnnnnnnnnnnnnnnnnnnnnnnnnnnnnnnnnnnnnnnnnnnnnnnnnnnnnnnnnnnnnnnnnnntttagggaaggaggtagtagttttatatatttcacaaaagtttttgaataaaacgaacggtcaaacatatttataaaagttaacgacgttttctaaatatttagggaagtcggctatttagaaacggagggactactactagtattgatcagcacaaacagccgaacaaagttttctgaaccaatgcaattgctcttcagcatcatgctgaagaagcacatgctgaacaagctctccaagagtgtgatactagcagtgtagcacatgctgaagaagcttgctgtaaactttcgttttccaagaggatccaagagcttgtcagagtgaatacatggatgcagcagtgaaatttgtcaatgcttcttcaatgcacccctgtcaccattcatgactcatgagaggaggaaggtacgagcaaaaacaactgtgatgcttgtgcaagaacaggcaaggaatcttggacccaagaaactctcaagctccagatgacaaaattttgagcggttcagattattcagtcgaaatcatcgtcgcaagaacttgcttggagaaaggccaatgcgaaaacaaaaaaattgacaaggcatcaaatcgaccaggacactacagaaataatgtgaatgagtcctagtggagtaggagcaagaaaaaagaacaatgtgatgtacttactactacataggattagacagtgaatttcatagtactgaataatgtgatgcttttgggtgtgtttagttcacgctaaaattggaagttcggttgaaattagaacgatgt

SEQ ID NO: 27982 - DNA, 904 bp, Oryza sativa
  unsure (1)..(904): unsure at all n locations
ctcgtatcgatcagttctatagttttactcagaaaaaaaacacaagtttgtcttccattaaaataaagcccaatctgcaatctcctaatcccataatgaattgcttagacttagtcctttacttacgtacgagatgcatggattgggaaatttgtgccataatattccatagcaggctatgtacattttcctaaactgagttctgtgatgactcattatgaacttatgcagcacattttgtagacattatgcacagccattcgcagtgtgtgaaagttcaaaacttacacacactcttgtaccttgaaagtaaatcccgtgtgcaatgcttagcctagaaaggacataaatacttctacttatttttttaaaaaaaaaaagaagaaaagagttgaaatagtagtccctagtgtaagatacatcaaaagtttataaccacctcaagatctgagcctgggtacaagaaatttcactccagaataaaaaactgtaaaatagggcatttgcaatgccaccggttttttcaatattgcaaggatgccactcgaatgacagttctagtggcatttttgcaattttctagtggcagttttgcaataacgatttaaagtagtggcaaatttgcatttgcccctaaaataaaacatttgaccgcttctacaacttgccaatctacagttaccattagactaaccttcatcagcagcgcagtagactcgcatcgttaggatccttctcttgttctggtagggaacaccgaaggaaactataaatgaaaaaccaagaaaaataaagaggggcgagaactccagtcagttgatgtaaggaatgcaggaaannnnnnnnnnnnnnnnnnnnnnnnnnnnnnnnnnnnnnnnnnnnnnnnnnnnnnnnnnnnnnnnnn

SEQ ID NO: 27983 - DNA, 653 bp, Oryza sativa
atatgtattgtaaataggtcttttttataaaaaataattatagataggttcttgatgccaatgacattgacgctaactccttcatatcagtcacttagctttcacgtgaaggctataggataatgtcaatgtgattagcactgtcacgttggaccaagatgcctatcttcgttggcaccctgaaaagagtctatttttaaaataagtttttctaaatatttatttgtaaaatgagtttcagagcaaggacaaaaagtaaaaaacaaaaaaaaaatctagatggactggtccagtgaagaagatggctccccaatccgagctgccatgtgtggatctgcaacgcaaagagtaggctggctgtagctgtaactagctgcacacagcagagtacaggacacatcatattacctctgcaggctggactactgccgctgcacaagctagtatagcggagaggggttacgtctaatcggggtcgctgaaaattgttggttgtcatgcatactccatggatacaccagtcgcaagtgtctactccagccagtgtaccgtgtgtatattgactggagactggaatcttgactgcttgtgtgtaccgtgtgtataacggaagatcgatcgtcattgtgtcaccgcaaattctgcctcaccaa

SEQ ID NO: 27984 - DNA, 1219 bp, Oryza sativa
aaactcacagagccggtgtgaatatcatgtatgtcgttgcatagatcatccaattctattcgtattatacgtcacgattcctatgtcatgtaagcatgatttcaaatcattcttcacacatgctcatacatactactatggataccattataataatccataacaatcagttttacttttgaaaagaacatgccaactgaaaataaaggataatcgacattgctgatttcgtctgtcatcaattcctgcccaacttgagataaagctagacgataaatcgagctcgtgtttgaaggcctcattgtttggcttatgcttattcttataagacaaattttaaattttagaactttattttgaattggaccttttagtttgttatcgaattttattttacaacatttgcttttgagtcactaaaaacatgtatataaaatatttacacataaatattcttttatttggtaataagttattcggataagcacatgaataaacgatacaatgggatgtgtttatttatccacgggcacatatgtacaaattaaattggctctacccattgcaacacaccggcatcttttatagtttatctataaatataagcattaaagaatattaagtgccaccttaatcatatcacgttacaatttcttcttatctttaccccagccaacttcttaccatatccatccctcactgagggacagcaaggtctttttctctccgttctatatctctctaaatattgcatctgtcccaaaataagttcagttatcttccttctacctaccctggtccacaaaatcttcaatacccttgattactcatcaccaacactacttcctctttatcatattataagtcattttactttttctcaagtcaaactttatagagaaatatagtactattttcaacataaaaaaaacatattaccaaaatatatagttagtgttagatttaataaaattaatttgatattttagatgttgctaaacttttttataaacttgatcaaacttaataaattttgactaggaaaaaagtcaaacgatttataatatgaaacggagaaagtagaatataacaacctagaatcggatgttggacagatcctctgtccagatttatattattataatgagtattcgctctatcttaatttgcattctaagatctaaacataaatttattttggggcaaaggtagtaatatt

SEQ ID NO: 27985 - DNA, 1120 bp, Oryza sativa
  unsure (1)..(1120): unsure at all n locations
agttcgtgatttcacataaatatcttatcaagaactttccgataagttttgtgtagcctgcatatataagcttcgttccttttctaactaaaattactcctctgatgcaaagcttccaatcccatagaacccatacgttggcttatgtggctggcatttttagtattgttttcccagaaattctcacttctggataatgctgatgtgcagataatattaaccaaggtattactggtatcaactagagacaaggcttacattggcatgccagtggtgaccaatgctgctgttcatgcagtggttgaggaacaggtatgtcctctgtatgttgtcgggttaatcatggatattcaaaattacttgaccctgatgtctccccaatatttttatatcagggacgggatgataaagtgatagtcttcaaatataagaagaagaagaagtaccagaggaaacttggtcacagacaggtaagtttttccaattaccttcttcaagaaaggtagaattttattgataaatactgattcagtttttacagcgaagcaattagagttcttttagattaaaaatctctgttgttttgcagccaaacacaaggttaagaattaccggcataagtggatacgaggacttccctgctgacccgatacttgagtatgttccagcttaagagcaattgtaagttctgtagttacaaacaactggtagtacattagaatacgagtgctaccttttcttgtctgaaagaacagtttttgaacaaaatttgctttgttcatgtgttcgagtgctgccagtcatccagttgttccatcctttgtttattccaccatctgttttgttcattctgatattgtgtatcctagccaactgtattattttcactgtgcttaaaaaaagagagagcattttaccacgatacggatgttttagctttggtttgtgtaactttatacagtttttgtgactactgatgctaatttcactgtttttggcatctgtaccaatggtgcttagtttattgaacgggctatgtcctaatattttgggatcagnnnnnnnnnnnnnnnnnnnnnnnnnnnnnnnnnnnnnnnnnnnnnnnnnnnnnnnnnnnnnn

SEQ ID NO: 27986 - DNA, 664 bp, Oryza sativa
  unsure (1)..(664): unsure at all n locations
nnnnnnnnnnnnnnnnnnnnnnnnnnnnnnnnnnnnnnnnnnnnnnnnnnnnnnnnnnnnnnnnncatttcaatggacaaatcgtgtgaaagagtaagttgcatttcaatctactttcttagtaaaaaactaattagcaaggcaaatgcagtcctttaattaacacacaatattttggcatgaactaatttgactcttcatgtcaataggaaaaagatgtacccccggttggaggacaggaaataccatcaggggaccacatggaaccgttacatgatgaagctttatcagagaactccaatgagctgcaacagtgcacaactagtgagagatcaagtacaatgatttctcctgctgccgctgacaacagtatgattactatggctgcaacatctgttgaaagtagtgtgtcagctgataaagtaagttgcttgtacttatttctttgatggtgaactttacccatacaacagtattgaatttgtaaaatatcaatgttgtatgccatgaatacaggtcagcccaattgaaggtcaggtgacagaagcttcagttgagcatgctcctgtggaaaaagatcagtgtgaagaaccaaacactacaatnggtgattcgggggactcatcagtatccttgaagaatgaagaactgcaggatcatgatc

SEQ ID NO: 27987 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnnnnnnnnnnnnnacctatcttcgttggcaccctgaaaagagtctatttttaaaataagtttttctaaatatttatttgtaaaatgagtttcagagcaaggacaaaaagtaaaaaacaaaaaaaaaatctagatggactggtccagtgaagaagatggctccccaatccgagctgccatgtgtggatctgcaacgcaaagagtaggctggctgtagctgtaactagctgcacacagcagagtacaggacacatcatattacctctgcaggctggactactgccgctgcacaggctagtatagcggagaggggttacgtctaatcggggtcgctgaaatttgttgtttgtcatgcatactccatggatacacgagtcgcagttgtctactccagccagtgtaccgtgtgtatatggactggagactggaatctggactgcttgtgtgtaccgtgtgtataacggaggatcgatcggtcattgtgtcacggcaaatcctgcttcaccaaagatcttctgctgctgctgcttctctactcacaagatcaatccatatcgtccccgttaaaaaaaacattaaacaagtggtactactagtaaacattagaaagagtgggatcatttggtttggtgtcctagcaaatacctttggtaaattttggcatcaatccaaatatctacaatgtac

SEQ ID NO: 27988 - DNA, 384 bp, Oryza sativa
  unsure (1)..(384): unsure at all n locations
accaaaacattcaactacaaagttgtagatcgtgtcgagggctacaagtttgatataaagtttgtgttcattagagttcacatgaaaaagttatgaattatttttaaatataaagtctttagaccgtcctatttgatctagatatccaaatccaagttaaggaccggggtgacacaactgaataagttggtggacctaaacgactgatctgcaagtttagggaccgggatgacacaatcgaacaagtttgaggacctgaacgatcgatttgcgagtttagggaccgggataacatagcggtacaagtttagggnccggtgatggactttactctaatttaaattctaatttaaattctaatgaccggatgattgacgaatccac

SEQ ID NO: 27989 - DNA, 592 bp, Oryza sativa
  unsure (1)..(592): unsure at all n locations
nnnnnnnnnnnnnnnnnnnnnnnnnnnnnnnnnatcttacatggtctttcatctctgaaggatccgacaaggccttatcggctctgggcgtccccagctgaagttccctcaggttcctcggaggccttgtcaagacggcgtaaagggacagtaggataggtttcaacgctaggtgtcatctgggtaagggatctctgggtaaaacacttggcgatcttgtgcacctgatatcaactttgttgaagcaggggaatgggagaatcgctacatcgctggtcgaggaccatgcaatagttgtaactcgaccacttaaagtggaagtagtgggagaatcgctacaccgctggtcgagaaccaggcagtagtctaaactcgaccacttgaagtggaaatagtgggagaatcgctacaccgctggtcgagaaccaggtagtagtcgtaactcaaccactagaagtaaatgtacgagagatcgctatgattgactggttgagaaccagtgagtaggtgtctctcgatcatttgaagnnnnnnnnnnnnnnnnnnnnnnnnnnnnnnnnnnnnnnnnnnnnnnnnnnnnnnnnnnnnnnnn

SEQ ID NO: 27990 - DNA, 3812 bp, Oryza sativa
cattgttgacctcgttaagatggtctgctgcaagacttccaggaacaagcgccacctccaagtgtgaacacatatccacttgtggcttttatctcatcagcatcagatatccagtttgagtcactatacccttctagtactttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgttgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattacggctggtcccaaagatcagtatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgctttattggaattttattcaggacatgacacgcagtcaaaactgcctcaccccaccattccttggaaagccccgcagtgtctaacatggcattcaccatctcagttagagtacggttctttcttttggccaccctatttgattggggtgaatagggaggcgtcatctcatgaataattccaaactcttcgcaaaaggatgtaaactcattggaaaaatactccccacctctatcagacttcaaccgtttgattttcctttcaagttggttttctacctcagctttatagattttaaagaaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaatttctcgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcccccgccctcgctaatgatcatgttggcagacttcctgtctttgcgctcaggacagtccttggtccaatgcccagacttgccacacacaaagcagtctccctttgcctttcccttgcttttcttcttaaaattggttgcagccttgagtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcgtcagaaactccgaacttggcctcaagtgcattccacatgtcttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaggcatgtggtttcagtgcagcagcaaagccaactaccgagaatgacctatcaggtttttggattggtggaaatttggtcataattcggcatattttaatcccaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttcttatttgaaataatgtaataagggtatacccc

SEQ ID NO: 27991 - DNA, 10175 bp, Oryza sativa
accctcaaccaacaatcaattaagagtaattgatgtaagttaccaattccttaatcaaatggattaattctcaaaactcttcatcccattgatatcccatagaagaatgaattcacatgaattcctagcataaggagccttggaatttatttgatttaattgatttaaatggattaattacccaattaaatctaacatacattacatagttatataatctgaatttacttgtgcgttaaaattatgtgaagattcccctttttataataggttttatcgttttatgttatgcataacttaatcgatgatacactttttgttattaagcttcatcaacttataagttataacaaaaaatttaatttttgagttagtttttacgttttatttatcatagtttattatacaatattaaattttaagtcatcaattagtgctacggcttataatgacccgttaacaaaacaatgagatactctgtatacactcaacttaatctatttgaagcggtgtatatttcacattacaaaacacaatttattccaaaaacgtttatattcagattatacggtaatcatgaatgctaaaaaaacaaacgtcacgttaggaagtttgtatcataacgactagattaagctgtgaccatgaccgtgaggatggaaaacacggaagtgctactgctttctctgtgaaactacaaacacgatccattctgttgttggcccatttcgcttattactctactcatcgtggtcgtgggggtaaaatatataggaaatgggcggtgaaaaaacgtcaccatttgcgtgaaaattgcaatgtaccggtgtggaaagcttactatacaaggttacggcggaggaaggtgtctatgtatcgtaaatatataatctaaattacttgcacattaaaatttgtataacttcatcgatccacgacacaacttcaccgtttgttcttcggctctaaaattttaactttaaaacataattttaagagttgactttcatgttttttatcatagtttattttacaaaattaaatttttagtcgtcaatcattgctacagtttataatcaaccattgacagaacaatgatatactcaacttaatacatttaaagctgtgtacatttgacattacaaaacacaatttactcagacaacatttagattcaaactatacgaacagtgaccatgaagactcctgaaaacaaacgccatgttacgaactttgtatcacgacgactcggttaagctctaaccgcgacggtgactatgaagactcctgaaaacaaacgcgatgttacgaacttcatatcacgatgactcgattaagctctaactgcgaccctgaggatggaaaacatggaagtgttgttgttttctctataaaactacaaacacaatccattctgtggttgtcccatttcgcttaattactctgctcatcttggtcatggggggtaaaacaagaaatgggcggtgaaaaaacattgccgattgcgtgaaaattgcagtgtgccaacatggaaaccatgcttactatacacggttacggcggagaaaggtgtgtatgtattatacatactagcggatatcgcacgcactgcagcgggaaatttagaaatacttcaaagaaaaattaaaggaaacaatatgtaaatcgtgtattcgtaatatctaaatggacaatatttgttctatagtagttaatgtgaaattacaattctatatgacgcttggatgcttatgtatcaaatataagagggatccaatggctattagttttctaggtgtcatggttcaatgcgcatggaacttttattggctatgctcatatttaaattcagaagttgattttctagaatagagtaggtaatctaatagaaagacaactatttatgactccaatatatactccatttgttttccagcactcgtcaattcacgctatccatgtttaaattttaaccgtttgtctttataaaagaaattataaatacaaaaaataccatacatcaaagtatgttacatccttttgttcgttgtagtctagccatcttaaaaacttggatacctgcgccttgcaacaagaaatttagaaatactcaaaggaaacttgaaggaaacaatatataaatcgtgtactcgaaatatctaaatgaacaatatttattctacagcagttgatgtgaaattgcaattctatatgacgcttggatgcttatgtatcaaatatgagaggggtctaatggttattagttttctaggtgtcatggttcaatgctggtacgacccaagtaggggtgttgttccgatcttcacaacgtaggatcaagaactcaagataactagctacaagaagccaagataacagtgcaacctaacaatcatacttgaagccaaccaccgtctctattacgacaacctgaattgagggttcgtctaaccacactctaagttaccaaccaacacaacctggaattaatcaaggaaaaatcctcaaagggaccaggagcaccaattggagggcgtcgaatgccgcttctgtaatcccacaaggaaatcacaagagcaaaggggtagagatctctctccgaatttgtgagcacgcagctaaacaaagggggttcatattctcattgttaaaagtcttccaaatgataaagcataggagatatttatactaggaacaaccctcatagatgagaatgaaaggtcttgggagtttactggacataggttagctcaaaggtcacaataagtgaattcccaagaagactctcgcgtttgtttggcttcttagcagtcctcaatgatttgtccattactccttattgggaagttgaaatgacgaaccgtttattggaggtgaaactataattgattatatttccaaccatatatattaagcatggagaaagttgactggatgggtcacacatcccttggaagttggagcaaatgtttggagacagtgtgctccaaaatcagcatgacgtaaatggtcgtcgtctttacgtaacccatcatcattttgatattctagctcgtcgtcaatgcccagcgagtcttttgcatgtgtaaacctaagtaatagcaaagtacttgatttaggtagtatataattctcgtcaatattgaaatatgtttcagctaggagcgagttcacttcttgttgtagtttctttgcgcggctacatgttatcagtccttgaaatggtgtaacggattggctctcattagcaacttagtcacatgattgtcttgtgtgttcatgtgacgggggctagggcatatcaaatgcacatggagctttatagctataactacacttagtgtgttgtaaatgcatatgacaaatggatggtcaagatcaaagcatgaaagggatccaaatgctactattttctagttctagatgatgttgctcaatacatatcaagcttttggttccaactatataggtatatagatataatccaaatttagttgcatgttacaattacgtagagaaatcccattttataatagatattatcatttcatcttatcttatgtataactttatcgtttgactatacaacttcactatttattcttcagcttataagtcataactaaaattttaattttaaaacttaattttgagagttgattttaaatttttatcatagtttattttacaatattaaattttaagtcgtcaatcagtgctacgacttgtaggaatcaactgttgacagaacgatgagatactcaacttaatgtatttgaagtggtgtacatttgacattacaaaacacatttacttggacaaattttagattcaaactatacggtgaccatgaaaactcctgaaaacaagcgttgcaaagttcgtatcacgacaactcgctaaaacacggaagtgccgctgctttctctgcgaaactacaaacacgacccattctgtggctagcccattttgcttaattactctgctcatcaaggtctggaggtaaaacaagaaatggacggtgaaaaaatgttgccggttacgtgaaaattgtatagtgtgccagtgtggaaaccgtgcttactatacatggttacgacggaggaaggtgtgtacttaatccgtcccaaaatgttgctacttaggatgggaatggatgtagtattataaatagggactatataggtatcatttgacaagaaaatcccccgtagacatcttgtatattttagaccatccgattgtttaaagattcatgaaggataatcaaaccctaaaaccccttccatcttcctccccccgacaccccctcttgcaacctccactcaacagtgcccgatctgcaccgcctccgccactgccgccccagcacgccacttggctcaccagctagtcagaaggggtcaacggcactagtgaggcctcctagtagtactattgttttatcttattatataattgtatggatcaattatacagctctatcattcacttcttagcttatgagtttcaggcaaaattttaattatagaacttaattttagagtttcttttgatgctttgttttgtcgtagtttatttttcagcattagatctaagtcactaaaaatacatatataaaaattactcataaattaggttttgattgttaacaagtgttaaagcttataattagttctggacgaaacaatgagataaatatatatactcatttttatttttatttttatttttgcgattcaaaattacgtacatttgatattaaacaaactcaatttacttggacaacttaagttttagattcagacgataaggcaaccatgaagacttatgaaatcaaacgttacgatgtttgtatcacgatggctcggtcaagctctgaccgcgaggatggaaaacacggaggaggagctgctgctgctttctctatgaaacacgacccgttctgtggttggctcatttcgcttaattaattgccgttctgagagttgcagcgtttttcttgtgctacaacttttgatatatattatataatagtagctgagcaatctgcatgcttcggcaaaccaacctactgcagccagtttacatgaaattcacgtgcaaatagcatgaaggatgctggaaagttcatgcatacgcaaaatttttcaccttgcgaggcagaaaaaaaaactaattacacagattgcatgtaaaattgcgagacgaaacttttaaggctaattgctccatgatcgacaatgtgatgctacagtaaacatttgctaatgatatattaattaggtttaataaattcatctcatagtttacaagcgaaatttgtaatttattttgttattagtctatgtttaatatttcaaatgggtatccgtatatccgatgtgacacaccaaaacttttcacctatggataaacacagcctacataccaagggttcagagacattctggtaatcacgaattctgttctgcaagtgtgtaacgttgcagctgcaatccaattcaattccggttcacatatgttgtacttatccaacctattgtttcgttcattcatatacctatccgaaccgcttattaacaaataaaagattatttatgaataaaacttttatatacatatatttttagcaacttcaaagaaaatcctataaaataaactacgataaaaaaaaagaaaagatcaaaattcagtagaaaatttaaatttaacttataagtataagcgtaagcgaaaaaattagtcgacgaatcattaatcacatcaggggcacgaagagatatcagttgatgcatcaaatcaacccgccccttgccatggtccatgcaagatcagataataaatatacaaatggcagaaacaaaatccttctgaggaagtcgagttcttgaactctaccgtcctggataactagccgtccagatttacaaacgagctcacacagatgcaactaagatttcaacacactgtgcagcttgcaatgtacatggttgttactgagggggtgtttggatccctgccacacattgcctcgccaaacatgcggctgccacgacagtttgactgatgtttggttaatacgtgagttgtggcagccacactttttgctagttcatttgcatgcttatttccgccacagctgtggcgattatttctctcgccacaatctctggcgacgccacaacttgatggctggtttgggctgtgaaccaaaaatcaacacgacgggagaaaatgctgcagctacatgagccatcttatattacacctttgctttgctgagtgggcgtcgagtagcagaaattacaacagattggcagcagcactctcattttctcctgctggttaccgaacctcctgacgccttcaaccgggcatgccgcccctcaagccttgcttgaagcagttttgccttcagggtgttctccttcatgcctactagaagccctgttgagcattcacctatgtcatggcccaatgatgcggacggataatcaagctgtcgcgatggactgtgtggattgcataaatcccccgaagtagttccatcacaaaatagactagctcgcgagtaatgatcaagggattcctgccccagacagtcggcatgagcccccaggttgttcttcgatgttgtgccattgtgatatccttgagaaatatgggggcaagggatctcattctgctcgtctgctggaacagttctagcgctggcctgtgagtcgatttcttgagttctagtggcatgccatggtctgctgctactggaccttgctttgttacactgtgaataaatttgcacgtcagacatatgtgaactctcaccaactacactatgcgagtattctgttcttctcttaggtgcatccatgttgcctgtgtagcttctgcgaggccctgtatggtcatgcatctgaatgctacttccatgcatgttgagctcaaagcaatgcaaatcactagcaacagaatcatcatcatcatcttcagctagctggggagcactagtggctccattaaaatggacagactcaagagattgccgacgtaaccgagcatttggcctactatcatgcatgtagttgtcattattcttaaagctaaccgatcttttggcaagaagaaaagcctcgatttcacttcttagcctctctgtaattgttgatttcttcagtgagtcttccttgacatcagtattttgcatttgcattctctcatcaagccatgcttctgatacatgaagcactgatttatcaaactggtattcgtaatttacatgcctttgtttcaatgccctgacttcctcttcatagtctcggattcccattgcgaattggtcacaaaggtcctctaacaggttctttgttttcttctctttctcaaggtccttaactgccttgacaaatgctgattttatctcagataactccttgccaaacttcctgtggaggtcttcagaatgtctcctaaggcgtctctcatcctccagttcatcttgcagggaatgaatgtctgctgcaatcttctctttgtctttatttttccggacaagtttgtcctcagagagttgcctcaccagtgaagcaacatcatggcgatatcctcttctctcacacttaagttcttgaatgtgttcctgtgcatgctgtaattccaattttagtccattaatcgctgacatatcagctgtatgttgttcttccaggctccagattcgatttagaaccttcaagagttctgttgatgtcttaaggttataatcagcccccctgaatctacccttgatatccaaagagcgagctggactgatcgcttgatttatactggaatcctgtaaaatacaagaaaaaagaaacattcttttgagaatgtgcttgttgtgctggttgttacatctgggaaacatatttagttgcatcaagaaatatagagaagtttcaagttatctacaatagacagcaggcaaaatactatgggactgacttcattgttctttctttttcctagcaaataaattcatacttctgtttatctaaataaagaatgagcagacaaaacgatgcacaaatgtattatttaattactatcaatcattcatgattatttttagtcgagaagcattagctagactgctaggctactcaatgacttgtcttgataaagcatactgttacactcccaaaacttctccatcagacacaaacatgtgtaatgaaaaacgcaacagaatcacaagatagaaaatcttacccctactaacacacattaccatatagtaccataagattttgttatatgcccacaaaccaaaatattaaagcagccaagaggatcacagcagataagaatatggatcacagcagataagaatatatacaaacataccccaactgagcttctgtaacttccaggagaaaaaggttgtgctgtacaattccttgcttgatttaacttctgatgattcgttgatgaatctgcaatatgcctaccaaagccacctgaattctgaggttgaatgtaacgaaaaaatatttagcatagaacaaatacaaaataaaataatcgtgttactatatatggtgcaataattatattcagcaatcaagactatgggaaatggtaaaacaccttttgtgcatttgctagataaatctcttcaaagtttaaatatgtctgatatattgttaacagctgtatgcttgaatattacatctcaacaccacatatgaggtcaaaagttaatatacagaacatgtgtgcaaacattgtagaaaggagaacatgcacacagacagagctaacatcatgtaaaggcagcttaacgtaaatgatgcctaatgtggattacacgagttgtaaatagctcacattccatgacatgccaaacacactccctaggaacattccgcaaactgaagaactagcatgttggtcagttagtacattgcaaagcaaaaggattcaccttttttccaattccaaggaacaaagtgtaaaaccctgatgtattcttcaaagcacaaaagatgagtactgagacaacattacaagtcagaagattggttgcaaagttagcagttcgaaaccttcaagaaaggttgtgtttacttttaataaaaacttgtaaccccgtccaatcaataagcaacaatttttactcaactctcaagcactgacagtgcaaattgtactgatagaataacagatagaacagatccatagttcatactagccagcaagcaaatgctggattgagagttgagaacagtagcggcattaataaaatcaatttagtgaagacgaccaagctctactatcaaaaaaaaatgcccactactaatggaagaaacagtcgaaacaaacaaaaagcagaacatcacaccaggaaacaggcaaaaacatggaaagacagtaaatcgagcgctgcaaatgtcttggttttgggctacatttcatcagtgctagtgcatccatttgctatgtttaagtaaataaatcatctactactagcagtaatcagtctccttcctcttgttgctgcgggccaacgaattacaattcagttgatgttacttttgccacatgaggaggaggttttgggctagttcgaaggaagacacctattaattaacccctcacctgatgcagctcgccgccggcggaggcgagcggcctcccgctcctgcgcctccgcgacccgccgccgcgcccctcccgcatgacgtcgtggatctcccacaggctggctcccagctgccgcgccgaggcggaagccgacgcggagctccgcctggcgggcgccaccgccgggtgcaccggagccagttcccccgccgccacctccacctcctccccctccagcttccacgacggcgacggcgtgcagggcccagcccgcctcctcgcggccctcccgagccgcacccgcagcggcacctcctcctccccgcggcagtcaccctcaccccgacgagcagctaccgccgcggcggcggaggtggaggcaccctcctgccccgcgaccttgccaagaaccgggcccgctgctcctgctcctgctcccgacgctgctgatgatgatggctgggcagcagcgggttgttccatggctatggcggcacgctgcgcgaggggggggcgctaggggcgcgtgagacaggggaatcccatgg

SEQ ID NO: 27992 - DNA, 48566 bp, Oryza sativa
ttgggaatggtgggggagctagggcctagggggggtttgaggtgaggtggagaaaaaggggggagggaaaggtgtctgcggcgtgggcagcagggtgtactgtaccccttttgtttcgttttgtttcccggtttgttgagtttggaactttttttggattggggaagaaagccatgccatatgtctctcttcccatccaaactcgtttccaaatcttatttgccgtgattttagcgtacagccgtttcatcgacgagctagtgtaaagcattcaagtttcgtcatttcaacgaattgaacaacccactagtagtattacatctgtcccaaaaaattttcgtttttcacacatcccacacgtcccaataaaaaaaacactcataccttatcgaatcacaatataattatttctcactttatctttgtccaacacaatttcttctactttcacaaactctaatgcaatgattactttaaaaataaacttattctagaacaaatatattgcagacaatatttattaaacgcctataaagtcaccgtgaataactttttactcccaaattcatattcaactatatgagtataaaagttttactctgatgacggagataaatatcatatgaccattttttaacctagatatttttaaagacttcactacatatttaaaatgttaggctgtgttcgggaggtgatgttgagaactcatctcctgtgcaagtaaaatggagcaatgcattttcttatgattaattaagtacttattattttttaaaaaatagattaatatgatttttctaaagcaactaacatatagaaacttttttaaaaaaacacaccatttagcagtttgaaaagcgtgttcacagaaaacaaaagaggtgagttgcgaaagttggggaaagaactcagtcttagtggtggtggtatccaatatgccgcaccacccctaccactaatatttaggcaaaattggttatatagtatcaaaagttcacatttttttgttttatagcaccgaaagataccggttcactttaatattacccaaaattcaccacattcccatttttaacacttccgttaattctcgatcttttccgtacaccttgatcgctatttacccagccacgcacataatatgacgtttctacccctcattatcatgcatcctacttgtacttgtgaggggtagaaacatcatatagtgtacgtggctgggtcaatagcgattaaggcggacgaaaaataaccgagaattgacggaagtgttaaaaatgggaacaaggtgaactttgggtgctattaaagtgttaaaataggaacggggtgaatgttgaattctcttatatgatcaatttgggaatgagggagtattgttctagcataaattttggcctcggccctctttacaactagaggatgccccgcgcattgctgcgggacttggttaacatcaatttgttagattggaggtacaatctcaagaagaaacggaagaaacaaatagctttcttggagaaattcttttcaacagccctatccaaaatttgtaaataatttaggtagcacatgtcaactaaagaggcgttcagccataaagctcttttatacagattgacgggctgaatacatatagatgtgtgtggagatggaccaatgtgttcatgtgggccgcatttggcatgaggaggcaaagagactcactgtggagatgcatgggccaatgtgttcatgtgggttgcatttggcactgaggaggcgaagagactcacctagtgactgatgggttaggctctatgctgtatttcatccaacgtctgagaagcgatctaatgcattcatccaatggttcacaatttgatgatgacgtggaagcatgaggtttgagtttttggccttaactttatggaaagaagggatttcggaaaggggcacggaattttcccgaccaaccctgaataagggatacgacaccagatggaaacgcgcatgtaatcatttggatgaaacaaatcatgaactttttttaatgatcaacaagatgattcattgaatagagtagaaaaaaaattacaaagctaatgccttgaaatgcaatagccaggaaagaaaaaaattttccacacaccgacaacatctacatatagccaaacacaaacagaaggctagtaccggactagtaccggaccagccatcgttaaacatgaccgatcaccgctagatcatcaaggaagctatagccgagaccgttcaaagccaagccttatcagttgagcaccgggcgtaactctagccacgtcttttggattgagggagagagggcaagggagaaatcaagaattctttttttttatttacggggagagaaatcaagaattaaatagcatgccaccagagaaggcatgtaattaatcgtttgtacgtgcgtattcacgatactatcaccctctgggcagtgtgaccctcgacaaagcgatcctcgcaatcaaaaacggatcgtgcaatgccagtgcctgcgcaaagactttggccccgttcttttctacgacaagaattgaatgaagattaaaattttcgtggcacgtttttcaaactactaaatgttgcgtttcgtgcgaaaactttatatgaaagttactctaaaatatcatattaatctactttttaagtttgtaataattaaaactcaattaatcatacgttaataccacatcgttttgagtaaaaaaacttaatcttcattttcaagaaaaaagaacaccacctttgtcgtgcattaccgatgcatatgagacatttaactccatgccacttttaagatgtggtaattaattatttaccacccgctgtctattacacgtgggcctctttacaatgcgtgagcggtacacggcaacgacaattgtattgtatctccatccaacggctataatctatccgtggaccgcgcgtggccacgtatgccgtaacggcacggtagcaggagtaggagcatccaacggctactttcagtcccagctacagcctaccgtgtacagtaaaagcacgctgagttctgcatggaaaggttccacctttcggaacgacgaagaatttttttatgggaattaaaaataattaataaaaatcatgtaaaatgcctgcatttcaaaggaatatgtagaaatggttaaggggccataattaggacatgcaagtcattttccattgtcatatctggtgtctaggtccctatggcacacgaagaaattgtttagaagagtttccagtagctgcaggctacaacttctcttacaattatccagtttttcttttaagctaagaagataggccatgcatatgcctgagcaccttgtttaatattgctttaattttcattattaatgttcatgttacgatggtattcttgaaatattctgacttcatttgaaacatgttttggttttggatattggttataattttcttctaattacccttgtgttaacaaccaaatttagtaattcaagtatcggaggtgaaggtaaaaccgaagcggaatccaagaaggagatcgttccgaaaacagagcaagaatcggctaaagtccgaatcggccgcgatcaggattggcagagtgcgagtcggacaaggttagccgattccgacaatatgacttgttacacgacatcgggttaagttaaagtgcttcatatggattgccatgcatggattgagtcctgaaaaggcaattgtatctattaattaggatattttatgtaatttccttaaagataagtttggacaaaagtctgccgcaaagacttatggtatcttagagtttgttagagataagagtcgtgtccaacatggacatattttgtaatctcgagtataaatagaccccgagccccatgtaatcaatctaacacacgttcaatacaatctcggcgcatcgccaccctttactttcgttttgtttcaacgagttcttgctttcgagttgagctgcatcggtttcgatcttcaactagaggtaaaacttgttatggcggcttgcgttctcgggattagtgcttccatctttatgatactctaatattgtttatgtaattcgtcaagttatcatatattttatataatctccggcaatattgttatttaaccctcagtcggctaacatctattgtgggaaggcagccgattaggttaaataccaacattgacttagattatataggatatccaccactctatgaaacatccaactgcttgattgtctagatattgttcttcttttcatacttaatgttgcatcagttaagtttgatctattaagtcgtgcttagaatctcaatctctagcctgcttttggttgctgattaaggtagtgtcggggtttcagccgatcatacctgatttagctttatatcttacatgcttaattgatatgctagatctgccctttatgttaagatcttactacaacaaagtatattaggcttctgtttgatatattttacttgctttaatatcttaatatagagtggtatcggagtattaaccgatacatgctagatctatctgatcggctatgctataaatatttataatcttcttgttaatatatatttcgatctaagtgatttatactgtctcggcatggcgaccgatctatcccaatcacttgatttaagtatatatcgataaaagtattatataccattgatatctacagccgatcgaatagatttagtttgatcgattcatatatgacatcggctcaaagataaatgatacgtcattggcagctagctgatcggctatcgtttatggatttaactgctatttttctgtctttatttcttgttgattgcaggattaaatcgactagtacgctcacgaacctaaaagcaagattttttggacctgcactgaagttaagcagatcttccaggcctcatgtttttcgcatcaacaccttgtaacatataaattctatcctaaaattacttgaaatcatacaaccttaaatttatgataatggagttgattcatatatacttgtactatgtgtgattcttttttggaatataagtttccaaactgttagtaacatttttttcttatatgctatagatgacttaatgaattttatgatatatcaatgaaagatattttccattaaaatgtagctaatagactacttcatctaataaagataaacttatattacttatactccctccgtcacataaattcgaggagtcaaattttatcccaaaacaatagggggatttatatgtaaccatgacaaaatcatttttataaatactaccacgataatgtccaaagtactatattattatttatattttcaaaaatatctatagtttaatgtctggtttaatacatattgttcaaaatgacatgagatacgaatgcattttttttcaaacttattcacaataactaattcatgttagtatacttatagcccatgtcagtgtggcatatgacaatacctctatcaattatgcctaacatgttagaattttccaactataagaaaacatatcatgagtagtttattacgcatgttacttgattgttcgtttgttgttaaaactattcagcaaaggaaaaaaacatacaattatatatttgtcatgcatatttcatgtttcaattgtacggagtacttttttctttcatgaccaacagttatatatttgtcatgtataacgaatagtacatgagaaagatattacttttttttaataatagatctaatctaatggtctaaaatattggtaatttaagtgaaaatcgacggtaagattagatattactccctccgtcccaatatattgcaacctaggatgagattagacccatcctagaactatgaaacagtttcatagtgggacggagggagtaccatatagtggcctatgagcggttgtagagtgtcacatgtcaatttaagagcgtctataataagcttaatggatttttagtatataataaatagattttaagaaattgaaattgcagaatcctaaaaataaagaaggtgattttcctaacttttcgatattctcgtcagctgaattcttaccggctgcatttagaatctgaagcaaacctgatgagagactgtaattccaccaactaatattcagtcaaagtcaaaaagtgccttgtgagatgcagtacgacttcatttaacttaattaatcctagattgcactttaagcctcctagctatagtagctgcacatggcaccgtggatcatcacttattactacaagggtttcttttgtgggaataagagcaagtttaatagtatagctaaatattagctccgaattatcaatagctaatctaatagccattcatataatagcccatttatataatagttatctataaaaatatactataccgttaatacccggacctacctctcatccacacacgacgtgttgaagtccgtgttgcagctggctataaatatgtagcctgctttcttttctcttcccttttcttctcgatatgtggttatagctggcttatagcctgctattgtacttgctctaagcgaaaacaaggtagaggtagttgagatcaccttctaggaggtcatgaactaagtaaggataagtgttatggtagatgtgactaccacctctaaatttatctatatcattcactattaaattaagaggcaattcatacaatatgttacatatagtacacaaacaccaatatctctaatactctcacaccagtcttgaattttgtgtggaggttgcctcttgatttagagcaagtttaatactacagctcgctactagctccaaatcatttataccaatgtaatagccaattcatacaatagttgtttactacgctattaatacttggtcccacctgtcatacacacattacgtcttggagtccgtgctgcagctggctacagatctgtagcccgcttctcttctctctcttcctttatctctttaaaatatgtttatagctggcttatagcctactattgtacttgctcttaggggtggctcatcatctctctcctcacttctctcctccatctcatcactcaatccaatgtggtacttttaggggcaaaatatgtagcattataggccctgtttggatccaggtgctaaattttagtccctgttacattggatgttgagacactacatagaagtattaaacgtagactaatgacaaaacccatttgataacccttgactaattcgcgagacgcatctattgagtctaattaatccatgattacttatgtgatgctacagtaaacatgtgctaattatggattacttaggcttaaaaaatttgtttctcgaattagctttcatttatgtaattagttttgtaattagtctgtgcttaatactccaaattagtgtccaaacattctatgtgacaggggttaaagtttagtcgctaaatccaaacaccaccgtagtgcttgccctaagcagctagaaaccgattctacccatgacataaataaaaccttttgcatgttcagcctttgcttaattgtgacgtgcatgctagctagtggcatagaacactggtactacctctctaaaagaaaaaaaaataatgcgtgcagcgagttcttaactcatcgatataaagctttaactattaattttttaaaacaatatattagtatatatcaagaactacgaaccaactttatgtaaaaagcattttcaaatatgagtctaacagtatcacaaggcacttcatgtaaatcagaatatctttttttcatgtagtatcatgtttcgaaaggttgggccataaggcctcctctaacaagggtgagtcagctagctcataaatctccacatcagcttttatatgatgtggaagagaaaaaagataaggagagagaatgcattatctcttcttcaagagctaagctcctaaagaaaatgtgagaggaattgtggaacccaaaatattataaacaatatgctatgagacaatcttagagaggtagactttttttctatcttttgtatgaggtggacaagcatagaaggaggcctaagctcttgcccagcccagttccaaggaaaacaaatactgcactgagcccaaacaaagccctatccagctcagttactcctctcgtgaaaaaaaaaatcagagagaaaaaaaggaaaccaccggaggcggacatctcgcgccgccgcgccgccgtcggcatggccgtctccgcccttctcccgcctattgcggctgcgccgcctctcgccggaagcacacgtacgtgagtctcctcctcccactgcatcctctcgctcgttcgaactgtctaagctgcgtggtgcactgcgtcacagcgtgtggcgccgaatgcagccgccatgggctagggcttgtggtatagctgaggcgctagtcgcggccgcgaccgccgcgtagggtccggcgagatatggggcagcacggggaggcggcgcagcaaagggaggcgggaggtggctagacacagcagcaggccaatccacaaagcagctgtgcattcttctgatttctgttcttctgatttctgaacaagtagagattaaactcgatccatccatccattcggcgagccagccaacgcattcatatgtatgatgacttggtcttcgatctagtgatatccatcttgtctaattagctatcgaactactccatatttaaccaactgacaatggaattagcatgtgcaagatgatgggaagaacaattcagtgagctactgtaattgttatctaatctaccggactacccctgtatactcgtctttgagcttattggccaattgtgtttagcagtatgcacacacatgcacgttgctgattaatttggtttataagtttagtttgtgaagcaacactaataatccgtcagctgcaatagatgcctgtaaacattaattgggacgttgctgacctgcttatatatatgtatgtaatctggctagttcgatgtaggaaattgtagttgatgatctctctagtgccatataatttcattgtgttaaaacaactttgtgtgttctttcatcattacgcctcatcttttttgtcctccgccctctctgtttgtgttattgaagtttcctgcattccttacatcaactgactggagttctcgcccctctttatttttcttggtttttcatttatagtttccttcggtgttccctaccagaacaagagaaggatcctaacgatgcgagtctactgcgctgctgatgaaggttagtctaatggtaactgtagattggcaagttgtagaagcggtcaaatgttttattttaggggcaaatgcaaatttgccactactttaaatcgttattgcaaaactgccactagaaaattgcaaaaatgccactagaactgtcattcgagtggcatccttgcaatattgaaaaaaccggtggcattgcaaatgccctattttacagttttttattctggagtgaaatttcttgtacccaggctcagatcttgaggtggttataaacttttgatgtatcttacactagggactactatttcaactcttttcttctttttttttttaaaaaaataagtagaagtatttatgtcctttctaggctaagcattgcacaccacatttactttcaaggtacaagagtgtgtgtaagttttgaactttcacacactgcgaatggctgtgcataatgtctacaaaatgtgctgcataagttcataatgagtcatcacagaactcagtttaggaaaatgtacatagcctgctatggaatattatggcacaaatttcccaatccatgcatctcgtacgtaagtaaaggactaagtctaagcaattcattatgggattaggagattgcagattgggctttattttaatggaagacaaacttgtgttttttttctgagtaaaactatagaactgatcgatacgagtgcattttgtgtttttgtgattttaagaagaggaagtcaatgacttgggagtcaacgtggcactatccatgctaaaattttacaaaagtgagttcattcttgctgttttcatcttaaacccttgtatttatgtgcagcaatcattggccttgcgcccttgccttttgatatcaactatatctctatagcttgctctcctttatgtgaacaggagaaatatcacccttactaccctcaagctgccgttatgtgccaacttgcagtgagtactctatgcaagcatacaaaaaatacggtgttgcaaagggtacaatcttgacagcttggcgtctatgccgctgtaatcctcttggtatgtaggttttttcgttggttcatagttcttttgatttcttcgacagtcgcagtctgcacctgcatcatatcatatttattaaatttcttttacaataaacaaacaggtggtcatggatatgatcccccaaggtggtttgatgaggaagagctaccaaagcaatgacagcctggtaattactagagaacgtgtatgcatgccctatggtcattttgcatacaattaagtgtgatatgagacaatgtagttccaggatcttttaatcgcaagcaaacatgcacaaatttctttaaacgcgaattagttgctattatggattgggtggccatcctttactccacttaattaaaacgaaatttttcaaaagatagatagtacataattgagtgtgttattaaagtgacaccaaacttcaaacggacaaattttatgtaattaattgttcatgaaaacctataaacattattcagctggtcaataacaaaagcattcgatgtgccatactaattaaaaatatgaccacaaaggttaatagcataatcacaaacagtttataaataattacacacttgttaacatagttgttctctaattgaatgaccaaaccccaaacttgaaatgagtaaactaattgatcatagaaacttatatacataacagggtttattaagaaggaagtatagctattaactgctgctagactgctagcaaaatctatttttggaagacatccatctagcattgttgcccctcatctcagggaagagtgttggcttttatctgttgtctcccagaggaaaagcagaaccaaataggttccttcttgtgggtggtctggtcagctagaaacgaggccaatgcaggggaccatgcgaaaatcagtgaggaaatttgctgtatatgaccagctgcaagaccatgtaacaaagctaagagcttgcctgatgttgctaaatttaagatgtacaacagatgcaagcttttggtagttgtcttgggctatcttctgaaggctttcgatgtgaaagatcctctgaaagacaattgaacattaagtttcaatgcaaatataagaatcaataacagggaagcatttcttaccatttttgtgcttcttacaggtgaaaaagttggacttgtatgcagctctgaagaatataacatgcatctttgccaactatccaccaaggacaactgcagttgtaaaattttcagccaacttccagctgtcaggtattggagaaggctttactcgatgcttagatatagtcattatggtacctgtttgtggtggaaaatggttggagtgaaaatcaagaaaatgaactacttagtactgaagtattatgagatatagtaggtatggagggaacaaggatatcatataccatcattcagaaattgtaacgatcagaaccataaatggcgtgaaatcaaactcccaaataagagcaagcagcataaaccaaattgtcaagagagcagtaaatatgcattattcgctaactaaaacgtaaagttgatagacattgtttcacatcatataggggatcatcagaattaatttgggaaaaaacatattatgcacgggaaccatttaatacttagttctgttaacttgtgcttatttctgattgacctgcaggtaaactatatagaagaaccatcaactatttatttaccaattgagcgaaaccgttcttaaacggataagcaaaacacatagctttcaaatatataatttaaagagtaaagtccatcaccggtccctaaacttgtaccgttgtgtcatcctggtctctaaactcgcaaatcgaccgttcagttcctcaaacttgttcgattgtgttattccggtccctaaacttgcaaatcactcgtttaggtcctccaacttgttcagttgtgtcaccccggtccctaaataggacggtctaaaaattttatatcaaaaaataattcataactttttcatgtgaattctaatgaagacaaactttatatcaaaattgaaaactttatatcataactttgtagttgaaaagtttttgaattaaaactgtttagggtcccaaaatattgttgcatgtttatagattttgaaattttaattttaatattatatttttggacaaaaaatgacttaaaataacaaaaaattcaactacaaagttgtagatcgtgtcgagggctacaagtttgatataaagtttgtcttcattagagttcacatgaaaaagttatgaattatttttaaatataaagtctttagaccgtcctatttgatctagatattcaaatccaagttaaggaccggggtgacacaactgaataagttggtggacctaaacgactgatctgcaagtttagggaccgggatgacacaatcgaacaagtttgaggacctgaacgatcgatttgcgagtttagggaccgggataacatagcggtacaagtttagggaccggtgatggactttactctaatttaaattctaatttaaattctaatgaccggatgattgacgaatccacattttagccattgcaaacaaacggataagcaaaacacatatctttcaaatattccttctttttgccgtgtcccctgcttgtcatcgtcgtcagaatcagatcctgcagctttgtttgccgcatcagtgccagcctcatctttcttctcgtaatcctatcagaaaataccaatccacttgtcaaatatctccacacagggcagccaaacttgctgcgtaggagataaatcttataccaatctgtttgtctactgtataccttggcggcagcagaggaatccttgaaggtgaacttgtcgaagatgttcttgaagttggcgaggaggccgtacattcttttattttagatggaagaaaagtttcttctatcttaaataaaagatttttgctgatttatttatttatatatccaatttatatccaatttatagaattgatacaccatttaattcatgtacttcatctgtattttaatgtatgataccgttgactttttaaccaacgtttgaccactcgtcttattcaaaatttatatgcaaatataaaaatagaacatttgatgataaattaagtcacaataaaataaattatatttacataaattttttgaataagacaaaaggtcaaacgtttgttaaaaagtcaacggcgtcatacattaaagtacggaggaagtgtcatttagcattcaggtccgcttgctcgtgatgtaccccacctccacctgcggcgagcacggttcctaggtcagaacaaacaagaggggggaggggggggggggttcactatttccccttgatctccctttgccgactactgtgttatctgctaaagtaaccatggaaagttcatgcattccgtggtttatcaggatgagattgttccgaaggaggccggcgatgctcatgaggatgcttaattgctaatagatatttcattttatgtgcacacttaatcttcatccgagcgacaacctaaaattatgtcctatttttttaaaaaaaaacatctctaaggagaattttaagaaaatttctctaaaaaaacttttgactttaatgtgatttttacacaactttctataagaaaatttcttacaatattactacctttgccccaaaataaatttatgtttagatcttagaatgcaaattaagatagagcgaatactcattataataatataaatctggacagaggatctgtccaacatccgattctaggttgttatattctactttctccgtttcatattataaatcgtttgacttttttcctagtcaaaatttattaagtttgatcaagtttataaaaaagtttagcaacatctaaaatatcaaattaattttattaaatctaacactaactatatattttggtaatatgttttttttatgttgaaaatagtactatatttctctataaagtttgacttgagaaaaagtaaaatgacttataatatgataaagaggaagtagtgttggtgatgagtaatcaagggtattgaagattttgtggaccagggtaggtagaaggaagataactgaacttattttgggacagatgcaatatttagagagatatagaacggagagaaaaagaccttgctgtccctcagtgagggatggatatgtaaagaagtggctgggtaaagataagaagaaattaacgtgatatgattaaggtggcactaatattctttaatgcttatatttatagataaactataaaagatgccggtgtgttgcaatgggtagagccatttagatttgtacatatgtccccgtggataaataaacacatcccattgtatcgtttattcatgtgcttatccgaataacttattaccaaataaaagaatatttatgtgtaaatattttatatacatgtttttagtgactcaaaagcaaatgttgtaaaataaaattcgataacaaactaaaaggtccaattcaaaataaagttctaaaatttaaaatttgtcttataagaataagcataagccaaacaatgaggccttcaaacacgagctcgatttatcgtctagctttatctcaagttgggcaggaattgatgacagacgaaatcagcaatgtcgattatcctttattttcagttggcatgttcttttcaaaagtaaaactgattgttatggattattataatggtatccatagtagtatgtatgagcatgtgtgaagattgatttgaaatcatgctaacatgacataggaatcgtgacgtataatacgaatagaattggatgatctaggcaacgacatacatgatattcacacggactctgtgagtttcatttacttggtatccacatcactcgtgaatcatgactctgcaatgaatgctacgcgtgacaggaatcagatacagacgacgtatcatagtttcaacaataacaccttcaattttaaaatcgtgagcgaggacgacgcagtcccgatcggacatgtggcaagggcaaattgcgcctgcgagggcgtcgcgggcccaatcacggcgccacacaaaggcatgtatggaaacagactcgggcgcgggcccgatcgttgcgtgtggcaaggggtacgtgaaaaggtgtaggtccaattaattcgcgcgcctctcggataagagggatactctggcgtaagaaaaaaaagagaaaaggatgtggcataaacataaaattaaaaccgattcaaacatggataacgtatcaaaattctaacggaagcatctttatttttttataatagtagagatattaaatgcttagaaaaattatattcatgaacacagctgatagcatcatcacttcacttgtggtgaacactcccggaggatgaagagggacacagatcatgctttagcggtgagtgacaggtggaaccggtctcacatatcagcgacagttgctgcaatactgcagacaatctgcactggatgaagagagctttcggttcaatagtagtaggcatacccatacccaacccaacaggattgagatcctctacggttaaatacacggtgcttttgtcactgacatatgagcccaataatcatcggacccacgtattagtgatagagtcacacgactttgactgcataggaggctgatcctacccaacaagctgtgcattgcaaagaagccatatggaaacacgagcccccaggcagaagcaaaacccaagaaggccagcaagctacaggcaggcagcagcaacttcacaacactagtgtcactcactcgtcacaggagtactagtagcacaggagtgtaacatctcgtcatggcgccccatcaccgtcaccaccactgcctctgcggcctctgccactcccccaccagctgagagctgagagacgatctcgcattgaaatctcgcggcggagtagccaacaaaagtcttcttcttgggcttcttctttcttcctcctcgcagcgagctccattggcatggcattgatggagacgtcgtgcatggttgccgatgcagcgcacgagatgggagaagtcgtcgtcgcagcagcagcagcagcagaaccaaagcaatgtgcagacaggtgcagcagagaaggggggagtgactagtgagagcaagagtcttcagagttgccactttgccagccagggccgttgaaaatgaattttatttcagagttctgattcagcaatggaaaagtgttagcagcagtagattgtcaaatgtgtttgtttggtggtgttggtattcaatctctgtacttgctgatgcttagtatattatggttttattaattgatctgaacattgcataattttatctttttgagaactagcattgcatgcttgatgcttcaccaatgcattggaacctacaaaagcaaaatatatttatcaggcccttcttggacgaataatgaatagtaagcgctcttggaaagtatactagtatttcaatggttttatttgatttgatatttgggcttttcctgctcaaattgataagaatagagtatatataatatgatgtagtaataactttataaattatgaagtagtactgtgtagtatcatgacatccattcctatggcatccatcttgttgcagagaatccaatcctcagcagtcgcagctgcatggagtattgcacattgcgtttgcaaggatggatagatggatggatggatggatggatatggacagaggagggacaagaagaggacaagtattactcctcctcgtcgacatcacaaactgcaacgccgcagaaaccaacgacttgtgtacccccgctcactaaacaacaaacactcgtgtcctgcctcccacttctcccccccataacctaacagcacacgattatctcatggtttttaccctccctctctctctcaacattatctctgatcaaactgctacaatgcaaagctggaagaggtacagtacccccaacccgcttatctccgttcatctctggtcgtcccaaatcagtgcttaggacctttagggcccatttgaattgcagggtagaaaaaacagaggaataggaaaaacataggattctgatagaaattgaagtgtaaaatagaggattgcaaaacacaggaatggtcgtttgattggagcgcaggaaaaacgtaggaatcggatgagagagagactcaaaggaaattttccaagaggttagagctcttgctaaatttcctctaaaatctacatgtaatgtgtcattccataggaatttcataggatttggaaagcttcaatcctttgaatcaaaggggcaaataggaaatcctataaaattcctacataaatcctttgattcaaaggggcccttaagattatagtaataagcagccgaggtggctggtctagattagtgagaatgtgaaaagttgagcttctactgctagtttattttctagattgtatgattaaagtttcttacaatccatataacaatatgaactatttacgaggctaaagattttgaaaaaaccaataattgttagaagctccctcggatatgtttttgtgtttacggcttacttatttgtttaaggtgtaattaattttaaattttagactttccaatgaagtgccctagctgttctgaaatttatgcgggtgcatcatctaggtctctcaacttttttttttattccctgaacttatcttaggcgttagatatgtccaaacatgctctaactcgtttagtgcacgctgacgtttttgagggttaattagcaacggtagtaatagctgactactaacagattatgacaaaatgaagatgtcaaaccagacagatgcatttgctccaacttctaaccacaagaattaacaaagactgggcaggtgaatcttgttttgtttctttaaaaatatgattctactcctatcagtagtatactagtatgtgtgatgtgtctgttctggcttggagaaacagctccctgccatagatttcatgtttacctctttttatactatgttgcaaagagacaaaaacactggcattctccaagtacattagctaagcactgatcatgttcaagttgtgggatatcctttgacagaacaccatgctttctgctaataaaaatcactatagcacaaagctcaacaagttcaggtacagcattggacaatacttgcacagcaaatgcatttggaggacacctttgcaaagtgacaattacatacacacccacatttactaccttttctagtagtataacagactggtagaaactgtccccaagatatcatacaccacccttcaacatcaatatatatgctcatcagaagaaattgccccatgcttgcaacaatgcaaccctgctggtaccacatcactgagctcacctgctggctggctgaaagggtctctttctgattctctgaaggcatacacaacatacatcattgacagctggacatctgaaacaatatgtgtccttcacttgcagagcagagggtgtggctttacaggctttaagcaacatttgggagcagtgacagcaggcaagaaaatataaaaagggagatgctgctttttaggattggtggtactatcaagcaagtacagagagttcaggcatgaggaaaatagtgttaacgtatccatccaaaaccaaagagagactctgagtccgggagtccctgatgcagcatgcatgctcctttacctgtctttgcacaatcacatgccattgctatgtagtatgacacagatgctgcatcagaagcaggcaaggattctggcactacatgaacagcacaatgctgtatgagtaattgggataaagtatggtacagtttagcagttagtagtttagtactataggacataagtagaagaacattatggataaacatgagcttcaaatagcatcaaaggaacttgacagaggagataagtataagaacattagggataaacaatgagtacagtaaaaccagagatcaccaaatgtttgcctaatatttcaataaaccagctcttcgcgatttacatggcatggtttgatatccatgtttttattttcagttaactatctgcatttccaaaaattctgattatgtaagtgctaataagagtgatggacagattgattttgtgcattggactaaaagagaaggcaaccttaacagctctgctgtccatcaatggttatacggcaagcagagcaaggactctgcttcaagtactgactcaacaacaaaggactctgcttcaagttcagatgtttgcatgtagtggtgtcgtaataaaacaaaacataaatcagtagcagcggggaccccaaacgcaaatgactactataaatcaagaaagtaacaatcttttaggtttgggacatctgaagtggcactttgtttgcaggcaacataagaataaagaaaacacaattcagcaagaattgttcttgtgtatggcatcatccctccctctattatccaaccatcaaatcaacaaaaatgaaacagggaagtttagacgccctttcaattagaagatatactcagcaataaatagaatagatctataaaacctgaaacactttctcgaatggcttccaatgacatcatctcttcacttggtaactccaaaccaggcaaataatgcaagaattcccgtggaagtgaaacaaaataaaactaggaagcaatgtccagcctaggctcaaaagagaaaccagtaaacagctgcagaggaaacctcttcgtcacagggctcttcagtgaccatttccacagcttctggtttaattcaaatgtgaggagggccggtgacccatagctctgaatatagataaggtcatccgccccacagcttgcaaaaacatcatcgaactcgccaaatccttggaaaaacttgtgaggcattcgagcaacctcatgccactccttgttccggagctcccagatgccaattcccttgatgataccaggcctatcttgcttgccaatgcccccaaccaagacaagcctctcattgaggttcatcaaacggccacatgtaagagggcacggcactggtatagccatgctcatcaaagaagtgtgagtaggcctggtagataggtcatacatgagaagacaatggcgatgctcgttgttattcaccaaaactcctgttgagtacaccagatagtagaggaccccatcacagatcacgcactcatcacctcctcgccatccaatcaatagttcagtgaagggagacacccatgtatttatctctgactcgtacaaatggatggtgaactcccattgataatactctgatggcacctggttgcaccttgcaacagccaccatgtactgatgagaggtcctggtcacagaaatggcgagagcactgtaatcagccgacttgccaccaggagcatcaacaagcctcttccagtccttagttattgggttgcacacgatgatgcggctcctatcctcactgtccatcagacacaccaacccggacgatgaggaaatcgaccaggtggtcttctcaatgcaagggaagtcgaatccataccacttacgcaggctcgggtcataggtgaaccccgagaccgcttcctcgctgcaggtaaacatgaagtaccaaggcttctgaggcaccattttgctccatgtctgcctccgggcatgcacaatctcatgccatctcttgcaaacagatccagatcttatgacacttgcaacaggcaagaaggagaggaccttttctaaaagatcatcagggagaacggcgtccatcgacacggccaagtctccactctgatcatcatccatgtctccagaaacatgcccataatctatgacctgagcaccaatgaaggaagatggatacaactcccactcctctgaccccattgccagcatccagcgaacagcacagtaactaacgcaagatcctgcatgtgcaagtgatgaaattaaatgttcatgcatcagccacatggtaacatctaatctagataccagagttactcaatattcaacacaacatcaatttttcagagcgttgagtatatatacatcttatacattgcctccatgagctcaaggaagcagaatgtaaatgccagataggtgaaagggatagcctatggtttttatagcagtaaattaatttcaactgcatccactccactaagcagtaaacaaatccgcaagaaactggaaaaactggaatgcccgttgattcggattaggttgcttacagaaagaagaacccccaaaagagaactctcaatccaagcaaaggtttattggcaagaaaacgtatcaatccatgtcaggatggatattcgccggagagcaagaacccaatcgccgccgccgctgtcgtcagtgatgaaaaaaaaaaaagagaaagggaatgcggacggacagcgaaaaaaagtagtattctttagaagaaaaaggattattgtgatgatcgtctgatttcttggcgggttcactaatcgcaaaaaataaaataaataaaaaataaatgaatttcacaagaaaacttcgagagtgacaacaccaaacctgaacacaagtttcttgaaaagggcagcgaaaccgaacaaaatgcgtcatttctcccatgaaacaaactcctactggctcaaagagaaagaaatccaaaccaaacgacaagaaacaaattggagggaagaaagaaccaatccaggtccggtccggacgggatctcccatctgcgccccggccgccccacgaaccggaggcggaggaggaggacgagagagagagatagctacagtgtagaagaagaatggataccttcaatccgattccggccaagattgggggggctcgctccgctggacggagcaccgcccgctcccccgccgtccgggcgaggaggcggcggcggtggcctccgaggctgctcgctggccgcgcgctggaggaggaggaggaggcttggcagccgcagccgcgcctccgggctccggctctgcagatcagagagagagagagagagagagagaggggagagagagatggagggagctgagagggaaagagggggaggaggtgagggaagaagaagagaaggaaggggcattttggtccctagacaattttcttttcagcttcttatgctcaaaaaataaaataatttttttctgtttgaaaatagagcattcaacatattactgtattggaaaatatatttaaaaatgaagtagacgttttttttggaaaaaaaatgttttctaggaagtggataaaataatgcacgacaataattcagtgaagtagcttgaaagaataaggactaagtcgagacttctaacgagtagaaaggttttttacactaagttaaaagtccatgcattaccacggatgtacaagagatgaaagaaaaataaaaagtataagtttatagcatacttagtcgattaggcatataatgaaagtcgcaacgttcacatatattgtaagaaccttatacctgtagccttacatgtcagtatatgttgtttaaccactactactatcatttaaagtaatatagaaataggtcatcaaaattttttctacattagtgataaatataaatagactacaacatgttagattttagcctttagtgacatttttattaaatatagaaaaaaatgcatgttacttttgatatacgctccccatgcatgtatgatgtatgcattatgtaatacgcgatatcttctttgggttgctaagagtctatgccctctaaaattattcctgtggtgagatgaaaaatctgaaaactcgacgctattgctcaaaatgatgaagataaccagttattgccaaaaactagggaggtcatgtagcagttgttcatgtgtttgaaccaacaggtttagatccgaggaatatatactgtgcactgaaatttttcgtgcatactctgtgaatataaattagtaaatatcacgaaaaattctaaaaaaaataaatatatacttctaatagtataacacatatctacaaagtctcattcatattcaagttgattatatgatattattctaacaataaacttattttgggacaaatgaaaggagataaaaataaacttattacgagatggagggagtagagaacttaaaaaatagattaatatatttttttaaagcaactttcctatatatttttaagaaacctccaccatttaacagttcgggaaacacgtccgtggaaagtgagaggttcgaagatgggaaatttctgcacgcttatggtttagggttagttattcctttttaccatttacaggaataactaagacatgtaaaatttcaagagtctaactaaggtgtgttcttttctcccccttttcaacttctatgctctctttttcacacgcgcgctttccaaactactaaatggtgtcttttaaaaaatatatatagccaagtcatattaattcatttttgactttttaactagtacatatatgctaatccactgtttcattttacatgtctaggagaagggttcctaaccccttaaaagaacacagagtcaagggagaagtgccgaatgcgacaacatcatggccctaggatagatgaaaaaaaaaccacattgttaccctagggaagatgtctcgtctatatgccaaggagaaaaatataccgatggacttgtaccacaaaactttggggattaagctataatcatgagttgtgtctccaatcaaattttctctcaggaactctcatcaacacttaaaacaaataaatatcataaaacgtgacgttttatgatcaatatttcctaaaaccccaaatgtattatgtcttgtggcacatacctataagttttattgtgaaaatgcttcataaaatctcacctttattaaaattccaattggtttcaacatgtttgagacaatatttttttaaagtagtaaagacttaaaccaacgaccttaatgaagaattcaacaactacaagtttcatatacactgtaattttaaaatattaagtaaatatttactgaacgtttgcaaaactttagaaccacaataaaatagggttatttgtcaccatcctaatatctaaggttttatgcaacttcaattgtatttaaaatacgaggcattatcgatacattcgtagttgggtagtagattgtttttatatatttaaatctaactaagattttcaggaatataaaaatattttattcaaaacttctctaagttatctttaccaattaatttattttaatatgctatatctctataaaattcctactacacatactctcggatatagtataataaattagattcatcggaactaaagaaataaaaaagacgcgaatattagggatgacctaatatcaaataattagaagttgtgaggtttcaaacccaggccgactagctcatcaccttgtggaactagccagaaaatcgattggcgtttctcagaattaaagaaataggactgttcatataattataggatggtacttaaaaaaacccaaaagacgtccctgaaattttctttaagaaaaaacttctgccgggcctgatatgtcgagtatcctaacgatcgatttggaacagggagggggtgctatgcatggatttgatgttccaaaggcctacaactacaaagatatgatcgagcagaccaaccaaacaaacaatggcgcaatcgtgactagtggtgttggatgaggcctattttatgattggtggagcaagcatgcacgcatggggcctcacctacctaaccagcaaccatctctatgtctatgtctctgtgtgtgtgtgtgtctggctgtgcatcactcacccacaggtcgcaacaaattaaaattgtttgtatatatctcatgacccatccctatccgatgcacgctttgctctgcctttgctgcttcggctgcctttgttggaaggtcatgatggaaggtgtgcagtagtatagctgctactacctctcctcttctctcctccatcgtcgttggcatttatccgtgacgtttgatcattttttttattattagaaagaattatgtacatataatttattttgttgtgatttttcattagtaaatatttgaatataacatgttttcatagttacgattgtcagggttatggataccacatatctaatagtagttaactaaatctcggcaggatccactacataccatgtcttatacggaaactgacctcgagggagttccggataaggaaagacaaccagagttctacatggaaacgacaaggactacttggattgtatccatattggtttctctagttctacttggacaagtggacacctatgggtataaatacaggccccctaggaggagaagggggacaagacaatcaacacccaacgggatcaacacccgacacgatcaacacccaacacaatcaacaaagaagcctacatacgccaagacacgccgccggatatcgacttcagggataagcacggctagtaccctacggtgtctccggatactgtcaggagagatgaaagcgctatctctgacctcgctgggcacggattcgaggaggaaggctaccctgttgtcgactacgagtcagatcgtcagaccgccatgtcgacaacagttagataggctaccccaaatattgtactggtgtgattatcatgaataagagcaataccgacttcggccaacaggatgtagggttattacctgaccgttcaggggcccgaacctgtataaaaatccctgtctccatcccttttacctcagtcttgcgtatatcctagcaccgacgatccccataccatgcaaataccagaattgcgacatcaaacgtcgacagcggcgcgccaggtaaggggattttggtgcttcaggatttcgacgagatgggttcaaaagatggattctcgaacaacaagctactcgacgacttcagctgcgggaagatccaacccgaccggagtatgtctcccgacgagatcggaaccaccgtcgctaaaaattcaatctgtcgagatcgtccaagtctcaagaccttcgttgccgtgtaaattctactctcaagacagacaaccatggtgcagcacgccgaccatcccgacgatctatggcagaggaactagatgtcagggtcaaccgattccggttgtcatcaggacacataccaagctgtattttttggtctaattcctactcggaccagaaacagagctctgatcggcaattgttgacggcaaaactgcacgtgtcagagctggatcaaagggagttttttcacgtgtacaggagtatcttatacaggacgactgtatggattggttcaaaatctactacatgtacataccggcaacaaaagttaattagtagattaattttttaaattagtctactaattccgtagatatatccggcatatacgcaatattttatatacaatttattgtacctatttttcagacttatacagtattgtcagatcaataatttgttatgtttacctagagcatgttttttatacaatatctgttgcgcgggtgtccccgatgttaaatcgactacgatctaacactgggggctcgctctgtcttcttctatataaatcatgcttgtttacggtctacataatatctgatatttacatctgctcgttatgtccagtacatactcgatattatctactatatgtctttgtcttctagaaaatatttttcaggaacaattgagcactcgagaaggttgtggtcgagtacactctattatcgagaacattctcgacaaatgcggagttatcgcacccgacctaccaacgaagaccgacgacctatctcatagcaccggccatggctggactactcgagaaaaggttgttaacggataattcctcgcgaacaccgtcggcttgatcacccgacatgattgcgaacggacatccggatatgctacaagttgggtgtgtgagtcatgctggccatatgagatgcacataaaccaactctagcgcctccattggtgttcgagagataattctacacgttcgctggttctccaaccagcacgtagcaatctctcgcacgacaacctcagatggtcgaggtacgactacagcaataacgcagcggtcctcgcaccacgacttcaaatgatcgagagacacctactcactggttctcaaccagtcaatcatagcgatctctcgtacatttacttctagtggttgagttacgactactacctggttctcgaccagcggtgtagcgattctcccactatttccacttcaagtggtcgagtttagactactgcctggttctcgaccagcggtgtagcgattctcccactacttccactttaagtggtcgagttacaactattgcatggtcctcgaccagcgatgtagcgattctcccattcccctgcttcaacaaagttgatatcaggtgcacaagatcgccaagtgttttacccagagatcccttacccagatgacacctagcgttgaaacctatcctactgtccctttacgccgtcttgacaaggcctccgaggaacctgagggaacttcagctggggacgcccagagccgataaggccttgtcggatccttcagagatgaaagaccatgtaagatctggtcgtgtaagagttctcgccgtacgtattaaccaagccgtgtaatcggaaatggattttccaacttcacagctgggggctaggataagtgcttgttcaaccgaggcaggtcaaaggtccaagagccttatcttctgagaacgattctccaacgacaaggctgggggctagggagagtgtatgactctacaaactgactgatcgtagttggtaagagagaagacgctcatatacaaagcactggtctgtacattcaattcactagtctgtcatattatagcatgtcaccctttgagcattcgctcgggggctatttctatctaatattcttttctgagtattgatttcaggaaaattctattcgacattatcgaagactccatgtctctatggttctacaccaagatcgactaaggcgagtatgacaaatgtcgacaaggctccgtcgcagactctacgccttctcgatcactcgagaacggttgctggatttcgacaaggaatacggaatgaagagatggtgtacccgctgagataaaatttcatgacttcaatccaaattctcgattgcagcaagacgggagacttagtcgtacgctctgtactttctcggtcgacatcagagattgacttagacaaaccctttcggtgcccgcacgaggctgataaaggaagtctaacgttatctctaaactcaccgagaacggtcacgtgagctcgataacagttcctccaaagtctgcggttgagaatatgaactcgttcatttgcatcgaagtcgggggctactgtcagggttatggataccacatacctaatagtagttgactaaatctcggcaggatccactacataccatgtcttatacggaaactgacctcgagggagttccggataaggaaagataactagagttctacatggaaacgataaggactactcggattgtatccatattggtttccctagttctacttggagaaggggacacctatgggtataaatatagggccccctaggaggagagggggggacaagacaatcaacacccaacgggatcaacacccgacaggatcaacacccaacacaatcaacatagaagcctacatacgtcaagacacgccgtcggatatcacttcagggataagcacggctagtaccctacggtgtctccggatactgtcaggagagacgaaagcgctatctctgatctcgccgggcacggattcgaggaggaaggctaccctgttgtcgactacgagtcagatcgtcagaccgccatatcgacaacagttagataggctacctcaaatattgtactggtgtgattatcatgaataagagcaataccggcttcggccaacaggatgtagggttattacctgaccgttcaggggcccgaacctgtataaaaatccctgtctccatcccttttacctcagtcttgcgtatatcctagcaccgacgattcccataccatgcaaataccagaattgcgatatcaaacgtcgacaacgataattttttaaataagatgaacgatcaaaccacatgacaggtaagagtcaacgacatcgtatatttagaaatggagaaagtgcagggtgatcactcatacatgcatgcttaattaattgtggagagcaactttgttgctgtccatgtgggcgatgctaaaggaaaccattggcttgctaataatgtccattaaagtgccttttcgtgattagtgaacttcttgtttgggattattgtattgtgattcagccaaggtctttaaactggttcgacggtataagaaatcgagaaaggtcggtgggcaagtggctatgggtttgttgatcactgttcttcgataaactagcaaaatacccatacatgctttgatatgggtaaaataataagagtaaattgtgtttagggccaccttttatcactaaagttttactttgaactaccctttaaaccatcttttcactttggactagattaatttgcctttgtttcattttgaaccacccaaaaactttttcgagcacataaatgactttaaccacatcggcacccataaaccgataatcttcccgacttacatgtagactattcttcgcaagattagatggtagatacaactagaaaagtaacttggggtggtccaaaccgtaacaaaggtaattttacctagtctaaagtgacaatattagttagagggtggctcaaagtgaaactttggtaataaaaggtgaaccaaagtacaattaactcaataataataataataataataataataataataataataataataagttgttatagacatgtttgcttatttgaatatacataatatgtccatttgattcaaataaatattagactattgtataatatttaaaaataacaaagactaattttaaaaagaaaatacaaatagtgatggtgacagaataaccaccactactaatatcttttataggagtatagatactcccaatagttccaaatgtaagtcgtttaagttgttttaaaatttatacgtaattctacagagcctcttttttgtttgcccttgctaaataaatgctaccccttttatgaataaataattctttttatgtagtataaacgaagggtaactaagtctactgttggaatcaaagtgagtgcaccatatctcattatgatatgtgtacatgtttggtttactactatttttagtcataatagatacagtatttggcactaccaaaatttgacaagataatagacaacatgtctcaaatactttttttaccaactttggaaattctagaaattaactttctcaactgaaacaacatgaaatctatctatctatctatctatctatctatctatctatctatctatctatctatctatctatctatctatctatctattatatactaaaagtccattaaacttcctagaaacgctcttaaactgccacatagcgtttctacaaatactcctagaccgccacatggcactgtttaatctcaccgtcgatttttatttaaattggtgacccaatattatagaccattagattagatgtccttttttaaaaaagtactttcacatctatattgtgggccggacaaagaaacaaaacgtaagtaatccgatacttacgtacgtacggagaagaaacaatgaatcttatctccccgttcaccggaataaaggaaaacatgtataccaacttagataaaagcgattaataagtaaaaaaaacataattaaagtaggtacgtagtgccactgaaaagaaatcgatgctccataaaatatgatattctactattttaaaataaaatatattactctataaacttatgcaaatatacatcattaaactagatcgtttacaatataaaaataaaatatcctatcaatgctctttaaacatcctatctataaattattttaaaatcatatatctaatttgtgatccagttggaccctccaattaaataaactattgatgtctatgttcataaatacatcataacacatgaggtcgacatataataaataatgttataataatatttgaaaaaataatgaattatcccttgaactattacggtagaccgaattaccctcataaacccgaaaaccagacatatttcaccctcaactattaataccggacgaattaaccctccccctaccccgactcaacgcggagtggttttgatcctgcgtggcaattcagttagcattttcttaaaaaaaatagtgggacccatatatcatatctcttcctcaccccttcatcatctctctctttcttctccctccacatctatcaatcggcaagtctaggggcaacgagcggcggaggcggctcctcctcgcccaccgccggtgggcgcctccttgacggtcgcgtggcttctcctcgacctgcaccagtgcgtgaataggatgacagcggcggggcaagggagctcaagcggcggaggcggttcctcctcggctgtctcggtagccacatgcgcattccagcggaggttgtcatctccatcatttccgttgcatatcgtcgtcgcgtgatgagagttgcagctgccgaaggcgagcacctgtgctggtcctcaatggccaggttcggctatgcccccgccatcaagaactcgcccaacaaatgcggcggcagctctatgtaccatagcgtgccgtcccaccacggttcttaatcaatccccaccaccaatgcctctctcccgacgagacaacgaggtggatcaatcaagcaagcaagagctggggaatggacgaaggaggagaggaagagcagcgggcgacggcgtgcttgccggccggccccagcagcaatgggaggaagaagagtgaggctggggaatgggattgaagaagagagggagagagagaggtgagagaggagggattgagagggtagagagtgtgacaagtgggccccacatattttatttttaaaatgcagactggactaccacgtaggaccaaaaccacttcggcttgattttttttttgggaggggggggggggtaattcatccggtattaataattgagggtgaaaaatgtctagttttcgggtttatgcggtaattcggtcgaccgtaatagttagggggtaattcgtacttttcctattttaaataattttacatcatattttaggtgtcaaataacacttgatgataatataatgctaatttaaagctacatatgtaaaataattgaaaacaatacaaattagttgtgtatttttaagtagatatatgatttaatttaatatgtttgagattaatattttttttgaatttttagaactatatgataattgggcaacataaatgttacataaatgtaaaaaaataattatgacaatatttcaagccaatgatcttgctataaaacaaccatttagtccatcatgagatttatggtcatatatgtatgtttttctctttgtcaaatagttttcataacaaatgaacaatcaaataacatacgcaatatactactcatgatatattttcttatagttgaggaattccaacatatcaggcataatttgatgattgtatgtcatgcactctattgatgtgacaatgaagtatacttcaatcaattagttattataaataagtttgggaaaatagattcattctccaaattaattagtaaaggtgtcttctgtcattatgaagaataggcgttgaaaaacacaagccgcaaaattatagatatttgtcaaaatataaccaacaatatggtatattgttcctttggagattttatcgtagtggtatttaaaaaaaatactttattcaggttaaaaaaaatcacatatagtacaaatagatatgaaagaactacattattccattattgttttattttttttgactagaaaaactgccagttctttgcccagcagtgtaattttatataactcaaaaaatatttacaaagttagagtaagaaaccaaacaaaaatataaagtttgtaaccaatcagaaacaatttgttttaagggatcctttattctgcacatatgcagaagaatttccttcacaaaaagagatctccaacttggaaggagggctgaatgttctggaagattaaaccattccactgcttccaaatgtgccatgctgccaaaaagaaaacctccaggaagcccctctgagcaaacttgagtttttctagggtgatcatctgaaagaactccaaattatgatccactgaattcctaagtgttgctagcatctgacactgaaaggtcaagtgaagaaaagatgaagccttatttctctgtgatgtgcattgcacaaaagacatgtgagatcatcatcttctttggcatagtgccttctatcgagcatatctcttattgttttattatcgtgacacatgttgttctcataaattcatataataaattcaaggttgtatggtttaatgtaatatgtcataattagataataactaaagcatgtttaaaatagagtgaagatctattttgaaaatataatctgcatataaacatttataataaaaagattaagcaatattaaataagtacccgcgcatatgcgcgggctaccttcctagtttctataaaaatcatataaaaacactatcgtgtacctctaccatctcaaattttggttatgtttgacatcaaacaaaatatgccatagatattgatcatattacatgactcggctcaatttgaaagagattattgagtggattattgctacggattatctacataatagtagagatatattaaatattttgataaacaaaattaacaatacttaataccagtgttctaaacaatatacaattaatataataaattttatttttgaaaaaaatattttttaatgcatggaacaaataatacatttcaataatctggtgaataatatacaaaataaataaaccacgttttaattatgaggctgcttgtctttgttctgggtagaaataaacgctttataactgaacagctagatggcatgcatgttgcttaattataaagcttgtagaaggccagaaaactatatacactcaagcataattaacacatctataccgcgataatcttgtacgtgctgtcacaataattcgctgtctaatctgcataataaatatataaacctattggcagtattgagagtttgtgactggtcgacaatgacaacacttcagaatgcttattattggactaccttgtcaatctttatgctatgtgcgtgcttattttgttgatcgccatgtttaggcaataggtacagctgccttacaaggatacgtacattacagtttaccacatagttatgttcgtttttttagttaggaactctacgcacggaaaacagagcgacatattttcttattattaattaattatttacttttttaaaaaatatatattaatatgattttttaaaataactttcatatataaactttttttaaaaaaagcatcgtttagcattaagaaaagtgtgcacgcggaacacgagagaagtgagttggaaaaactggggaagaaaccatggcttttaaatgaaaacgaaccaataatcgtctataatcaatcatttgatcttcggctaattagccaaaaaaacacaataaaaaataatttatgagttacacttttataagggtgttgttagtaatttaaaagccaataatacttaaaaacaacgaaaaaattaaactcaacttaaaattaagttctaaaatttaaattttgatagtagataagccaataggcatacgataagaagctataaccgttaaatcattgaacggaccgttaaccttaaaaatcgtttgagattaaacaaatcattaaagagctcatattaaccatatgaaatgaccttctaatatataatcaattgtttctaatggtttgttcaatcgtgtgacgaaacggttgtggcccatttgatagtagtagaaagttgtaagccaagagcccctacttcaggctcaagttcagatcaaattgatatcgcacattcacacctcaatcatttttaagataatcatagaaagcaaataaggttgtcaccacgctcataaactcaacttttgtgtgcggttaaattaggctctagaatggcatttagttgagctgaatccaacgctccaactacagaaatagttggatgataccgatatattaatgtgggtgatttgtactatatcttttttgacatgacaagagatgcatatctattgggaaaagcatatccagtgaccaaattgtgtttggttttggggatgaactaaagagatgagccacaagcagtttgtattcttgcaggtgtattccttgaattccctgcacgcacaccttgatgcggtggatgcaaaacaaagagacaaaataggtgcctttggagagttgcatagttataacagtcttggatgagtatagatatgtcaagatgttgtctaaacttttgcatactttttttggttgaaaaaaatattttaagaatgattgcaccaaaactatttcaaaaataaaacacgatttcagcgccagacatgatgacgctaaggttcgtctcgttgctagtggtatgagtataggtatgtcacgatgctgtctaaacttttgcatacttattttggttgaaaaaaatattttaagaatgattgcaccaaaactattttaaaaataaaacacgatttcagcgtcaaacatgatgacgctaaggtccgtttcgttgctagtggtggtgtggacacccttgcggccatggaacaatatagaagtgaaaggaggtcaacactaggagatgattgttgaccgttggtactaaggtatacacatgattttggtacaaaagataataaacatgtattttttatataggttcgggctttaacttataggtaataatgctactcttattgaccgaagctggtgctgtctttatatatcaatatctcacgagtactacaatatagaggatgacctaatctagtcataaagctctcacatgtgatcgacgaccagcgtagtctgctttggagcagtattgtattggattgtttagatatgtcttagcgtgtcttcgtatatcccctctcctcctagggtcttgtatttatactcttaagcgtcccttttcaagtagaactagggagccaagtatgaatacgatccgagtataccttgcagtgactaagtaagattttgtttctcttttcttatccggaacaccttccgtatatgaagctttttttttataggacttgtattaggtgggccccactgagtctaacacaaaagtattagagattggtttggttcgtggcttaacttgaccttaccaatttttgtcaatgccaaattttcacaagtttttgcatgtttactcttggcaagacaaagttctatttagattgaagccaaaatagcctaaattaactattgaaatggcctatttttctaggcttttgtcaaaatttggcttcaaaccaaatagacactaaacactattaaaattaccaaatattggtaagaccaatttaggctgcaaaccaaactagccctagatatgccttatccaagcaagtaacaatcatctcccaatctaaacacccatggatctggcagcaaggaagggacctcgaccaggagctcaacgagggcggccattgtccagatcatgtggtgccactgccgcctcaagtgctagcgccgtcgtattcctaacgcctaccaactcattggtcttccacatcactgtcgtccttgtcaatcttcatcaactccaatgccgttgcggcctcatcaagctctagagtttctggtcacaagtggaagagacgtccctctaactttacgtcgaagctcctctcattcctggtcaagtcccctattttagagaatcttttaccactatgttgaaagatcaataccaacgtgtcagcactgacctcttgttgatatcggcctccaactctcactctaggcaccacggcctctagctataagacattagacctctacgtcatttggcaattcatttttctaaataagttttttgcacgagccgttgttaaaatacgtcttttttttaaagggtgaaatcgtcaatatatcagacactccagacacgtttgtgacattcccaaactcctggtgaatacaacctgtccccatgtgctagcacacttgcctactaacatagagtctagcaaaaccacgatatatcaactcgtttgtagctgctacttctcctctcatgtcactattccacatgtctaaactctagaaaggggatactatgttggatggattgttgaccacctatgaggtttgctgctcattcctatttgagattgcttgtagatgcggcaaatgtacatgtagccctgtcaaatcctttgcttatccttgtttttggagtaagagttgactgtttgtataggggcaccacacgtacttgccgcagtattgaaattcactacggcactcatgttttcaatgcccatcttgaccaaatttctttttcaatctctcaggttttcaatgccatcttgacaaaagcttcttatttattcgtgtacgtcgggccgataaaaggacaaaagtacatggtttggtaaattaattttatttgttaataactgatataatttttactcatagtttgattgttgaaaaaatatattaaaaaatacttagtagttttctcgtagcaaaacacagaaaattacctaattactctcatgtttaagaactgaatcaacctggcagcagtgcagcgttgttcttgtggtggcaaacaagtaggatatcaactgtgccccagaataatcaaaggcatgctagtgcactaatgagaatggccactaataaattaatgcccactacaatgtatatgtgccatgtgccagaatgcacataccacctttcgtttttgtgtttcatgagaaagctaacatggtgctttttcagtttttttagcttgcatgtgagtcagatcagatgtagaccagacctaaaatgtcagaccatgagaactgtaaatctctttcaagaggaatcgagtcatcaaccaaaaaagaagaacaatgcaacggccaagaatgcatagaaccgcacatttttgtaagtggtggctcctccgctggcaaaagaacctaatgaaattagcccattctttcacccaaataacctacgtggaaagaaaaaatgtaaggtatgcattaagccattaagcgcggaaatttcctgtgctaatgggtaaagtacaaacacgcaataaataattttaaaaatattttatttttcgcatggaagaaattcctggcaaacattttccttttggttggcatggcataatccactcactagtcattgacaccacatgctttaattttgcgatgtctcaaccatcagccagtttcaatcctatgaaaaagggaatggggaaataaattgtagggttttttttttaatggcaacagttgtgaaattggccatcaagaacacttccattagttccgtaaggagaggctcatggacaaagagttaaatggatatctatatcaacttgaagtcactgtcctcatgtcattgtctcgagtgacactaatcttagccatataggatcctcctcttgcttcggcttctaaagcgatgttgagacttgtgagactgactagtcatcacatttttgtatgaatgaagtatatttaccatgccttttaggattccttgttaaattcatggatcagactgctatggaaggttcgggtagttcctacagtatatgatagaaagggtatggttgggagtttttctggtagttgtagctttttcccaaaatcaataactctctcaaacaatttagattttaagaaggtatagttatagaatccacgagtccacaaaatgaactagaagctaggaccagcttctcacttcctagattcctaccagctgcttctctccaaacatgcccaaagtcattcctgactatatatcagaagtgtgcaatttcaaatttgtatttttaagtagcatgcgccttattatttctagcagatataggaatagcagtaatttaaggctagtatggtttgtggcctaaactgtccttatcaacatttagcaatttatactatctatatagtttatgtccacgaacttttaaaactcaacatgcaggtgcgccacatcatcatccactagcaattattatctagattattttaaatcacatacaagtgcgtcacatcatcactcactagcaattattatctagagtattttaaatattatgatatatcatttacaattttattgtatctttagaactcaatatgcaagcagtgtgccaatgccaaatcattatctccacattatttcacattttttacaacatatacatctatcatttctataatgtataacatgcattcatcaacacatcccacggcgaaacacgtgatatcaactagtttcaatagtgtttagtgtctatatagtttgaagccaaattttgccaatcctaaaaaaataggccattccaatagttaacttaggttattttagcttcaatccaaacacaattttaccttgtcaagattagccatgctaaaacttgctaaaaattggcatcaacataagttggtaaggtcaagttaggccacaaaccaaaccagcccttacaaacatcaggatcaattgacacttcctggaaacttcatgttagttgttgtactaacatgtagcaaagtgggctatccaacatgatctagcaaagattagcactagagcaagatgcataaatatagacaaatattcagatggatagatcatggccaatcattttgtttaagacactggcatgctctgctaatggaggccctccatgcttaccggaatctcgagtggtccagagtgtttcatagctcacatttgcagcaaaagagcatgggaggcgtggcatcaagtgctgacaatataggagtgtattccagtaacaggctatcttatgatgtttgccatgctctctcatatttttattttattcccctctgtattgtcatagagaacaacctacttgccatttgtctaagaaacaagatgagtgcaataaccatgatttggttcattggcaaagacatcatgttccagggaagaaagtaagatagcataacgcaatactattcgggactgtaccttgttttaccttctactatcttgcatgtctgaaaacttttcgaagacctgactgggtcctattgttatcatgatactgcgccgttccaagtcgaaacctgaaaaggtggatatgccttttcatgattaactccagaatccagattcatgactaactgcagtcttacaatttactggacaagaatgttacatctcccaccaaaaaaatatatatattatataatcaagcgagcaacagttcggcatttttacgctattccgatgtcatgtgagcaatacctcccatccgattctctttactacttatttcttttcttaagctatattattagagctaactcacttgtcccaaattacttttcacaagttgagatatataatcagatcacagctcgatcaggcagcttatagataaaaaaagcatggcaaaatactggatgcagagcaatcacctgcatgcgttgcacaaagttcagctcccactcccctgccacatgtcctgcatcaaaagcaacagacaaattggagtgagaaaggacacatgaagccagcacatgacgaacttttggtttcagatcatacctggccttagtggaaatagcagaaatgataatgtgcatatggtatgtatggagcagcagcagctttcttaaccagaaaaatagcacacaaggaaaatattcaactcccttatgacattgatactccgtgttaaactaggctacatgagcattacaaggacccaacacaggcatgatcttacattctccaatgcatagtaccacaacactcatgtgtacattacaagtagtacattcatacaggcatggttacaaacagctacatggaatccataaacacaaactcaaaacttcagagatcatcttcagtggactttggccgttgcttgcctggttggtctgtgtacccttacctttggcctcttcttgcgcgccagcttacgctcaagcgtcttgaccttctcgctcagttccgtgataactcccatctgatcgctgccagatgcaagaaggttttgcagcatctctttcagcttctggttttcttcagcaagtttgttctcattgtcactctttgaactataaggagtcgcataatctgaagtagtttcttcagcaaccttgttctcatctttcataccatcaggagttgcagaagccaaggaagcttcttcagatgccatgttctctgtctgaacactagcatcttccttcggattatcatctcccagctcatcgcattcaacttcctttggcacctgcatgtccgcacgacgcctatcaacgcagcaactctctttctgcacatcggtttcgcattccggtggcgcatacatttcggaatcctcatgtcctgtgatgtcaccatgttcacatgataattcacttctctccgtctctggcaaaataggttcatccttcaattctctaggagcactttcatgagtatcagcttccattcccagtcccacaagagggggctcttctttcgcagaatctcctgtcagattgttagcggattcattttgcttaccaacaagtactgactcatattcaccagaaacgtcagattgctttgctgcttctggttccttcaggacattttgtcctgttgttgattgcaattttgatgttgtttgcagcaagggagactgcacataattttctgtgtctgcataggtaacatcaaccataccaatctctggtgtagcatcagattcttcggttgcatcttgtgtggtatccacattttcaacttgttgctgcatgttcacatcgctagcttcttctggctgctcggctgaattggacataatagaggatcctgaaggagcttgatcatgatcctgcagctcttcattcttcaaggatactgatgagtcccccgaatcaacaattgtagtgtttggttcttcacactgatctttttccacaggagcatgctcaactgcagcttctgtcacctgaccttcaactgggctgacctgtattcatggcatacaacattgatattttacaaattcaatactgttgtatgggtaaagttcaccatcaaagaaataagtacaagcaacttactttatcagctgacacactactttcaacagatgttgcagccatagtaatcatactgttgtcagcggcagcaggagaaatcattgaacttgatctctcactagttgtgcactgttgcagctcattggagttctctgataaagcttcatcatgtaacggttccatgtggtcccctgatggtatttcctgtcctccaacggggggtacatctttttcctattgacatgaagagtcaaattagttcatgccaaaatattgtgtgttaattaaaggactgcatttgccttgctaattagttttttactaagaaagtagattgaaatgcaacttactctttcacacgatttgtccattgaaatggcatttgattcttctatttgttgcttctgctcagtggaatgtcccaacaaagctgcatcacccatcacatccattgatggttctccttgacagtcacactgtgttgcaactttcccctattgaagatgagttacgtcagataccccacgagtaaatcaaatcaatctgttacatatcaatttgcaattaggccctccaaaggaacagatagaaattaacttactccattattaggcgcttcttccttagtagtatttgactcttctatatgatcactaggatctgcatcttgtgtcgtatacattgaaactactgatgaaactgcatcaggcatcaacagcttggagttgattgtggacaggccttgttcttcatccactcctgcagctttttcctgctggcaaatatttgttgaaattacattgtaaattagcatgttgtcatcatgtaaacagtaacaaaattaaggctccattcgaatctaccactctaactaaactactcccttgtctaccatgagcacatttcccgaaccgttaaacggtgtgttttttctaaatactttcaatatgtaagtttctttaaaaaatcaaataaatctatttatcaagcttgtaataattaatactacctccattttaggttataaaacgttttgactttggtcaaagtcaaaatgctttaagtttgattaagtttgtagaaaaaaataataacattttcaacccaagacaaatttattatgaaaatatattaaattaattatttaatgaaactaatttggtattataaatattactatatttgtttataaacttagtcaaacttaaagtagtttgactttgaccaaagtcaaaacgtcttataacctgaaacggatggagtacttaattaataatgtgctaacgacgtctcgtttcacgtgccgctgaaattatcagccaagatgcaaaaatgaacgcagcctaagttatagaatgctatgaagggagaagtgagacttactttctcagatgcttctattgctgagactggatctgtattttgaaaattattctccattgcctctggtttctctttttcaccatttgtgtgaatagactcgccagatgattgcttgcataaacaatcaagtttctcctgcagactaattagctctcgagcaacagacttcctagcctcccttacagttggatgcaagccctgtatcaacgattagcatcaccaaggtgaacaaccaaccaacatgcaattgtccataaaattgtaccacagtaatttaatcagaaacataaaatcaatctgaacagaaaaaggtggtacctgaatggtgtcaagcttcaggagtaaattcatgatagtctcattgatagccacttgctctttaacagtcagttgcttggaagaagcttcaatgccttgcaactgctccttcagatctttcatctgttcatttacattcttgatcatccggagtttctccaaaggttgccatcttcgcacattatatccccggtatgcagactgaatacaaactgctgcatctacttctgagaaattaatgctgggagttgtatcatagtcttttgcaggctcaccttgaattttcgcctcaccctctgtgtttttgtcagatccctgcaaattcttctcaccaacattttcctgagcatcaaaatttactccagtagcttgcaccttctggtcagccagactcatgggaaattgttcctcctgcatttgtttcacagaagcagcttgcacggtttcattgccatatgccctccctttattcatttcatcatgtgctttttctttagcttcagatacagttctctccttctttggatctgactgtttagcgtcctgtttttgcatatggatctctttaacatccttcttggctatatctgcatccttcctggttggtggactgggagaccttgaagaaccacttccagatttcttcctgggcaaaggatccacccgcaaacatacaggaggcaattttgaattctttgcttttgatgattcttcattgcttcttttaccattttcttcttccatctcagtgctgctggccttcttttcatctctctgcacacttgcctcaggcttcttgtcatcgctttctttcacaggcataacaggaataatcctgtaattaccaccagcgggtttgttttcttcattgtctttcctaggcatcactggaattgtcttgtaattttccctggcgggcatcttctcttcgctttctttcttgggcataagtggaatattcttcatttccctgccatcttgatgctcagtacctgcagactgcttcttcactgttgatctttcattatgatgagattcatccttcacagatggcttctgatcattgtgaccattttcaaaccatgacaagggaataatcttgatcttgggcgatggaggagcttcttcagaaacctttggactttcatccacctccttcagttcttttgcttcttgccttttctcattatatcctgctggcatccaaaatattggccactgaaattgtttagccttctgatcatcctgatcttgttgcttcacatccccaacccacttaccactcacaggaatccaaccattgtagaactgaggtggcaattccatgctttttttgttctccttatcattcatgttgccagaaggaagccatatagcctggttttggtaatttggatgtcgaactatatcagaaccgctggcatccctctgctcagtgtcgggattgacttcaggcctctcttcttcaattttaatattgctcctctcgccgccatggcaactatggtttgggcatccacagcaatggctcttgaacttgtcatagccgtatgctgtctgatcaacaggatacggcggtggacgtgcaaagtaagaagggtaggcattcgggtgttgtggaaaaggaccatggtaatacagatgaggtggtggaatttcttgaggggatggtagcctgaaactgtagtaaccaggaggatatgtgtggttgcagcagctatgaaactctggaggatgcaggtggttcatgttaggccaaggtccatagctcggcggtcgacaggacgagtccattgccatccgtggatgactaacttcccaacacccagaaggaggataatgtgcgtaaggagcgtgatttctgtaatgtgaatagtatggatccatgtactggtttgcaggatacatcactaactaatttagtatatactagtttgataaatacctagacctgccgaacaggttctagggctgatacctgaaaaaatacataagaaatatattactaccatgctgtgtagccatgaaggacctaaattcgcattatcaaaagctattagttgaaaaggatgttttactttctgaccataaataagaactagcgaaactacattcttaagcaccttctgatcagattttaaattaaaacacactatatgctatccaagctatcagtcgattattcactattctctctcgtgcggatttattggtctgtaactatcgcagtttttatgtcatttgttggtacacaatactattgtcttgtgcaagatggtttagaaaaaaatgtccctaaaattatcgagaaacatcatgcacaaaatagaaacatggaaaagcgattccacagaacaaattagcattaaactagtgtatagtaccaaattagtttcatttcacctagtactctataagaagtttatcacaaataccaagaacaatattatcagttgctcctatcatgtgtggttactggtcatgtaaacatcagtcatcagggagcattcggtctgtcaaacttcaaataattaccagagcactcccccatcacttatctacaagattctgctaccttcttccattttttttaaaaaaaaaaacaccaaaaaccaatgttctgtcacgggaatgccagaatttcagaaaaaaaaaatctgggctaatcgcagagaaatccttttgaacgcgttcgattccatcaatcacccggttttctcgtccccaaaatgcacaccgatgccaattgccatccatcgtaatcagtcacacactagtactaatcagaaacaacagatcgtttggctcatgatactacctaccaactcacgcgataaagcacaacaaccaaaattacgcaaaaaaataataataataatgcgacgcgaagcaaaaaggatcggaggggactcacagagcagagctgcccccgatgtgcggtgcggccagaagataatccgagacgaacaaccaccaccaaaaaaccttttggatctccacggggccgagtgaggtcagctaccggcgcgcgatgcggtccgcttttccctagttcgtcgtcgtcgtcgtcgttggcgagcgcgttgcttcttcttctgtatgaggaggaagacgagcggatccgccatttatgcggcgcgggcggcgggcggagggcgatcgggagatggagaggagagcgttcgcgagtgttcgcgaggaaggtgacgactcgtcgttggcgctcgttctggacgcttccaccaccgtctccctcgactcgaggaagatgaccgacctgtggggccgggccgatacctgggcctggactgcaggaatttcatggggcaggcctaacacgtttatttaatgggccggtaaataggagcttaaggttttgcataggaataagtccattttgcctccctcatctcttgcgcttggttgaatcgcatccctcaaccgcaaaaccgggtgtaatatatcccccaactcccaaaaccgttgcaaatcgacttcccgggcggtttcggaggcggtttttgtcccacgtggcatctttgaccccgttgaatggctgagtcatcaggtgggacccacatgtcagccagccggctgctggtgctgcgtggcgacagggtggccttttcctcctcgtcatcgtcgttctcgcccgacgccgaactcgagctggcggcggcgggctggcggccacgttccgcatcccgccgcagctagagtgcacgcaacaggctgggagggggctagcggcggcgttctgcatctggtcctcttcgtcgctgtcctttcccgcctccccaatcaacgccgcctggtccgcacggtggcgagcaacgatgacggcaggaaccccatgggtgtcaacacggggtcctcgatggtctagcgatcgtcgtggaggcagtgtgcggaggcgatgatgtacgtgccggagatggagaactgtgccaccttgacgctgagcgggctggcgacgtcgacggtccacgctgtgccaccttgacgcccagc

SEQ ID NO: 27993 - DNA, 13026 bp, Oryza sativa
  unsure (1)..(13026): unsure at all n locations
nnnnnnnnnnnnnnnnnnnnnnnnnnnnnnnnnnnnnnnnnnnnnnnnnnnnnnnnnnnnnnnnnttttgactctggttttgtccgacaatacaatattatgaaatttttcatctcacgaaatgacaacaaaattaacataatgataatatattagttaacaagaaaaccattgcaacgcacgggcattatgctcttttacaaaatgtaccaaacttatgatattatgacattatttcttgaggcaaattcaagcatgcaattttttttgttgtttttaaatttggctgtttgaaatggcatttggctcgagatagggacgaaaacggcttggaaacggacggagactatagtttccataacttttttcggaatcggaatcggagcaggaaacctcaaatatgaaaatggtattgaatatgaaaacatagcgaaaacggtaacggatatttatcataatagaaaacccctcactgaatttttcaaactaacgaagagtgtagctcattacttttctaaaataataaatcgacatttctatattttttttatcaattttaaatataatacgactagttgtacggttcacttaccataagaaccaaagctatattcatctatacctgtaattagtatggcatggccaaataatgaaacagtaactaggcaaaagaaaaaacatctaaagtaccgtactaaaatcaaaatcttcattcaactaaccacctcaatactatgaaaaatctgaacatagagtagagaaggctaaagctaatcaactgtatatgaaaagttttcgtttccagaaagtttccaaaattgtttccggaaagtttacgatgccggtttcctacgaatagtagccttactgtatttgtttttatttccaagaaaaaaagttccgaattcatttccgttttcgaaaattttcgaaaaaaaatgtccgactgacactttccattttcgaaaacatgtccggaaaatgagaaactttccaaaccgtagctcgagagaaccaaaataatcttctaacaaatttcgagcatataattcaaaacagctacgcaaataatagaagacattgcacaaagaaggctgctccatgttcgtttactaatgtctcatccagttattttgaaacgggaagtagctttttttttttaagaaaacgggaagtagcttttagaacttaactagccactttgtcgcgcgttgcgcgactttggtggccctataaagccctgtatgtatggatcgtaatgtatgagattgtacaatgatgtctaacactcttaatgttatgttgccatttagaaagaggttacataagtgtgatcctccatgttgctttattcctcaaacagaggcactgaaggtgccattcctaggtgagtggaagtggggagtgtctcagatgttgtgaacgctgcttagaaaattgccatcactttgaaccaccaaattggcacaagatcactgttggatgcaaaaagaaaacatgttatcttataaaggaattaacatgatgagcttggtggtgaaactttagtatttaggagattgacgccacaaatgatcgagaaaggtgccatggccgagttttcatgtacaaaatgttatgttgttgaattgtttacatctaacagatggtaaagaatctagagttcactgccctgtttataaacatatgtacaatagaaaactgaaattcatgattgcctgttgttattataaattattctaaataacttgccttctatattttggacagactattaaccatggcacgtatgactctatttacctgtctagccaatcattgagcctaaaacatcctaccatattcattttatggtgttaaaatgcagctctggaagaaaaaagatcaattcaacttgtctctataccaagttgctgcttattatagaaaagtttattagtgtgttctgggaataagctgatctggtattgcaaagtgcaaacgttgttggttatagccaaaaaagaaaggcaccgagtcgatattgcgaattgtaatggcatttttctaatatgacatatttgtaatggcatgactcaaattaacccaaaaaaggaatgtatcacacaacctcaaatgtgcttctaccttaaatatgctccttcaccatacctgtgagtggtttctccaatctgtctgagtcatcacacaagcaacaattaatcatcaattcagtaagagaacaaatcaaattcaatagaacacgtaagcacacaacatggagctacacaggcaagaatacttcggctgaggaccggtacaggtaatgagctgatggaataaattcgaaatgacttctgtacaatctaattgatacacaagtgctaggcctggaccacaatattatcgctagaaatcaagtaatgaatgccagcaataagattttcagtctaaatgtggaactatgtactggcatggcatgtatttttagaatcttgatgaaatccttgatgactcacaaccttaaaagggtataaatgaataaattgtttttgttttatatgcctgagcagtacttggaccatatttcagaactttttatcagaatcaactcaagagaagaagtagaaaatgtatttaaatatgtgtattcagattttttaatggactacttcatgatgtagataattagacagtaaattaagatatatcaataatgttttttaacttgagtagagttgcttaaatactgcctgcatgcataccgttgaattctgtatctcgagagatcctttgctcatggcagtctgaagactatatataaattgaatcgtacatgacatttcaaggttaaaacaaaatagggggtgcgtttgatcaggaccttcagttaccttgtttcctaactccatgagatccaagaggcaggacttttccttaaagtatctcttaatgatttctgtgggcatgacacttgagctgatatggagtacaccatcacttatagcagacaaatcacaaaccaacctgacattgtcaaccagctgaacatttcagctatcattcccaagacaggatccagcgctaccatgaagaaaagtaagtaatggacgaagagctcgcaccgttttacctcccttgcttctgcactgacgcatcactgcctctgctgttgattgagggctccacgcggcactcgaccatgccctgtatatctcattctgcttcagcggtcgcttgccttcttcttccgattctcctcttcttgattccataggtcaagctatggtcagatcgaatcaggaatattggaggctggtggctagatggagggcccgataacctcctcctacctatgctctccctagccgcagggattaggaggaggcagcggagatcgggaggaggcgacgcagctacagtgctgttggggaggagaacagctacgaccttagcaggcggaggcagggccgctaaccggctacgaagacgaggatgagagtaggcaagcggcgccccagtctcgccggagtgcgggcgaaggtggacggggagaaggaactgaggtggcggcggcgaggggcgacgagaattggaggcggctttggcaggccggcgtccacggtaggatgtagggggcaaaatgaaaatagcgtaagtacccagggacgtggaaggactagaagtagatagaagtttcctaaaggatcaataagatatttcgccaatcaaaggatcctacggtctgtatcatccggaagcgaaatcgggcggcccgcatttattggatgacgtggcgcagtaatttgcaagaaagcttgttgctttcactattttagatcttttctgtgtttacaaagaaaacacctttcgtgtataatagccccttaacataaacctcccacaagttgtaggcccctagctcgtggctagcctcttctccttaatataagagtttagggtatggtttagggtttagggtttagggtttaatatatattgttagtatattgtaccgtaaaagttctctaatatgggcatagctcctgtttcaggaaaaatggtaggctttggatacccaactcagcatgcactaatttgtattctatagtcaaacacaccatcctgttttatatgaacacacatgatgatattgcaatgacctgtcctaaataaaatagatgtcttagttacgatatccagctcctaattaattaatttacacattatttgtagctcaaaccagaagcatatgcacatgatcggctgccacggttttatacggtttatgatattattaccactgttatagattaacaaatggtcaagtatgtcgttggcaagaagaaaggaatacatgattatttagttggttttgtctagaggtggagacggaagacagtaggtgcattggcatccctcaggagtgcacttgccagtagatattgcagcgacttgcgcgtggcagtaaggcacaacattggaaaacaggggccaggtgtgatggtgaacttgcatgagtcttttggggttctgtcatcgactaatgccttcatcgacatatctgcaagcaagtgaaataaccaaatatttatgtgaaattcacattcaacgctcatgcctttaggcaataaaaaggaatttgtctatgtaattaatttttttggggcattatgtcatgcgaatcttttaaccgtaggattcaaactgaaccatctagatctttgctgcattctcttcttatcccgttattttcttcctaggtcaaccgctagatagaatcaaggtcgttaccggacacaaggtgcgtgctatttccatcctccccactccctccaccctgcaccccaccactctgtaccctatcggtgtcacctttgtagccatcaaactacagcaccccctccctatcgccatattctccttacaaccttgtttcatcttgatatcgctgttggatccatcgcagtcaatgaccgccagcgaacctcttctttgtggatgccccctacccctggcctcttcccccaacacagctttgtcagcgcaacaatcacctctcatcgtcatcacctattggttgtcctgcatcaccctgaacaaccaaccccctcccccctttaaagtagggaactcctcccaccatccctcatcccccgctgccaacaccacccactccctccttcaccctaaccccttaccttgaccacttgtgaggttgtcaaagtttatgggagcctgttggaagattaatccggatctaggtagtgcaggtatcatagagcaaatcgcaaggtaaaaaaaaaatcatgattttgaccccaaatttttgccaaatgtaatatagcaaatccgtaaagaaaaaagactatctccacccatgtagatttgtcatcctagttatggaatacaatagatgaacaatagggaagtttacatgaatagtgtgctacgagggaaagggctagtagcaacatgtagaatagcttcatcatcctatgcacagaatgtgatgaggtgttgacggcgagtgagctagcgattgcaatccggcgatgatggggtactgttgggctaatcgcggttgtgaaggtgattgctatctaatcgattcggcgtgtcttttgtagcttatctttttattattatggaaacatactacacagtttcttaataatttggaatagctgtgattgcaaattataaaagtttgttctttatgttgtaattaatatcttacatatataggctaatcatggttgtgaaggtgattgctatttaacttctatagctgatttattattattattattattattattattattattattattattattattattattattattattattattttggtagcataatttggaaaaagttatggttgcgaatgataaaaggccataaattatggcataataaacatcttctatataagctatggtatttaatcgattcagcatcgattgtcatggcctttaaagtgatattcttttatgttggaaatcgtactgcacagtttcttaataatttagaaaacttatcattgcaaataataaaaaggttgtcctttgtactcttgtttttaaagacaaacttagataacagtctcacagtttatcaatgttgtttgatagcctttgatgcgcttgcatgggctgcagcatatagcaacaggccaagcaatagtgcgctataccttgcattggctacggctacacagtcgaagcaatgccatagaaatgtgactactgaacatgtcaatgttcattgttgatagaactgggagtacggaagatagtctctttaagatggctaggtcaaaatataagcaaaggaggactcaacaagatttgaaaaaaaaaacaacaatcaggtcctcctctgtcttatgcccacattggtggtgactggtgacatacttgatggcagtgggtgctacatggacacggcgagctacagaagatgttgccttgacgcattcccaaatagggtttcacaacaatagaggttaaggccatgacaattcatgaaaaggttcatcaataccatagatgagtacatccagagctaaatgagattgttcttggagcagaaccatcaaggtcgacaacctaatcgttgatattggtgatagagacaaagatttcatggcaagttgcataaaaaagcaccaagaagcttaccttattagggcctccatagcctaaggttgaggaatccaagcatatagcaaacaaaactcaactgcttcttgaaggtttgccaccaataaagaggaagaaaactatcatccttgcgaaaagcctgctggagaaaagaaagataacttgcctaacttcccttaactaggtctagctttctcctaactcacggtgatagagaattacccggtgttttagagggataccactagagaagaaacttcgattgccttctccatgaaacctaggactagaaggccaacatcgccgaccttcacgctcaaactaaaagaaaaacccaactaaattgattgacctacaaagagagagtttgtcggacttctctccctcacctcgccggcggcaaggtcacccgagcctgtgaggaagaggggtcgaggaggcgtagtagttcagtttggctctttcgtccgagagttcacgagagttctcatcactcgtgttaattcgcatattctttatggtctaatcaacacattcgatccaactcttttataatctttaactgattaaatcaaacgattctaaactttagaaaggagaaacaaaatgagtacgtgcagtatcgctaaaaaactagtagggcatagtttcatgtttttcatgggtatctaatctgagccgttgatctccaatcgaacggctcagggtaacctccctatccacaatattatccctcttctttctttccgatacgatagcccacactctcatccacactgctcttcccccccgcgcgccggccatggccaccgcgacgctgcccctccgcctcctcgcctccaaaaccctagccttcccctccgccccgtccctcccggcctcgcgatgctccctccccgtcgccgcgtccgcgccccgccgctgctggcggctcctcgcttccgccgaggagccggcgcccgcacccgtggaggccgaggccgaggcggaggtggtagaggaggaggaggttgaagaagaggaggctgcggtgccggagcctgtggaggcgcagatcgcagccgcgggcgccgggaaggacgccgacatcttcgccgttgtcatggtggggctagcttgcccttgccgccaatatttcagatttagtcctgctcggctcactgcaaacaaacaaaaaaagaatcacatttgttcatgctacattacctcgaattctttaaataatatcattacacaggcatttggcgctagttgcgttgcttcttgcggtgaagtgagcatttgatttcaggcttgtgttgcttactctatgctgcataagaagcttaggattcacgcgccaataggaatgcgcgcacgccgattattagtatgtacaggacacaccattaagaaaacggcgcagagaattacagtgttttcgaatgatacaatactagtcttacagagaattgttcggatgcatttctgaaatatgcaggagtgcatctgaggagggtttctctgtgttttgttttgtatgagcgctgtgaataataacgagggagctattttgattatttttcttctgtcgcagattgggtcgagacagtacattgtgatgcctggaaggtatatatacacgcagaggctgaaaggcgccaatgtcaatgatcaggtctggtgcttccactttagaggatgcaggaggatacttgttacaccctaactagaaatttggcctatttttgctagttagttggtttgtattaatccataaatttaaaaggtatatgatgctgaggtggcttctagataaggtgattgtaaattaggaaaaggcaaatatatagtattggttatttggttattattctttttcatccatgagatgcaataacaaacttcaaaacaacgaggaaggttgtacattctgaaattatggaaagtggtagtgacctacttcattttagaagtaaaagagtcacttccctgtaattataacacttcaatcccagttcctgatttcacataaatatcttattcagaacttttcgataagttttgtgtagcctgcatatattagcttcgttccttttctaactaaaattactcctctgatgcaaagcttccaatcccataggacccatacgttggcttatgttgctggcatttttagtattgttttcccagaaattctcacttctggataatgctgatgtgcagataatattaaacaaggtattactggtatcaactagagacaaggcttacattggcatgccagtggtgaccaatgctgctgttcatgcagtggttgaggaacaggtatgtcctctgtatgttgtcgggttaatcatggatattcaaaattacttgaccctgatgtctccccaatatttttatatcagggacgggatgataaagtgatagtcttcaaatataagaagaagaagaagtaccagaggaaacttggtcacagacaggtaagtttttccaattaccttcttcaagaaaggtagaattttattgataaatactgattcagtttttacagcgaagcaattagagttcttttagattaaaaatctctgttgttttgcagccaaacacaaggttaagaattaccggcataagtggatacgaggacttccctgctgacccgatacttgagtatgttccagcttaagagcaattgtaagttctgtagttacaaacaactggtagtacattagaatacgagtgctaccttttcttgtctggaagaacagtttttgaacaaaatttgctttgttcatgtgttcgagtgctgccagtcatccagttgttccatcctttgtttattccaccatctgttttgttcattctgatattgtgtatcctagccaactgtattattttcactgtgcttaaaaaaagagagagcattttaccacgatacggatgttttagctttggtttgtgtaactttatacagtttttgtgactactgatgctaatttcactgtttttggcatctgtaccaatggtgcttagtttattgaacgggctatgtcctaatattttgggatcagttacagtactatgttcaatgcagttctggtcatgatttattcgagtgttctaagagaagttctgcaaggccatatataaggtgtttgtgtgcaaccttgtactgcttagggcacataagcagctggttaggacttaggccatataagcatctacaaggcaggtggctgcatggattctgcttaccactttttagaaccttggttcatgaagaactgcagaagttttgcccttttgaatccttaccaaagataaccagtggcataaggcgtataatcttttggcaaactatgactgtttcagtagtccttcacccctaattgcatattacagttctgaattatagtggttttcagacatcttttgcctaattgaaacccttgttgaagtaaaaatttgaccactgtaaaggttcataaactaaatataatcacactaatttgttatatgctagccaattttcttgatatataagacttgttaattgtcaacatggttgtatgatgctatagtagattgttgaacaacggaaaaaaggtcgtctcttcgcggtgcttccaggtgtaaggaagtatcaaattcaggtgcaaggcatgggtgttaaggcaaggtaaggtgaccccagcacgccttatgccttaaggcgtcgcttcgccttacgcagatagaaaaataggaaatgaagggctttttcattatatttatggagtccaatcactaaatggaagccatatatctattgatccatccccatccccaatcccatcggtgcccgtttctcaaccacctactcgcctctgctccaccgccgccgacggtgagtgagagtgagacccttgcttgggccgctacctccgtccctcttcccctgctgccgggcggtgctggctgtcaagggaggtggttctggctttgtcggtggtcaaggacgacggtgatggtgatgtaggccactcccccttcctctgctgccactgctttatccccttgtttttccctttatcctctagttttttcctgtaaggttgcttgattccttggcaactgtttctataattatgattttatgatcatttgatgcatgatcaaaaatgctggaattgcaccattagcaaaaggtgctttcttttttattccccaagaaacagaaatactggcaacattgataccatagcgtctagtacaacatcagcatccactgctcgctgctacgtcacaagttccatatgttaatccactggctccatacatgtattttactagagagctagctggagaagatatgaaattacttcacggtcaattgctggtcttgcagggcattatcatcatcattagtttttatcttttacaaagtcctgcagattcagtacgctgtcaatttattttttgcccgagctgctgtggcaaagtgcaggtgatgacggcagctcaattggccatacatcgtttggcgtcaaaccaatgcaagtgttgaatcatttccaacatgcaggtaatctttaaagatctgtgacagcaacagaaaactgctaggattttatcagcttgtttggacccttgtagcatcataccatgtgctgttaaacccggtcaaactatgcagcctaattcctcaatacttcagtaactactgctccctccacgttttgattttgttcaaagtcaaactacttaaagtttggctgactctataaaaaaatattaatatttacaacaccagcatagtttcattaaatctataattgaataaattttcataatatattagttttgggttaaaaatattctactttttttttataaaattagtcaaatttagagtagtttgacttggactaaagtcaaaacgtcttataacataaaacgaaggaaataagttattagcctgggatgagtgtatcccgtagttgctaggtatatatgctaatataaaaaaatgaagttaatttgagtaggtatgtcaacttaggaatcatcccaaatactccctctattccaaaatatgaacctaggatcgaatgggatattgtttagattcatagtgttagagcagtttatccagattcatagtaagtattaggaaatgtcttatctgattttaggtttttatattttcggacggaagaagtacatagataagtacagtgatggatccataaaattggcatgctgatcatactcaaaccgtgtgatatcttctatgtatatataaacagtctagtgatgtgcacatttattccttccgtcctataattttacttacactttgaccactcgtcttattaaaaaaatttgtgcaaatataaaaaacgaaaaattgtgcttaaaatactttggataataaagtaagtaaaaaaataaataataattccaaaattttttgaataaaacgtgtggtcaaacagtgcaaataaaaactcaaaatcctttgtattatgggacggagggagtaccatagatccgaaataagccaaataacacgatggacagaagtttggatgaagtaaaaagaaaagaaaaagatttattggcagcatgccttacatagatatgttggaggggactacggatcggtcgcccgatccaaatgtgcaaaaatcggcgccacgcatgtgtgcaaaactactttaaaatagattttctcttaaattatttatccaaatcatgatccgattgcacaattaaatttgttgtaattaaatcttcaaaacaagaccacacatgtttatattttgacggaatttttttaccctattattgaattatttttaaatattgcacgatgttccaccaagtatattagaattgtttcactaagtagatcgaaaatgtttcaatcgtttaaatcggatgttatttcaccttatgtaaaaacaatgtttcagtaaatagcggaagcatgtttcagttcactgcaacattagatctatacatagtgaaacattgtgagtacactaggtgaaacatttttggtggaaaaaaaatgaaacgaaatcccttagagggcttccaaaatatgtgggttatttattgcaatggagttttgtgtgtggacaagtggcaggtgggggcagggggcacgtgggtgggcctaggggcgcgcgcgtcttggagggagggagcgcccgatttcggctccctcccctgagcgctcgatggcgagcattttcgagatatggtaaaacagtttttgagaagaatttgaaaatgaaaatacactttcacactactagaaaaagtattttcgcaggcggacaaaagtgatttttgcaggcggagggtcggaccgcttgtagcacaacgacagtgaaaa

SEQ ID NO: 27994 - DNA, 7914 bp, Oryza sativa
  unsure (1)..(7914): unsure at all n locations
gtcactccccttccggtgattgggaaagaagaaggggtaaggggaggaaagaaggcgttaggggaaagaagaaggcgtgaggtgtgaaaagggaaaaggccgcccgtgggtggagacttagaaaaaatcaacctctaccaagtttatttatatttaagtctattttcgtaggcggaccgaccatttcaccctaatttatatttttgtaggcggtcatttggctttaagagtcnnnnnnnnnnnnnnnnnnnnnnnnnnnnnnttgagaaaaatactttttctagtagtgtcagatacaccacagagcctttttctctctcttggcaacgaacgtatgacaccaaaatagcacaagattaagctgtgtgagcatgggtttttccccctaacttgggtagagatggagatggagataaactgaccaatataactatagatctttgcgatagatgcagccagtgatgcaccgtgagtagattccacgtagagcaggaaaacgacgctcagtttgggatctcgaggtgtatattctatcctgcctccgacatgaatctttgctttcttgtcccttgttttctgcatcttgcttatgctaattactcaattggccctgtttggatccaagggctattttttagccctccctcaaatagcctaaatagccccaaaagatccaaaagggtgagctatttgagggctatttggaaatagcccacccaaaaaaactatcccatctaagcggtactaattggagctatttcgggtgggactcactaaaaaggtgtcttttctctctcccacaggcgcacgggatcctcctcccctccccatccggtcgcgcgcgctcgcccccaatattcgccgccgccgtccccacgattcataggtcaccggcggcgccgcccccacaaatcgccggcactgcggccgtcacccgtgtcgccgcctcctcctcctcttcttccctcgttggcccggtcgaaacggcggtgagccggcgccggtgaaggcggggtagcatccggcgcgagtctgcgctgacctgggtgaccgactatgagacgagtgattttctcccccaccaagaaccgaatcgacgaactcgaagcagagaaagagagacagaagacagtagatggctcgtcgactcaatctaatcttgccgctctctaggctcacagtttcttgatttccccaaaccttccattcttttttcgtttctaaagtttgttgttgttcttcttgttgatttcttcctctgcgaattgaattccacactgttgaagcacaagtcgatttgttgtcataaaattttctctttttttgtttgttcgtttgctgcgttatcacctctccttggctcttttttttgcttaaatctgatgcccgcggaggaggagctcctgcaccggcaggtgctggccatggccatccaccagcacctcgacaccggcggctccatgtcctgccgcatcagccacaccaaggacacaagtgcacaagatccagtggaaagagagagttgagtggtagtttgattggaaaagtgccaaataacccttggatccaaacagctcaagggctattttattggagagctattccttatgctaaaaaatagctcttaaaataaccctcggttacttctccaaataaggccaatgttgatttgataattattccatttgttccctggtcgatcgggcaagtgcgacaattaattgatcggttttttccttggtactgactggaacttttaattgaacactacagttttattttattacaaaactggaccaggcaaatcatctatagccaggtcccaggttgtttgacaaattcagggatctgatttggcatacctggcagccccggacttcaattagcccagctggccagctccatgatgcatgagtcactagggtaatgtggagtaatccctccatgcacccacgaccactattgatttcctttgtttttgctttggtagcttctttgaaacgcatgattaaaaaaaaagaaaaacacattattttgatacaaatgtcagcgcaaaagagagaattacaaaacacaaaaacataggagtgatcatttgattaggccgtccgcaggaattggatgagaaagacatactcgaaggaaaattttaaagaggttggagctcttgctttcattcaaaatatctacaggattatctattccataggattttcaatggaaaaggatataattcaatcatttatgtaaaagtccttcatatgaatctttaatatataattggaatatttgtttttcctggaccttatcgttcaagttaagattttgtcgaacttttaaaattttaaaaacaagtgtattgttccatacattttgctatcttctttatgctaattggatgatctcctataaattgcagcgttaattttaggaggccaagaaatttagaaatgactccattactcagacaaaaggttagaagttccaatgttaagaaaaaaaaatgtcactcaaccatctatcacattgtacgtcgttgatagtaattatgaataatttaatatatctcatttgtatatccattatcaaaatgggaaaaaaaatataaccttgaactttaattcgtgggtaattttattatcctttagaaaatcctaagtggtatcatagggcctgttcggcgtgcctagatggcagccagcagctacagtaacaacgtacaatttctacgtagttgctgctgctgcagcagcagcgctgcacagccgctgcagttgggcagccgaacacacccatatttactagtgtaatatttaatacctgaaggtatcagataccttatgataccgtaaaggttctcttgactctaagtctaaaaacaatcttggacttgtcaactatataatgttgaatcataactatcaaagccgatcaagcttaaaaagatatcagtttaaaagttctggaacacaagattctaatcgcacgaatagaaaaaagaagcaggattggaatatcgtgccatgttgaaccctgtggaaaataaaatcataggattgctcaaaacatgtgtttggatggctcaccggaaaaatataagaattttgagattatgtagtggtacttagattgagtaagagaagagagatgttgctttgaaattctcatagaaaatgtttaaaatcatttggaattgggccatatgaatgaatttcaaaggaattttgtgagcccaaatcaaacaacctttttaggaaaaaaaaactaaggattcaaatccttcacatttcctttgaaaatcgaagccctcaacgttgttttctagacttggttgaatccaaccttgtggttgtaggatgaggctttctttggtagaactcgatccaactcctaaatttaattttaggagtttggtttggagtggagttgttgagcggtctaaacatagctctacctctctagtttattttgtgaggacacttcaaccagctctacttttattttaggtggagctgaaactgtttggctaagctcctactccagaagcggtgaagttagagttgaagtcgtgccaaatagatcctaagtaaactttgtccaacagtacatgaatacaaaaaaagcataaactatcaagaatcaaccaaggccctgtttggttccatgggctaacgtttagccctcaccttttagcctcaaattagccctcaaggacccaaacaggtgggctaattttgggctaatatgaattagcccccctcaaaacattagcccctctaaggggtgctaatggggctaattttgtgtggggaccatcaaaagtcagctctctctctcctctcccctctctttctactatctctccaccttttagccttgaattagcccatggatccaaacatgccaccctaggctaatgtttagcctaccaattcataactaaacattagctctcaaaattagccccgggctaatcttctaaacagggcccctgcccgtagcaacggtcagtggcaacgtctaggtgcaatgaaccggccaccactcgatccccacaggtgcaggcatttgtcactacgcactaattcttccaagcattttccatgctgtgtccatacgattaaaagcaacctagcttagcttctggaaaacacgtagccactgagatcagaaaggatcaaaagagcactttgttttttccttcttttttttttctttttagatgaaccaagagtactttcttacctctccttgatcgatcggcgaattagtagagaaagtgtccaaaaaaaatatttagtaactcatgcacataagtgcgatcttatgtggactagtcgagacctcacaattggaaactattattttccagaacacgcaaaagattttgttacattattccattacaaaagcacgttacaagccgttcatgcatgcttaattggtgtcaaccttataaggccagagtttgttgtcaacgtcacctcccaattatactttattaattctcatcatgttaatgtcatgtcctcggttatctttgaaaagtgtgaggaaagttacgtacttcctcagtttcatattataagattttctaacattattcatatttatatatatgttaataaatctagacgtatatgtatgcctagattcattaacatctatatgaatgtggacaatgctggaaagtcttataacctggaacggagggagtaaaagaacacacaaaaaaaacccaacgaggacattaaaatacgctccggtgttgttgaacaagcaatcgattccaacaatgacaaagaaaaggatttagcggtgttttattgtgtctgaaagaaacgatacttttctatagcatgcaagcacagtaaaacatatcaataacttataattatattataattaaccaaagagtattgaacattgtattgtttttgtttacgtaatatttagtggcacttctgttagtaacaaattaaggccttatgtgcatttgaaaaaagtaaaaaagaaaaatctcgaatgaaaggatgaaggaaataattgtttgccgctggcaggtgagcaggagctttgacctcctccatggttttaaatttttgtgctgaattcactatagcttcagcaaaatttaagtgtatctgacttatgactgatcgttgtgattgatgttaattcctcatgctccaaataaaactatctagggcatgtgcgtgcctttcgccctccgaagctccaacactactgcacattattttcctgccctcaaaattcatataacaatttaacaatcagatcttatttgtcatgcctccatatcccagatccttgctgaattttataagttaaattatagtattctgaaattttgtattttctattaaatattaataaaatgattcacctctgtaaggtttaacagttagaaatatccaattaaaaaatttggtccggacctgtgccaaactgaggtttagttttttctctacaagtgaacaaccaaacataggcaaataaatttcataaaatcctatagtttaaccagtagtatacctctcgcaaaatttactcatcatgaaacaattcaaatatgtttggtgataacccacatcctcctcccgtgtcacctctctcggcgacccacgaggcgaaacccgcccaccccctccaacctcccaagcacgaccactggccttgctgccgccgcctacggtggtggtcggcagtagcggcagcgcacccctcctccctcctttttcttccctctctcttcctttctccttcttcctttctctctttttcccttccacccttttcttcttcctttctctctttttcccttccacccttttcctctagatttgaggtgactgtcgtggcccttcctgcagtcagcctaagcctcttttcctttcctcttcttccttctctccattttccccttccgttttctccaaatctggggattcaccggtcatctcctccggtgctggcggcctgcctccccgcatctggcgttggctcttccatcccgggttggtggcggcgttgtggcatcggccagtggtggtggtgcaagggggacggctagatctggctcctcttggtctagatacggggcatcctcagttgatgaaccctaagttcctctcgacactcaaggctgttgttggcccgatctttcggtgagttgtaggtaactacgatttgagagaaacgttggtgatccgactacaaccgtacaagacgttgtgttgcgccttagcgatcgatacacctctccgtgggttgttgatcttgccggtgcagatcaaccttattcctgcaagcaaatcgaagaaacaagcaagaacaagatagaagcaatctgaattgcaaataggaatgaatacacaagataagttggggttccgaagaacaagcagatggacggtctagccgacacgcgcgctgcaaggaagtagcaatggctaaactttcatctaaacaaaacccaagaaactctaaaggggtacctaactatttaaggaggtgggaggacgacctaaggggaccctagggtcgtgctccacctggttggggcgcaccccacatgggccccacttgggccggggttccagacgaagttacaagcccataggcccattataggtgacgcagcaccttctttttgtgatttcggccgactgggatggaatttggcgatgaagctggatccattggaaagatgactctgagagctttccatcaagtactcatggacctaaaatggagctcgcatgcatatttggtggccgtttgaagtcgacactgtagcaggtggccgaactagattgcagaacttggacggcttgatcttgatgtggacgacggttgtatctatagtagccatggtcacatcatcagtcggtgttgagtgtggctgggcccgacgtcgaggttactcaatgaagcttgggcagcctgtgtggtcgtcggatggcgccgtcagtcttgctccgccgctcggtggagtccggtcattgtgcagatggtgtgaatagtgcaagtaccttcggtgtgcaggtggcatttggtggcttccgctgtggttgctatggttgaaggggactccgaggtgaaagccttgctcggcttgccggtgctagcaacggcaacaccctcgggtgtcgttcacattcttgaaggcattgctattggagttctcattcaactccacatcaagggaattcagcaggtgaaaactttagattcttttggattggacgatgtcgccctgttcttagtttcagtatgccaatgtcaaggttttcatcggttttttgtaaattaaccgtgtcgttctagatttctgggtccggtttttcttataaagtgaatcaacttttacactgaaattgtaggaactccatacatgttccctcgaaaaagaaacaattcaaatatgtttgtagctaatctgaggtgaggttagacctaacaaccggatcgaatatcccgtgacccttttggaatcgttcgtgcatgagaattaaggtcaatcaagtaaatataaaaggtaggtatcttcatgttaattaagcgtcaacttaagacgaaagctagtcatccacggcactaattcattacgattatgtaaacatcgctgtgtcatcttcttcttcgatcgaaaagtgtaagctatatttatatttgtaaaatcatgtacaccaagcaaggactgaaaagaaaaagatgcgatttctcatagatgaatatagccgcgagcacaagacactatacttttgtgctttcttttattaaaaaatggatcgcaatgtcaaattgtcaatgatcttttacaagtgatactcgnnnnnnnnnnnnnnnnnnnnnnnnnnnnnnnnnnnnnnnnnnnnnnnnnnnnnnnnn

SEQ ID NO: 27995 - DNA, 4650 bp, Oryza sativa
  unsure (1)..(4650): unsure at all n locations
nnnnnnnnnnnnnnnnnnnnnnnnnnnnnnnnnnnnnnnnnnnnnnnnnnnnnnnnnnnnnnctcgagggaaatgggcttgcttcccacctgaaggaggataacctgggaaacctgtccattttgaactgagatcgcgtgaatctggatggtgaaacaaaatcttgtgtgactgaaagaagagaccctggtaaagggctcattttcatgatgtgctacactgaaattgtaggaactccatacatgttccctcgaaaaagaaacaattcaaatatgtttgtagctaatctgaggtgaggttagacctaacaaccggatcgaatatcccgtgacccttttggaatcgttcgtgcatgagaattaaggtcaatcaagtaaatataaaaggtaggtatcttcatgttaattaagcgtcaacttaagacgaaagctagtcatccacggcactaattcattacgattatgtaaacatcgctgtgtcatcttcttcttcgatcgaaaagtgtaagctatatttatatttgtaaaatcatgtacaccaagcaaggactgaaaagaaaaagatgcgatttctcatagatgaatatagccgcgagcacaagacactatacttttgtgctttcttttattaaaaaatggatcgcaatgtcaaattgtcaatgatcttttacaagtgatactcggacattgaaggactgtagttgcatgcatttggaggtacattgtgatcattctcagctgatttatacagggaaattgagctattgcatctgttgtgtcccatcatcacaagagaaaaaaaaattctactcctcacataaaaaaaaagagtattcaagatatttgtgggatggaaatataagaaccaagcctatcagatgggatgaatgatataaacaccaaaaaacgaaaacttttagcggaattaaaagctaccctcaaattcaatgaagttctgacgaaattctgtgtgagagccagatatgcaccggttataccgcacctatgttgctagtctgacaggatgactctcgatccatcaccagcaacactctctcgaggcattaagacacacttacacataaatcaagcaagaaatcatattcgagcacaagtttttccacaacttaactcaacattaccacacaatagtattatatacgtatagtaattatctagaagttataaatatgaagtaatcatgagtatccaaacaaacaacttgaaaccaactttaatacagagctagtcgactagaccgtcgggttggctagtctaaccgcacactacccaccggtctaactggctctacacatagcaccactttgcaaataaatatcaaaaaagaaaaaccaattatctcacaaatcaattgttcatcatcaaataataattggaacactttaatttcacaattcacgcctataattaaatacctatttaatatatataattggtgcagagtttggaattctacttctaccttaagaaatgtgagtagtatgtaagttaattgggaagcgcatacgtgtgagaaccaagaggttactggatcgaaacatggttgctatcttttttttccccacctagtaagttaattgggaagcgtgtacgtgtgagaaccaagaggttactggatcgaacacatggttgctatctgtttttttcccccacctagtacgatcttgatgctcatccatcggttagcacgaatcgctcatccatcggttagtacgaatctttacgcataccagatagaaaaatattggatagaaaaatcacacggcaaatccctagcaaaattggcttttgtaatcatgaaaacatgttgattcagccggtactatcaagaaaacctcccaaaatggagtatcaaataggaaaaggctatacgtactaactttttcttactaaattcttactaacactgatatgtcatgctacgagtgcatctagattttttgtaacttccatctacttaaatcaaacggttgagatgattgttagtaaaagtttagtaagaaaaatttagtacgtgtagcattgctctatcaaatactagtactacctccatattttaatgtatgacaccgttgattttttttcaacatttgaccattcgtcttattcaaaaaatttatgtgattatcatttattttaatgtggcttgattcatcatcaaatgtttttttaagcatgacataaatattttcatatttacacaaaaattttgaataaaacgaatggtcaaacgttagtcgaaaagtcaacagcgtcatacattaaaatacggagggagttctatgctagtagttaattaattttacagcaccaaacaacaatgttacttcctcctctctgttctttatacctgtaacaataatagcaacaatagtacggagtaatatataaactcccctatgtatgtatatgtggatgtggcgctgcgattgggcgcaagtcggcgtcggtgacggcgacgcggcgggggatcccgcggagaaagatccttctttctggtattcttgtgtgggaggaccggaggaggagagcccaagggaatccgacccaaacgatgccacgtcaggcgtgggcccccaccccaccccaccgtaaaaccaatggcaccgagaaaacgaccccaccccgccggcgcgcggggaccacctggcagccactcccacgacccacacacggccggattgatttctggtgcgcgggtgcgcgtccgcgtcacgcgtgacggcgcggcgctggcgctccagcccggagggtggtggagatcacgtcactgacgtgcggggcagggtgttcgtgtgggacccacatgtcagggatgtgggtatattcggggcgatgggtgagggtagtattcttttggtgtggggattatgcgccgcgccgccgtgtgcgcgggtcgttgattcttccaagcggcttcctttgttttttcgtttttgtgcgatttttgctgttaggcccctgtacaagttgtagagcgtcggatttgctctttagtccctgaatttttgccagttgccctgttttcatttcttcttcttttttttttccctaacagacagaaacagaatgccatagctaataagtctgcgttcttttttcaactgaaaaaaatattttcctcgttatgttttttaaagtattaaatgatgatactctctcttcgccccaaagttttggtgcttatttttgtttttggacagtgtacgtacttattttcggacggagagagagtatgtttttctaaaaagctttttatataaaagtttctttcaaaaattgaataaactcatttctaaattttgtaatgacaaatactcaattatttatgtcaatgacttatcttattttacgtgcaactaaaatgttgaagattcaaacaaactaaaatatatactcgctcgtactcctcttatacaagaggcagtacaagcgtatattatactttctcttatacatgtatagctctatcaaactatcatactccatccatccataaaagttagacatattttacatttaagtttttctaaataaattattgctattcgtagtctttatgcatttaagacttaaatgaagagataaattaaatgtttgacgagaacccaaggagtcatctaaatattcattggttccatgcttgcattcactccttgattttgtaacatccaaaataatttaatttctcctaggtcttggtgacaaaaataatatgcgtaacttttgtggatggagggagtacagtataaaaatatatacatggttgaaaaaagtaaataaaatcaacacatcctagctatacgaatctagacaatattccaaataaatttctcagtactctatatatcccagtttgatcaccacataaggtttttaaggttttcccaacataatcatcctctaacaagcgcatcttatcctctaacaagcgcatctttgtttatctatgctaagagtaaatgaacatcattaaatgtactatatgcaaccaaccaaaattaatttctattggtccaactacatgcaatatttataactagatgcaatccacgaaacataaagcgacgttgctccttaaccgatgagaattaactacaggataatgaatgttttattgtccatagtctttgcgctttttgcttagagcaagtttaatagtagagccaactactagctccaaatcatctatagccaatttaatagctcattcatacaatagttacctataaatatatttatacaatagttacctataaatatatactccacctcttatgtactatagcattaatatgtagtctcacctcttatacacataatattttagagtttgtgctacactcctgtaactgactataaatctatagctcgttttttctctcttctttttatcttattcatatgtatttatagctgacttgcagcatgctattgtacttgctaatgtaagatgattaggcggaaagatcgtatcactcacttggaggagagccatcgagccaaaatggcatcttgtaataaagccctcacctaacacgataattacccacccgaggctcctgcgtcgtcctcctcttctcggctccatttttccccatcccgacatcgcatcaccgcctctctcttt

SEQ ID NO: 27996 - DNA, 37660 bp, Oryza sativa
ggcgtcgtcgtcgtttctgccgccgggctacaggccaggcgatttcttcttcttttcccccgcaatttccttcttcctctttttttttttccgcgcgaattcattgtttttcctgtcgcggtggcgcgcgcttccccctctatttaaccgcgagggaggccgcgaattaagccttccgactccggtcccgtgctccgaaggtggggtgcaaggtttgtgcccctgcgtgctctcgctgatgtttctagtgcaaattcgttggggcctggctaggttgcttttttagtgaattcgttatggtatttgctgaatcttcatcgtgttctggggagagtttctttggagaagagactagttgcgattgattctccatgttgacagatgcgcggcgagacgaattggaacgctttcttcttttagatggtggtgggcgtgcttagaaatttgtttgttgttagtgagttcggtttttgtttgcgttgacagtatcttctgttctagttggtggactgttctgattttgtttggggaaaaaaaggagatctttgtgcgggtttgagccttggtttggaggagcatggatccagctgttgaaatactatacgcagattttgcggttttatgagcaaaaagtcggaatagtctctgaattcattatagtagtgaactcatattcttggatcagttttgaactgatgtgctgtgcaaaagtatgatactgtttttaccttgattactttcttctctggagagaactttacagcgttgaggttgagataccgtcctggttactctccttttcttttttttttctttttggatataagaagattctggtgtttgaaggaatggtagactcttagatttgctatatcacttacagttgttttcattaaatcttcaaatcatcctccctctttctcagaactttgaaagtgatcagggcattgattgagcatacataattcaactattagagagttttagagcagattgatggtctagctccttgtttttgaaagatgcacaaagatgttttagtaattgtacattttctacatttgagggtattatctggataataatgaaaccaaattcaaattgcaacaatgatagaaatgaattttgaattatggtatctatgcagtataatattgcagccctattgatcctttgatggcatatttgctactttttatcctcttgaatttgttaggacctgctaatattccccttcctcgtataaagctgtaagctttggtatgcatgattggaattttaagcacacatttctgtagcagaatatatgctctatcactgtcttcttgaaagttttgcttcttttttatttgagctgtgccaaatctctttgtttttttggaatataggagtgttggatactaaaatttagctactccccccccccccccccaaattgtagtgatagaatcatagccgttacagatgactagcagtgttctaagagtgtcttttaggtatataaaagtgacagattcccctacttgttgccatgctattgctagttaggccacattactgggtgggtttcaccgaataattacagctgtggtgaccatatgggtgattggataaatgttggttatctatattagaacttgattactagtatttacttatttggttgctcacatagtcacaatccatgttgatcagtctctaatattgacttctattttcagtttgctgagcacagttgctgaattttagggttatctgcttcaagcataagtgggccattgcttctggcttttactggtaataaacataggcttcaacttcaagttactctatcttaaggaattaatagttcatatataagtgcattatcgagcttgaattggcctgttatcattgccgtaacaaaggatcagggtattttttttgtttgtagctatttcacttcaattgatgaaattttactttagatttgttgatgcaaccagacttcctatattttgttaatacacttgctatacagtaagtttgaatcctgtttttatcatctgaattttagacaaaattttggagtactctcttttttaagagtacaacgaaaagccacacaaacatatgcccctcaaatgcatgagaggcatgtagagatcctgctatcatatgaacttttgtatcttctcttcatgtgtgtagcagcatataacatcctaattttctttatatgtgtttgttgtcctcttttttttttgtgtgtatgagttgtattatcatgatcattgatcatatctttgtccttttgttatctgcagaacgtaactcacttggccaaatgaaatccatggtagttggttattctgaagcatagaattgttactgctttgtgaacgaataacatctatctatctagagcactggaagatggatcatagagatacttctgggtttgtcagtggaggttgcaaagaatcaacgaactgcatcaccctaggatttctaactttttagctttgttaaccattatttaatctggaagtgaggttatctggtacttggcaaaaaaattggctgtgttttgtctcctgagaaattctctagcaatggaccccagacttgggcggtcagcgtttataaatttctcaaatccaaatgcctatgtgggcaagttccctgtcatctccacagtcagccatcctacagcttctagtcaaattgatgtgctagctcattgcagttcatacaacctgcctagagggaccaagagaaagtttgatggcttgtcactagggctgggcaactcatcaagctcagaatctagcaagcaaagcatgggtactggctgcaccatatcttctgctaagggtagtgatgatggttcttctattgatttggatttgaatcattttactctgggcaatgaaggtacttccaggcttgataagcgggcctgtgattctaggagggctttggataagcctgaattgaatcttgagctgtctttgtcatcccagtctgctattactggtgcagacttcactgcagcgactgaatataatagcccaagtctgcagccatactatatggacttagtgccaacagttgatgaaggatctacatctgctcgccgaccatctggttgtcaggtactgtctttccttaataagactgcaaagatgagtgaattttctccaagggaggttttcccaggtagctctaaccagagtcaaggtccggctccaatgccaacattgcttcaactgccaaaaagtccagtagcctgtacttccggtttatctcgtccacaacagcgcagcagtagcacaaaaaactgtacatacccaggatgtatgaaaggagccagaggttcttcagggcgttgcattgctcatggtgggggtagaaggtgccaaaaagatggttgtgacaagggggctgagggcaagacaatattttgtaaggcccatggtgggggaaggcgctgcgaacaccttggatgcaccaagagtgctgaaggtcgtactgacttctgcatagctcacggtggtggccgtcgttgtagccatgaagaatgcaaaagagcagcaagagggaaatctggtcgctgtattaaacatggtggtggcaaaaggtgtcaacatgcaggctgtacaaagagtgcagaagggcgctcaggcttgtgcattgctcatggaggtgggcgccgctgtcagcaagatggttgcggaaaaggagctcagggaagtaccaacttttgcaaggcgcatggtggtgggaagagatgcacacaccctgattgtaaaaagggtgccgagggaagtacagcgttttgcaagggacatggaggaggcaaacgttgttcagctgaaggttgtactaagagtgtgcatggcggaaccctttgctgtgttgcccatggaggtgggaagaggtgtgtggtagaaggatgcacaaagagtgcaagaggccgtactgaccgctgtgttggccatggcgggggcaagagatgccaatcttctggatgtgataagagtgcacagggaagcactaacttttgcaaggcacatggaggcggcaagcgttgcttgtggggtcacgaaggatctgaccatggagctggtgacactccttgtgagcgccttgcaagaggcaagaatggcctgtgtgtttatcacaatccgcaggtggatgaaaatcgtgtccatgggggtttcagcgttgtcagcgatgcactttctcagggagatcgaccttcaaacactgaaacaagcaggtgcagcattttctcgcatcctatggaggctcctcgtcgtgtggcagctccagctgacgagggtcgggtgcatggtggcaacatcctgtcaatgtttgcaaatggcatgagtttggggaagcatcccgccaaccaagcagaggctagcacctctgcacctcgcaactcgaaatccaccaatggcatggtgaccggtaactctgcggtgcggggcagctggctgtagagccttgaaccgccttctgctctctccatttcagtaagcatatgcttcgaaccatctgacaagtgccttctcttcttaatccttcgggtgtgaaaactatggtgtgattgtgtgaactgttgtgtcctgatttgtttagcagtgttgtgaacttgtgatatattattaatcgtttgtgctttgtaaaatgtaataatcacctgtgtgagataaataaaagggggaaggttacacattagatgctgaatttcaggtcttgtactgaaggtctgctgtcacctccaaaatttgtcctgtgatagtcatgttctaataaatctatgtgactgacatgtttgaaattatcatgctcttgctgctgcggtacacgacagttgttgcgtccccacttcattttctgatcttaatgaaacaaaatctcagaacctaaaagatatttcctgcatagtcagactatttggagatcaggatactcatgttatgtatgctctggcctgagcaggcttttgagaattcagatgcacatcaggatcggccaggcaccttagatgcagatgcagcacatctctgcttccatagcagtagatcagtttcctctcactgcaaacaaacatgccaggaccccccacaaacagcaggacaatgcagtgccaagaaaacagatgattcagcaacagtgatgacaataagattttaggcatatctagctaaaagatagtactatttcctgcatattcagactattgctaaaagatactaataatactattgttctgccaataatgcctccgaatgatttgcctgtcaattatgcggttgctgaaacctgttgttcttctgatctcaaacacctgacctagccatcataagattgaattcgaccgctttgataagtgtcatcaaatactacaagaaacaattatggttattattaactctgcaacacgctgctggctcgccacatctgcatgagccagccaccaactgtgtgatgatgcattatgctgtcttcgtcagtgcgacatggctgtccgttcaatgaaacaaacaacaaatcgatttggcatctgaacaatttagagccacacgtttcatgcaactttctccccctttttttttgcagtgtactgtttggggagaatctgttagtgatatgtcctagaggcaatcatagagatgattgtatcacatactatgtttacatatttatccgatattgttcttgaaatagataactccttattagttaatgaatatgtgatactttcatgagactctttatgttgtttgttactatttctaaaggatccctgatcaaatatcatatgtggaacaaatatatttatataatcagcacatgtattaattgatgatcatgtctcatggatcatggtatagagataccaaattaataatgtggacacatgttgttggatagacccaacatgagacactgcaagagccatatgtgttgtgtcatcagtgatctcattaagtgttggtgttgaatccttagacctgagattgctaaacgctactccgtaattgggtagttataaaagtagttttcgggtatgctatgaaacatgtagtggaatatgaataatcaagatgggatttgcccctcctatggagagatatctctaggcccctcgatgttgtagattatggaagtgcatggccatgccaaaggtgattgaggagtcaatcacaagttatataatctatcaacaggttcgagtgaatgattgagctattagaggatggcacatatctatccttgagcttaatcgatatagtgaggcaaaggggttcatacaagtatacactagaggttcagccgatatgatctttatgtatgtccggtgggtcaatacgttctgctaggggccgctgttgacgcgtggaccgaaaaggagttttcgggttacagccgagtatatatgaacctatagggtcgcacgcttaatgggccggaataagggaattggatagagatccaatatgagcttaattcggataaggatccgaataggagtcctacgggccttggaggcccgagtgatggatcctatatattcgtgaggggtgtgaccggcggaggtattgcatcacgtgagaaaccctagccgttacttccctccccgagcaaaaccctagccgcgcgcgggtgctagcacatctgcgcgtggcgttccgtctctgtacgtgtggataccggtagaggcgccgctggtttgcggtgctgatcggtgcgagagtacggcgaggagaacgcacgaggaggagaaggtcgagccggtgcgatcgacgcgcgctacttcgcgagagttccttcgacttctcaacgtctttttccgctgcacagcgcgtcgagtggtagtgatctatgatctaatacttgcatggttcccggtttacgcgatagaaaattttgatttatgctatcatagcctacgcgtatcccaacagaaatgttacagcagcatggattcatgcagcatgaatttctgtcaaaaattgatcggcagggagtaaatttctcgaacagcttttgtaccaacttgaagaaaacactactacagtagtagaacaccacaaaactactatagatgctggaaatgctagaaccggcacctataacgtttttcctgtcctcctaaactctcagaggagtcaaaaataaaaatcggcacctataccggtttataaaaaaaccaacacatataatgtaagcgctggttttttaaaagacgacacaaataaaaatactatgagtgttgggttttttatttacccgctccaaatttagagccccacaagcacgcaaaaaaatcagcatggagaaaaaaaaaatcatgtttgacccatgccgtgctaccctgcccattaatctctatcccttatctcctcgttcgccccacccccgccatccctctcttccacgtctctctcgattcctccatctccctcctttccatcgcggcgagaaggaagcgacccacctctcctagccaacccaacgatagcggcgacgaacaagctgtccggtctgactcctgccgcagttgaccatggcctcggctctctttgctagatttgtcggcgacagttgtatatacgccagatcccaattcggtgtgcatcctggtgtacctatatggattgcacatggaagtcttgaaaaatgctggccaactaaaattgatcaaacatagtatatttgacttaggataaaactaaaacaacagaaatatttaatttatgataaaactaaaacgataagaaaaattgaaagcacatttctatcgtttcgcatatgtttatttgtactgcttattagcaataataataataataataataataataataataataataataataataataataataatttgtgaataaaacttttttttccaaataagtttattttttattatctcttttggctcatcttttaccgatcccacacataccaataataaaaaaaagaacactaaaacactctcactttatcgtatcttaatataattattgtctactttatctacttctgacgtatattttttatctacttccacaagctcttctaatgtaatgattatagacaaaataaacttatttgggacaaacgggtgaagagaaaaaaaatgaaattattctggaatagaaggagtataagagaattttggataatcataaaatgatgacacggtggggtcccacatccacgtcgggtggctgctaccgaccttgacctgccccagctcctcgggagtcgggaaggcaactccgcctcttcatccttcgccgccgccgccgccttcacgtgctccctctcctctgcgagtcggcggcgccgatctccatttgtcgaggcgagcagagcaggggagccgggaggggagggcatcctggtgaggtgagcatccacatcccctttctgatgaatcattcatctctctcccacctggagtagttttttttttgtctggaattcgctcgcgttcgttaaccctagctttctcttgtagatctggaagaagctctcctcttaattaacctgtgtaaaagtttgtttgttcccccaaaaagtttgcttcctgggattactacgaggaggaggagaggggatagatagtctgtcagatgatgatgatgccgctgcgttgcctctccgagctggcccgccgccggcctgatcgcgcggtgagattctactcattttctttcttggatgaatcattcagctagaagcacgtcgctgtgtctttgtactgtaattatgcattgggtctctgtaattgtgcgttgggtactagtaataatcaagtaatgatgtattgatgcagtaccatatcacatcgaagggatgagcttgtgctgttaatttttaatttccagtcaaaaacgaattgcttgttttctggtgctgtaacagtcaaaaccaaaattttcaggttgatgcaatgagagtggggctccgatgtttgatgagcacttgcccgttatccaaagctactgatgatagtcaaaggttatatgcaacttcttcttgtgctaatgtgccagaggtagcactgagtgaggcgccactgtcagacatgcttgtcgattcgttcgggagattccacaactacctgaggatctccttgaccgagcgctgtaatctgagatgccagtactgcatgcctgcccaaggagttcagctcacgccaaactcagagctcctgtcgcatgatgagataatccgagttgccggcctgttcgttacttctggtgtggataagatccggttgaccggcggagaaccaaccattagaaaggatatcgaggatatctgtttgcatctttccggcttgaaggggctgaaaactcttgcgatgaccacgaatgggctcgttctttctaagaagctcccaaggttgaaagaatgtgggctcaatgctctaaatattagcttggacacgttggtccctgcaaagtttgagttcatgacaagacgtaaagggcactcgagagtcatggaatcgatagatgcttctatacaacttggattccaatctgtcaaggtatgcagatttttgcatacctgaaatttctgcagtttgtcttctttttaacataccacaaactggagctatatccgcatcatattgagcatttatcctcagtttaattggttctttttccctttttctgctgccaggtcaactgcgttgtcatgcgtggaatgaatgatgacgagatctgtgattttgttgaaatgacgagagacaagcctgtcaatgtcagatttatagagtttatgccgtttgatggtaatgtttggaatgtcaagaagttggttccttatgcagagatgatggataaagtggtaaggtacacctctgaaaagttcacttcccttatacattttacctttctttcttccgcctgcatctagcatcctagccattttatgtacatgtggttttattattattattatggaagctacaagtaatttttcttacttgcaaccttggggatcagcgccaacgttttaaaggtgtagagagacttcaagatcatccgtcagagaccgcaaagaatttcaagattgatggtcatgctggaacaatttcgtttattacatcgatgacagagcatttttgtgctggttgcaatagattacgactattggctgatggcaacttgaaagtgtgcttatttggcccctcagaggtatgctaaccagacactttgtgaaaccttgacttgtatttctgcaaattttcctatcatattttgggccaatatgtcaattttctactttggattccatgagggacaatttttgtgctttcactgatgttgtggcctcttattttgaataccataatcagtgttaatgtgtcacgcataatcatgcaaacttgaaccatgtgtactcattgattttccttcacaattatgaactatttgaacatagatcaatacacatatttctgtatagtgctaaaaatgctcaggatgttccaagcatgttatatcatcttttttgtcttaacacaatctgaatgagtgattggatgggttgaatggtattcatgtgctttgtttccttctgttgcttttggaatttctgtttaggtgtgctgtgccttagatctgaaagtgaaagttaagtgggggcagatccagtgtccatgatatattaaaccttaatcagagtaaaatttgaccgactttctgcaagtcctatttctcattatttaaattcactgtatatttcagaattcaggttgttaattccagttgtctctttaaaagtgaaatctccttgtacagttctatttttcttgttgtattaatatcattggacaagaatggataaaaatcgaggaacaagtcttctttgcaaaatgctaaaaaaaaataaatgagtacaaatattctggtttgtacaggtgagcctgagagagcctattcgagctggtgttgatgatgctggactcagagaaataataagcgctgcggtatgtgtagaaattcacttggttgacatcttctgtatgaaagacagtaatctagaccatttattcttattgtcgaataacaatcttgcaccaactatttcaatccactcctgttcctttcatagaacacgataccaaaaggtttttaactgtttttctctctctcatctgagcagtttaagaacatatgaattcaattaatttgtttgagaagaaaatgatttttatgttaaaagactgcttctcttgacaaaaatttaaaatcagcatcgcaaataagtaccaaaagagaagtagagtctcctggcttctgggatttccattgaggaaggaagggcatgcatttttggtttggaccacattgggtagaagataagcagaggcgaactatcctgttcctggtataaactgcacattatatccaaggttacctgggatgttgggatacttttaacgtttaccagcacccttttgcctccattggaacaggtggatcttgctctgcctacacctgaggcaattgttcctttggacagctagtaggtttctattgatattagttactctacttgtccatgttcatagctagaaatagctacattttgggacgagcatagcatatcattagttatattatcatgtttagtcgccaacttactttacccaggttaaaaggaagaaagctaaacatgctgggatgtttgatattgctaagacggcaaatagacctatgattcacattggtggctgaggtatcttcttaacactgcttctaccctttgtttaataaagaaagaattgatagtttctttgaagattatccattttcttcactcaacattgttctattggatccctctgtgtgttctattcataatacagaacaatgcaaattttagaaccaaaatgctggttccctgttataaattagaggtagaatattgtcatgagcaacaattgctttgtggttgctcaggaatctagtgaagagcatctgcaatttcattaactccatggctttgaattatctctagcttgattaaacatactgttgtcagttcattatgcttgtattcttgtctggcactaatttcttttaggttacaaactgtaggtgcaacatgcaatatttagaactggctacaattttaacttttatggactaagcattatccatgcttgtcttgcttaccaattacaacttgtttcagatcagttttaccagctgaaagtaccttggctcctccatacgatgactgcgatgaactatcaacatgataaaacaaaacaaagattacatgatcttaccttgatatgatggtaaactgaggaactcaaaacttcaaacggcaatacatacagtttgtacaagatataaaaatgttactatacttgtgaaatagtagcagttacaaaacctcatgcagttgaaagttaaagcatctgtacttttcgctacttgtacgagaaagttgtaactgttgtatgatgtatgctcctcataaatcaatgctaatgtgtaactaattattcttttacggcatcttatcggttaatgaaacgaaatttattgtcttttctttctgggaagctcttgttttgtattcagcagaataacggcctcttgaaatcgcgggaatgaaaaagggagagaaatataggaagtgtgcaagtgtgcttccgcacttgctttgaatttggtactactgatacaacaaaaattactctttgagaaaacaaaaaacaagtactttattttaagatagtaaaattcaactagagttgctttagaggttggttctctcttgctaaaaatattgggaagagagtaaattttttttaaaaaaaaactatgataaacaaaaataattcaactatttcttttaagagggtaaaaattcaactagagttgctttgtggttggctctctcttgcttaaaaaagctaaatgataccccgcgtttttctacggtatgattatatacagacaaacagattttaaaaagtacacacgcttaaaaaaaaatctgaactctttagttataaggccggggagaccatcagaccaatagtctttaaatttcaattaaaagtttaaggtgcatgaacgtgacataatataacttcaacaataaagtgcatgtcaatagaagaaaattaattgctctggagaattaaaaatagattgggaaagagaatatatactactactttctaagtagtggttgtgtctattttcatatcatctttaccgctgatatatgagccctataatctatactgttacaccacctttcagtgagtcttgagtcttctcccgtttaattattggctctctttagattttaaaatcacttacatatttaataaggaaaattatagtattacttggactaaatacgtgcttattaattgatttaataaagtagaaactcaatttattttaacttaatttgtttttcgttgcaatgcacgggctctatgctagtggagactaatcaattctaggatttggaaattaacgtggaattgtacgtagcactaggaaacattagcttatgtagtttgccggtttccatatttgaccaaaaacatgaaaagttacattatcatgtcttggtatgcaattaagcaaatttcactggccaaatgagtgttgaaattgtggacatatgatctgattagtttggatggtgttagagtgtgcagcccagccaatcaaccgtgagccacctaggtcacattgagcctactccaccacaggccgtcacaacttcatgtaccgggcctacaccacccaaaagactaggttctgagcctacacaacccaaaagactagtctgatgggtgaggaccgtccccaccttttaagtcatgtgggactaaacccaacaatctcaattaccgatgtgagactagacccaacaatctccccggaagtgctaatgggcgatcgatcgcccggcgacaagggtagcgatcgatcccccttccccctccctccctccacctggtttccttttttggcaccgcattactttcctattttagtaaatttatgcacctaaagtttatacacctcaagtttacacatctaaagtttagagaccaaaagtttataagtcaaaagtttatatatccgattcaaatttgaatttgaattcaaatattttttttatatatagtatttctatgcatctaaagtttatacacctaaagtttatagacccaaagtttataagtcaaaagtttacatacccgattcaaatttgaatttgaattatatccattcaaatttgaatttgaattcaaatattttctatatatagtatttctatacatctaaattttatacacctaaagtttatagacccaaagtttataagtcaaaactttacatacccgattcaaatttgaatttaaattcaaatattagtttatagacccaaagtttataggtcaaaagtttacatactcatttcaaatttgaatttgaatttaaattcaaatattagtttatagacccaaagtttataaataaaaagtttacatacccatttcaaatttgaattttaattcaaatttgtatggtgtagtagtaagagaagaaggggaggtaaagtagtaagggggaggggcgggtgattgcttggaaggtgagggagcgatcacccgcccattaggagtaccccattctcccccgtcacatcaaccctgatgtccgtgtggccccgaagactcaattaccgatgtgagactaaacccaacagatggagagagagagagagcaatgtcaattgggatatgacgaaacccaaaatcaaaccaaagcattatttaaaatgcaggaattttataggaatcgcataaaccaatgacacaatttacaatgtgataacatatattgaatatatttgtattacaagttgataacatacgtacatagatgcacgtgcctatataatacaacagtgtccagtacactatataatgtgcagcacaacataagaaaatatgatatggcttagtcgaaacacacacttggaagggcatctaacataccccgtactgtacgtcggatgcaaaaacgtttacggcttggtcgatcggtcagctcgcgtccaccaagaagaaccgtaaatgtaggggctatagtgcagcgtagtcgggtcggagaggaggaaaattaagttgctaatgagcagcatatccggattcgtggtattaggaaatatccctttcaattttaagctcttcaaattttcggacggggagggagagtagcttagctgcagtaacgtacgtagtagctgatgccatggatgtagctagctagagctagtactggtcgggccagaggaaggcgcccatggcgaaccgccgcttggcgtcgaggtcgccgtcgacggggagcccgtactcccggagcaggcagtccacccgccactccggcatcgcctcgtactccgccttcttgtaccgcgggtagtgcagcggcatccggaacgacgacccgccacacccgccgccgccgccgccgtgctgctgctcaccgccggccgccgccgtcgtcttctcggccttgggctgcagccccaccacgcttggacccaacgatcccatggccaatgtggctttcttgcagctaggactaggagtctaggagactagctaggactatatatgattttcttttttttttttttggtgtatcttgttgatggttgcaagaggctgctcatgtgtggaggggtatttataggagaggaaaaatgtggtgtccataaagaggaggtggtgctactcgctatgtgtggcgatcgcgcgccgttggattgaaaatggatggtccaaattgagcgtgctcgcataatacaccgaataattatcgagttttagtgtttgattgttggccccgccctattgtttggctgatcataagcatataagcgaaacgacatatatgtaaataaaaaataatttataaataaaacttttatatatacgttcttagcgatataaaagtaaagactgaaaaataaactactccctccgtcctataatataagggattttcagtttttgcttgcaacgtttgaccactcgtcttattcaattttttttgcaaatataaaaaataaaaagttgtgcttaaagtactgtagacaataaagtaagtcacaaataaaataattaataatttcaaaaaattttaaataagaggagtggtcaaacgctcaagcaaaaactcaaaatcccttatattatgggacggagggagtacgataaaaaaaatctcaaaaccaactccaatttacagttgaaatttcaaatttttgctgataagtgtaagcgaaaagatgaggccatgtatcatggatgaaccaacgaacggttgagatcgagcgtgccagcacaataggaaacgcgtgtatcaaagatgaatggtccagattgagcgctcttgcataatacaccgaatgattgatgggccattaatgcacaaaccatatggttgatgacacgtatgtgcaaatcaaacaacccatttgaagttatggacaacgcaagggacatgtagggagggatgaattgcatgattggtttgtgttcaattaagaatctaatgcgaacaacaagagacgtgagagggaaatcaggggtttgattggagaagacgacagcaaatgcctcttgctgctgcccagattcagtagtttctgttccaacaaatcattccagcagagggtattaacttgccgaaaacgcaaatgtacgtaggtgtagctagggtttaattagttaattaggacttgttcgttttgttcgaccagatctgacaaaaaaaaagaagaaaaagttcaggacacagcatggtttgtgtgaattggttgcttgaccaagatacatacgctactgaggttcacagaaaactcatgaaaaactgtagcaattcaatcataccaaggtactccaacatgaaaatcagattaaacttattgaataaatatacttttaatgaagtaaacttgttaatagcagcaataacaattacagtaaatatgtaggagttgttgggtattagaaatttgcctttctactgtattttacgcgtcgttatttgattttctttattcaacctgattttttattcattttactatcactttgcttgcttctcctgcaaaaacggaaggaaggaagcccacatgtctgaaaggtgaacaagagtcaaaacacaacggcaatcaggaaacagattgcaataactcataataattggacaacttgttctagtagtcatcaacaaatatgatgattgatagttacttggggtgttcaataagcagaggtgttttcttcagagtttgagaggcatcgatagcctttcattggtgttttgcttgtgaagcagaagaaagacgtgtgtgcttctgctaccaaagcctaccttccatgatttttccttccttgatcaccttgcttctcgccttctcccagtgaatccgcattatttaacaaccttctagatgccgttaatgcccgtctgaacaaaaattgttacgggaatcatctcagtgagagggtgtgtttgacaagaggagaaaaagagaaggtcgaggagatacgtaaaacgaagtggatcattagtatataattaattaagtattaattacttaaaatttaaaaatgaattaatataattttctaaaacattttttctatagaaaattcctttaaaacacacggtaacacttcgggaagaatacgcgtgaaaaagaggggtttttcctatcattgtgctgctgctgaacgcaaatcgctcccaaagagtagctttcatgcagtagatggaagttgccacaggataaatgggtgttttctctgctccatagaagcaagtattctgaaatggccaaatgggagtactgacctagcatttgtttcaacgttgatcagttcacacctcttgttgcttcctgtgaacactgaccagcacatctctgtaattgaagtgccaaagcttgatgggccccaaatgcttagccaaggccgagacaacggcccaagtaatctggataaaggcccaaacttcccaaacgcctacaactccaaatgggtaatacaaaggccgagtttagttccaaactgttttttcaaatttccaacttatccatcacattaaaactttcctacacacacaaactttcaacttttccgtcacatcgttctaatttcaaccgaacttccaattttagcgtgaactaaacacacccaaaagcatcacattattcagtactatgaaattcactgttctaatcctatgtagtagtaagtacatcacattgttcttttttcttgctcctactccactaggactcattcacattatttctgtagtgtcctggtcgatttgatgccttgtcaatttttttgttttcgcattggcctttctccaagcaagttcttgcgacgatgatttcgactgaataatctgaaccgctcaaaattttgtcatctggagcttgagagtttcttgggtccaagattccttgcctgttcttgcacaagcatcacagttgtttttgctcgtaccttcctcctctcatgagtcatgaatggtgacaggggtgcattgaagaagcattgacaaatttcactgctgcatccatgtattcactctgacaagctcttggatcctcttggaaaacgaaagtttacagcaagcttcttcagcatgtgctacactgctagtatcacactcttggagagcttgttcagcatgtgcttcttcagcatgatgctgaagagcaattgcattggttcagaaaactttgttcggctgtttgtgctgatcaatactagtagtagtccctccgtttctaaatagccgacttccctaaatatttagaaaacgtcgttaacttttataaatatgtttgaccgttcgttttattcaaaaacttttgtgaaatatataaaactactacctccttccctaaatgtttgatgccgttgacttttttaaatatgtttgaccgttcgtcttattcagaaacttttgtgaaatatgtaaaactatatgtatacataaaagtatatttaacaataaatcaaatggtagaaaaagaattaataattgcttaaattttttgaataaaacgaacagtcaaacatatttaaaaaagtcaacggcgtcaaacatttagggatggagggagtatacgtatacataaaagtatatttaacaatgaatcaaatgataggaaaagaactaataattacttgaattttttaataagacgaatggtcaaatatatttaaaaagtcaatggcgtcaaacatagagacggagggagtactaaatctagtgtgccctcatttgtgctgattaaatgcagatgcagggaatggaagaggaactacaccatgcaaagcaattgcagagaaacaagcccaaagaaaaccaaacaagcaaactactactactactcctgtttgtgtttgctagtagtaggacaccacgtatgggacaaagcatgcaaacacacaagaggctcaagcatgtactcctcctatatccccttgcctgcaagcttccaaaccttggccatggaaccatatgcacataccaaggacatggagatgtacacacacaagatgacacaagagacacatatttactactcccatttcttcactgcacattcattgccattgcaaactaccagtgctagtaccagtaggagtagattattgttgcttgatagtagagtccaacaagtgttgcattggcagcttcagtcagtgaggcacccccatactactactgctgctatctccatggcagctttagaatccaaaacagtctaaacaatgcctttaaagcggggccagatcaaaggtaaagctaaagtccaaaagggcatgcataaaaagctaaacaaaagctgtaaacatattactgttacgactgggaacatttttaattgcagtaaacaatggcgtttctgtaggatcaacagtgtcatgcatcggtctctgtgcatgaatgatcctcctcagtcataaccatttcacacctccctacaagcaatatttcttgatttcttcatattgtgatttgtgatgtagcatcagggctcctttggactaagaattttttttcctatgttctatctcttggaacaaagtaaaatgcataaggattgttttcatatgctctcaatcaatatatgaattctaacatgaactcatcttttttttcctttgctaatgtccaatgtatactctctctctctctctctctctctccccgcatgtgatttccttaaaaaaaattgtttcaattcctgtggaactatccaaacaaaatatcttaagtgttgctatgtttctaaaatcatgtactccctccatccctaaatataagggaggagtatcgcagcgtcctactatttctatttctgtgttataggaatcctgcgttgaaaagagccctcaaagttgatatagcttattgttcattttccatggctactacactatttctctcatgttccaaatgaaatttcctgtatctttagaaactgttttgctaaatggagaccattttgaaacttgcatagattttatattttcacaaataaattatttacattttcaaatatatattataaataaagaaacaaatacatttagccattttcttaattattatgccaactaatatctttatatctaaaatcagaggaggcagatataagtagttactcctcctagtgatttaattgtatgtccatgcagatgctgctggtgaacagtgtgagacataaatttgctggcttttgatgaacagtttgatgagcatttgggattggaaggacatgttcacgttaagagttgatagtgatgaagtgacctgcaaaatggtgagtttggctggaggggattgtttgcttttaggagctaaaaccttagcttaaacttttgcatgagacatgtataatctttagctcataattaaagaaaaaagacggtttgtgtccttttccttttgttcaacaactagattagttaagcagtagagtagttagtagctcttctttttttttcccttctttttggtgctgaactgctgattgatttaccgtacttggcgtttaaaacaatgagatgagacaaaatgacaattaccaaaccctgttattagactgatggtgaaatctactactccctctgtttcgaaatgtttgacaccgttgactttttagcacatgtttgaccgttcgtcttattcaaaaacttttgtgaaatatgaaaaattatatgcctacataaaaatatattttacaatgaatcaaatgatagaaaaagaattaataattacttaaatttttttaaaaaaagacgaatggtcaaacatgtgctaaaaagtcaacggcgtcaaatattttgaaacggagagagtactagtagtagtactattaaaaacctgttttcagtgccaaaacttttctcctgtttctttacaaaaagaaagggagaaagacattgaaatgtgctgagcacccgcaatggtaaagtaagttgctctctataaaacatgtacatctcagcaatagactagattaatagtaaaccacctcaatagtatgtctacttgggtatctatagctctctaatatattgcctcgtttttctctatagactatcttcaggttagtagatagctttgctctctctcttcatttaatctcttccaagtagaaaaatatgctaacatggatctcttgtaaagagtttatagataattattgtgggtgcccttacagtgccaaactgccaataaccttgatttgttttccggttctcaactaccaacaccacaaatagtgtagcttcaagttttgttgcagcaattgatagtgagcatctggagtactactcctacactattatacacaactcaagaggagtgaaggaccatgaaggaatcaatcagccactaacattatcattagagttcttttcttgggtcctgcatgacaggaatgtgcatgcagtgtcagtgagccaattatcctgctgcccatacacttgcacattcacacattcacacacacaaaaaaacacaaaagatgaatgaatgaaaggcgcatgtctggctttgttcagctgctgtttcctccccttcttttcccccatctctttaggcggattcggtgcgtgattgccccattgccattgcaatttttgccagccacctggtcagcaaaagatgggggagatgatggggctgaagcctgcatggatgtttcattttgattccttgattccttctcctttcattcatagaaaaacaatcatacatgcacatcctttggtgataatgaatttatattgctatactctacagtaattatttgtgggagtagtagtacaagtcttgctcaatctggtaattctatctacagtaatttactcccattttcacttcacttgccctgtttagtttcaaagtttttttctaaactttcaactttccatcacatcaaacctttcatacacacataacttttctatcacatcatatcaatttcaaccaaacttttaaacttactaatgaactagacacagccgtactggagtgaagtctaccagacgagtaccagagttgtgtatgtgtgtgagagaagaaatggtcatgatagcatcagttccatcagttcaatccaagtgaatcaaaacctgctttttgcatgcatgcaggatgcaagtgaggaggaggaggaggaggaggccccccctggtatgcatgcctgccccaagcaaatccagataacctaggtgagctgaggtgactgataaaacagcatataatgtgatgtgtgtatgtagggactgtgctgcctgcccagctgtggtggcctgaatcatctcatcctccccaccttcatccaccatgctctgtctcttgccttgttgcctcctagtacctcttggcatgcatgcccacttgtaatccggattcacaatcctggtactccctgcgtctcaaaaaaaaaaaaaacattctaggagagaatgtgacccctcccagtacaatgaatctggacagagtgttgcctttttctggaacggagggagtacctttttgtttttagttgtgtttagttcccttcaaactttcaaaaattctatcacatcaaatatttagacacatgaatggagcattaaatgtggacgaaaaaagcaattgcacagtttgcatgtaaattgcgagacaaattttttgagcctaattacgtctaatttaacaatgtggtgctacagtaaacatttgctaatgacggattaattaggcttaatacattcatctcgaagtttacaggcggaatctgtaatttattttattgttaatctacgtttaatactttaaatacgtgtcggtatacttaaaaaaaatttagacagggaactgaacacggcctttgaatggaaaaaggctccccactggtttattgaaaaccgatgactttcgatcaatgttgaaaaccaattaatactgatcaactttcacagaccgacaactaatttcatgaaaaacaatcggttttatgaacctgcctagtaccggatcaagaaccgattggtatgtcgaattccgtggaaatcgttgataaaccaaatcaaaactgatgaaattagaataaatcttgtcaaaagtttgaaattcagtttgaaaaccgagcaatttgtatttttttttcgttgtctaggaaatctggtttccatcgtttttataaaccatacttgtataatccatcagttttataaccatggctgtgtttagtttgtgtgccaaaattattataagtatacggacacacatccgaagtattaaacgtagactaatagcaaaacaaattatagattctgcctgtaaactgcgagacgaatctattagcctaattaatctgtcattagcaaatatttactgtagcacaacattgtcaaatcatgacgtaattaggctcaaaagattcgtctcgcgatttacatgcaaattgtgcaattggtttttttcatccacatttaatgcatcatacacgtgtccaaacatttgatgtgatggaaaagttagaagtttaaagaaaaaagtttaaatctaaacacggcccatgcttgtagtaatagtacatcatgcttgtataatccataggcaggagaggaaaataaaacagatcataggagaataagggaaagggcaaagaagaatataaatcgtacttggattgccgtttcggatttgtacagtggcaagtaaacaataaactccgtggcctactgcaatgttattgtcacaattatatatgcatggctaggtccttgagttcaatcatcagctagctacagtactgtacccccttctttagcttttgtgatagaatgatgagatttatatcagatcatggatggatggatggatgcatatatgtctgtgatatctccggcttttgcttttgtgttggatcgatggcacaacaacatgctggatggttgtatagatctagtctatactgcatggacagctagtgatagtactctcctctttgaggtatggtttgaggtaaccttccctccctccttgcaaaggacacgtcaggccactagattctcatgtttgtcttccaaaaaaattgctcatgaatcatcgtacaatttcctttgcacttttttattccctccctcaaaacaaattatcttttatacacgatatgcttatttattttaggacataactacttaccatgtactcccccgtcaaaaaaaaaagtcaacctcgtattaggatgtgatagagtataggagtaattaatttctaatgcatacccatatgtgtagttattatttacaattatgtgtagttattattatattgtaaatacataattttattaaattatttttagtgacaattattaatatggcgttcacaaatgagatatgcaactttaacatgttttactcacacccgttctctaataattgacacggtcactattccaagttcatactttaaccacatgccttttaaacaaaactagcaaggaaacccgtaccgatgcacgggtaatttatttgttgtttataaaaaagaatataaaaaatcgtatctcaccatattcaactgtaagaactataaattacattataatcataaaagaaagaaatacttacaccatgaaataaaccataaaattttatatactaaatgataatgtatattatattcaaacaaattcactttatcctggttatacgtaaactcgtctatcaccatctttcacaaacatacgagttaatatgagttttgtttttttcttttactatacatctaagtcacctgcgcatgttcatgggtaatatacgaaggaataatccattgtcaaaattatttatgctaattttgttaacactttttatatgagaatggcataattacataaggatataatatgtttccatgtgacatttttttattgtaagtatgtatattttctttttgtgaatagtagtatgtgtattcataggatagtgtgcacacatttatatgagcgcttacgattgccttttacatggttagtaaaaaaatactttcaaaatgtctggtgggatggcatgaagcggtgccacagcgacacgacttcttcgagaagattgccatgagtgcctcaaattaaagaaaaaaaactatcagatagagcagatcgtatatgaactcttcttttttattcttttttacatatcttgtgtacatacgtacatacgaagggattaaatggtttttagttggaatagatctaatgtaatggttgaaaataatggagctatgtgtatatcaattgccaaatattttgttttctaataatttttcttatttttttctaatttattagagttgtcacgtggcatcttaagagtgcttgtaggagtgtagaaatgttattactcacactggcaacctactcactgtcaactattgtttgttgtggtttagtggcatactcttcttacctatcatttgttgaagttgcccacttagtatagtcctatcttcggtgcttgatgacacacgtgcttattggatatcagctaattattaggtgcactgtgcacgaatgactcgtaagcaatattcccactaatacagaacttatatacttatgattagtgggaatatacgattgtattagactattttgtatttataaagtatattatatactacatattaagggttttagtatgtatgcaataagttgtaaagtacttatcggattggctactctcttatttattatgagcacgtttcctcgattgttctaggaatttttataaaagaaattaataccttttgataacaatatctaagtccatctaaaccattatattccttataattaaattgatatcatggactacattgtatatatttaagtgcaacgtgtgtattattagaaatatattctatataaaagctaaatctatttttggcttcataatatttaatatttaattaatcttgcactaatgacatgtgtcgtttcgtgtgtccaagataagctcagctattgagctagatcaaagtctaattaagttggagatagaagacatcgacatggtgtcaaaagaatatataagatctttaattttcaaatattatagaatagagaaaacatataatacttgaaaatacgttcatgataatttagtaatatcattttgacatattattatattttacctagggagtggaaaaatttttagaattgttagtcacaattagagttgtttttattttaaaaatgaaagcctaatttagctatcatataatctattttttattttatttatatttttcatggatgtttccatgaaatgcgcctaattagaaactctaaataacatatattttgcatagtaaatatagacagtttggttttccataataagtgagatagaaaaaaaaagaatgatgtgggcccagcgtcgtacgtacgtatcaaaatatggacgtactttttgtttttttggaatacctatatgtgcacgtacaataagagtttttagataaatttaattgtatttttataatagatttaatggttagaactaatgggtccatcggattctaaaatttattagagcgccacgtggtgatttaggagtgtttttaggggtgctatgtgacgttttaggagcgtttataggaaatttaatagacttttagtatataatagatagatagattgtacatacttcatttgatcgtaatacattcatttagaagtaatttatggtcaaagttattgtccgtcgtcgacagcgatagttattccagaatgggccgacagtactttttattgaatatagtataatgtatttggctgcattttagttcttttagctagaaaaaatattttacaaatataccctctataaaacttattgcaggtatggacccactatcttggcaccagagatgttggcgctgaggtaggatatcacagagcaacattttaacgtcgtcctctcccatttaagaactactccttttttctgcaaattttatagacttgttgtcaaatttgaaaaaaaaggacgatatatattaatgtatcgtaaattcctaatttatttccgctagtttatttttatgtataaaaaattaatatgggaagaggacatggctcgcaccctcctctccagtactattgattcgtggttaaatttgaaataaaatcgaaatctgacacatgatatgtattttttttccccgaaatttcactgcaaatcaatattactaggtgtgagaaggagtgtgggacccacattctcctccctttataaattagcgtgaatgaattaggatgcattggtttgtagttttcctaaaatttgatacggagtagcaaattagtaataagattttgaggaaatctagatgggagaggtagacgccaaacttgctggcgccaaaatccacaaaccatgccgtagagataggatctgcaataagtttttttaagtctatttttaaaaatatgtttactaaaaatactacaatatgaaaaaaaaagacaagtttgattgctcatgttcaaggacataaacaatcaatataaaaaaaataaacttccaaggataaatctggaaaaatgcttattcgaattgatccatgaaagttgttttttttggaagggaatatgttgtatcttactccctccgtcccattttaagtgccgccatacttttctgtgctcaactttaatcgtctgtcttatttaaaaattttaaaaaaatattaaaaacataaatcacgcataaagtactattaatattttatcatctcataacaacaaaaatattaattataaaaaattttcaaataagacggacgattaaagttaggcacaaaaactcatggttgcacttaaaatgggagagagggagtatctgaattgattttttttatgtgagggacaaatacttccttcgtcccataaaacataatctagaactggatgtgacatattaacagatgtgtgatttagtactagaatttatcacatccattactagattgatttttcatggaacggggttagtaagcaagaacaacatgatattggttgtactgggctgttttggtttgatgacaaaatttgccctacaaagcactttaaatagtacattgtagatatttggattgatgccaaaatttaccaaaggtatttgctaggacaccaaaccaaatgatcccactctttctaatgtttactagtagtaccacttgtttaatgttttttttaacggggacgatatggattgatcttgtgagtagagaagcagcagcagcagaagatctttggtgaagcaggatttgccgtgacacaatgaccgatcgatcctccgttatacacacggtacacacaagcagtccagattccagtctccagtccatatacacacggtacactggctggagtagacaactgcgactcgtgtatccatggagtatgcatgacaaacaacaaatttcagcgaccccgattagacgtaacccctctccgctatactagcctgtgcagcggcagtagtccagcctgcagaggtaatatgatgtgtcctgtactctgctgtgtgcagctagttacagctacagccagcctactctttgcgttgcagatccacacatggcagctcggattggggagccatcttcttcactggaccagtccatctagattttttttttgttttttactttttgtccttgctctgaaactcattttacaaataaatatttagaaaaacttattttaaaaatagactcttttcagggtgccaacgaagataggcatcttggtccaacgtgacagtgctaatcacattgacattatcctatagccttcacgtgaaagctaagtgactgatatgaaggagttagcgtcaatgtcattggcatcaagaacctatctataattattttttataaaaaagacctatttacaatacatatatttataaatagattctcagtgccgtgttattagtgtcgtgaatctatttgtaaatgcatttttaattaaatagatcctcttttattacaaataagttattttttaaaagaatttacaaaaagatcatcggcaccaataacgtgtgcaccgatcccttttacatcagcattttagcttctacgggcaagctagggatcatggcgtcaataacttgatgccctacaaaaattcatttataagtctatttataaaagaagtttttcaaaaagtctaaaatgtaaaaaaatcattcatgtaagtacgtccgacagttgatgctactagtactgttattcaacataaaataaatgattttaggctacttagggcccgtttagttcccaaaattttttcctaaaaacatcacatctaatctttggacacatgtatgaagcattaaatatagataaaaagaaaaactaattgcacagttatgggggaaatcgcgagacgaatcttttaagcctaattagtctgtgattacccataattactatagtaacccacatgtgctaatgacggcttaattagtctcataagattcgtctcgcggtttaccgacgagttctgaaattagttttttcattcgtgtacgaaaaccccttccgacatccggtcaaacgttcaatgtgacatccaaaaattttcttttccccaactaaacacacccttaccccttaaacagactaatctaaaaattcgctcttataaaaaatttgaataagatgctaatcaggtagtagaatggcataatcggaggaaggactaattgtagtaagctgcaaaacccggcgacgttgtagctcgaggaacatctgatccaagaaaacggtagtagcaggttaattaacccaataatctgggcagatcttctatttctatttctattatatactaaaagtccattaaacttcctacaaacactcctaaaccgccatgtggctcctacaaacactcctataccgccatgtggcgctctaacaaattatagaaattctaagaaaacaataaaaatccgaccatcgattttcacttaatacggtggacccattgtttcacaccattagatatctatcttataacaggaaaaaaaaaatcacaaaacccatccgtatcccctccatcacgtacataacgtacgtacgtcccccaccttctctctctttctttccatttatttataggtagcaaatttttatgttaaaatattaatattaaataattagaatttcttataatatatttgattttaattatgccatgtgttggagtgttttatatatatatatatatatatatatatatatatatatatatgtatatgtatatatatatgtatatatatatatatgtatatgtatatgtatatgtatatatatatgtatatgtatatatatataaaagaaatatatcatttgcatataaactcatatcctttatatgataactaaatattaagacatatcatgcaatcgtaaatgatctaccatctctccttcactttattatccttatttctagctagcagcttagtatataaataattaatatataatttttattatataataaagatttgttaagcagatccccataaaatatcatgcagatatttctattatacatcctttatagtgtttttagctcatcacatggcacatctaataaattataaaaagtactataaatgctgcgaaagaaacatttaatcaatgattttcatttaaatagataaacctattatttttaaccataaaatctatctatataaaacttttaaataaaaaacgtctcctccccttcctcctccttcctctcatctacattattctagaaacttgcatatgtaaatttaaattacaatgtcaaacaaaaattagaaattcaactattaaatagtgttttgtcaagagacagcatccctgctttttttttacatgtcatccgaattgacataatagaatatgaaataattgaaaaaaaatcacatgcactcataatttatatgaaatatgccttttaccatggaatcattatttttttaccattagatttatcttaataaatagacaaaaagagaaaaggcccaatcccaaccctcctgtcctattacattatgtccatacatatgcatgtctgcgccctcccccctcatgcacgacacaacctcgcctcatcttttccttctctcccattgtcttatttttatgcttattagttagatagaaaacatattttgtgatagcaatttttaaacaactataccacctaaactaatttttttatctgtgcacctcattagattatttgcagttaactttcatgagtcgaatccaaattaactactaccttcgtcctaaaatgtaagcatttttagaccatattttggagactagctattgatcagtcataaatatttaggaaaagccacaaagaattttaaatcatattattaacaacatgttgcttacattacaacaatgtaaaacacttttaagtagttagataacacatttgtggaaaataacaaataccgacgaagaatatttgtggagaaaatatactttgaagtatgacagtgctatccgattaatattaaacatgcagcccacaatacatacgcattcacgctaccttcctagtttaattaaacttggggcgatcaacacgcacatcctgtacccaagtggagcacatatatgggcccagttgtgtgcggcatcatcatgcgtgcatatgctgctgctgctgctgctgctgctactgctgctgcttgccttggtctcgtctttggagacgaaaaagaagagagaggaagacgttggcgaggtgacctacctgtggcaagaaatgcatcgcaatgcagaggacgaccaagaagaataaagtcgagatccacctaggattcgtactactgtacacctgctatacagtacgtactccatctcctttttgtgtgacggcttgaaaagaaaagaaaacaaaacaaaagcgacgccatggctgcccatctcctccttctcacttctccctcgtgcatggtcaccatgacaacgtacgtaatgtactattcctagtaatgtgctgtggcgtactgtactgaaaataggtcatctaacttagtactgttttctaattttaaatggttgacacatagatcccaccgcttatgggttcatatgtcagcgatccacgttagagaataataagtcagacgagcctcatccgtaatgtaacaggatcacgagagcactctcctaccatgtatactggccattaaaaaaaaaactttcgactataaatttattatcggtacaataaatttcttacctcgtgtaccggctagcaacctatatccggattcgtagtcatactaatgctacattttgaaacgaatgaataactatagatttaagcacggacgatatctaaatttgaacctagtaactcaattactagtttttttttaaaaaaatactagtaattgaatttattttttttattactgcatatgtagtgctagtgcgggtgctcttcctgcagttggccacttggccaccgcccggtcaacctggcatatttcttttccttcctttggctttgctcgcctagcagaaaaaaaggatcaaaaggcaaaaacaggtctcatcgatcgcaaccgatcactccacttttaattatttcatccattatctcctttagttcgtttctcttttcttttccccctttgacctccatttctttttcttttttgtgtttcttaattagactagccttcaaaactttccttttttttcccctctcttttttatctagtgccctgcctttagaattccagttagggagggatcattttgactggaaattctagctggtgttcttttcttatcacagttggtttggatcagcataacgttctccaccagctgtgatagaaccaacaattttagggcccctttaatttgaagaaaaatataggaattttggaagatttctgtcttataggaaaatttactaagaagccatttgaaaaataaaggattggatcatatccaatcctttgaaattcctatagaatagataatcctatagagattttggagaaaatttagcaagggcttcaacttcttgataactttcctttgagtctatctctctcatccaagtcctgcgtttttcctacggttcaatcaaacggtcattcctatgtttttcctgtgtttttacaatactctgttttacatttgcattcctatcaaaatcatacgttttttctattcctacgttttctcaatcctgggattcaaaggggcccaataagatcaattatcatagtttgatagtttagtgaggtttatttacatactcccaagggtgattatgtacgctcaattaacaactagtacgattggcgtcgtcggccgatcgatctgtgtgcggtccatatatacggatgacgccgtttgcctgcacatgcagctcgatatgcatgtatatatatgatgatcatctccatcgatcgatcgatcggatcgagcacaaacacaatgaatatgtatgttgcatatatgcagcatgactccaatgtaaagctgtgcaggagatgatgattttggctgaaacacatgcctgcttgcctgcatatgcagcttatagctaactgccgtgctgccttcttctccgggcacacgctgtcccgcccttgcgcacgctacattgtcgatctaaccatcgatctcgatcgatcgatcgatcttggagctagcttaattaggagtaattagctataagcgcgcgccaaaggccaaacctggagcttaattaagctgcaaatactcctatatgtactaatctaattaaccagagttactttaatttcagtctttcagatcaccaaccatgcatatacatgatggttgcatgacatgcatcaaccctacattatttatattaatggttgtggttatgtacatgtgtattagatgtatgcgtgctgaataatgcttagagtccacgcatgcatgtactagcgccagacgtggggctgtttggttgtatatacgacttcaccttaccgaactttttgacatatataaattgtgacgacatgccacaagttttattgataagaattaattatttacatatgttaggcaaactttagtaaaaaaaagtgtgggtctatgacaagtgggaataaaaaaaagtgtgagttagattttatggcttaccaaaagtcactactatatatagaaatggttttttttaagacaaccccttatttttacaaggggctaggaagacccgcctatgaaaatatgtgtgggttatccagtcaagccccacgtgtggaaattgattttcacaggtggtgggtataatcgaaatataaaaattccacaagagatcgaatcatgacgacaaaaccaagacattatatttgcctaattatggactctcctcctcgatctagtataattacaatgtattagggtagccatgacgatcgaccggttaggcagccggtcaatttcccttccctatgctatagttgccatgcatgttgttacaacatgtgtacatctctatttaagagagagtctaagataatatttgactctaattctattctaacatatattgttacaactaaaaaatctaatttgtaactgattttgtatatatattcaacacaaactataacagtgataaatttgatggtataatactatacgtagaccgacataaagatactcatgtgaaaaaaggaattgcattttggtagaaatacagtttgtttggcatctacatccaacctaaacaattttaactccagttagttaaaccacatagttatctagctaaacatgatgtttgtgagtgcactgacaccgatatctactctagattttgaatcatgataacctagggatacaattacacaacctaatcatcttgtcacatgccaaattagcaattgagtactagtatatatctttaagttagcaaccaaggtagaactatcatacatgtcgttaccagcagcatgcatgcagcttgtctcatgaaattggccatgatcgagcatgaaccacttgtagagttgtagtgaaattaatcgcacttaaattgagtagtccaatcacatagtccagccaattacaggtaatttgcacatgcttgcttgctgtgaaagggagattaattgagacgcgaaaaattgcttgtctgtacgtcccgcttcatttattatgatcgattccctggtcaggagggaacaaaaccaattgttatgggattgtagggcctctttaattaattgtttcatatgccaaacacgatcaaataaaaaaatggcatcaccaaaattttagtcattgggttgtttttatagtcaaattggcacgccaaattatttagcttaagtaaatgccaaaatgtaactttttttagaaagacagtataaacaagctctaaacacctgtaatacacacggcaatgtatcgatcatatgcacacaagttttctcgtatacacatcatgcacatcaactaaataatatcaaaaaagttctaaaaatgttgtacatatatacttagtagtattatatctatgtatagagtctcatcttcaaactcattatatataccatttgtttcatgttataagtcgtttgactttttcatagtcaaacttttttaaattcatcaaaatttgtaaaaaaatatagtaacatttccaacgtaaaacaaacatatcatcaacatatatgcaatattaaatttaatgaaactaatttgatgttataaatgttgctatttttttcaataatttgatcaaacctcaagcaatgtgacgaagaaaaaggtcaaacgacttataatataaaacagagagagtagggagcaaaaaaaacgacactattttgacagatttatactcttaaaactgttaaaatttttttatcatttttgttacagctaaaatataatgaatttgaggttaacattggacagataagtgtaatactatttttttttgagaattacacagtacaacgcagacactcacaacacacgcaaaccctagaattacacagtacaatgcagacactcagaacgcacgcaaaccctacccctatgagcatcttcgaagactggaccggcaaatcctggagagattgacgaagtcaccacaggcgcctcgctgtcgacgggtatgtcgcctaccactgaaagcacaacgccatttaatcctggaaaattcgctcccatggggagtcgaacccaagacctctactgagtctcttgtaaccactaggctacaggccctttcgcagataagtgtaatactattgaaatcacttctataattttttttctagatttttagttgcgtacacgataagacttgtgtgcacatacacctattcttatgagcatcttggaaagattgagccgacatatataactaatttggcagcaaatcaaacgaagccattgtcaattcttgctaaaaatttggtaatgaccaatttttgctgtgccaaaaaaaaatgctaacggcaatgagccaatcggccaaacaagcgtatagcaaatttgcactgaggcctacctgttacataatagtacccctacatatatattctccaaactgttccatagggaccataaaaatagtggaaagtgggaggacctgggtacaatttatccccactggttggtaaggtttgtgcgtcataaattcgcccgccaaaaaccagatgggcgtgcgggtgcggcctcgtttacgcgttgcagtggttgctggtaacaaacgctgctcgtgtcaaaaaaaaaaaaaaaactctgctgccatcggtgacgatccgggccgtccatttccatttgcatccacgtgtcgagctttgccccgccaagattttgtttaatttgtctcgtgtaccgcccccatcccgtaaatgtccgcgcgccttaattgcggccaacccatttcaccaaccgcaaca

SEQ ID NO: 27997 - DNA, 589 bp, Oryza sativa
tatagggcgaattcgagctcggtaccccccgtggagatccaaaaggttttttggtggtggttgttcgtctcggattatcttctggccgcaccgcacatcgggggcagctctgctctgtgagtcccctccgatcctttttgcttcgcgtcgcattattattattatttttttgcgtaattttggttgttgtgctttatcgcgtgagttggtaggtagtatcataaaaactatttaggagggttaatggttagagcctttgttgcctcaactcttgtaagggggcagtttctaaatgacatgtttgcataagagcccataccgggctctacctttgagcatgacctaagaagcacaaaacaagcattgagatcatgatcggcacagctaacaagcaactgaagtctgaagattaaacacaaaaactaacggtattttgcaaagcatattttcacgcgtcccttcattataaaaatgtattatttaccccccaacccccaccatacccctttcaaatataaccataaggagaaacagaaaactaacaatcactttgcaaagcagtacatagcccttaaacccatttttcatg

SEQ ID NO: 27998 - DNA, 674 bp, Oryza sativa
  unsure (1)..(674): unsure at all n locations
nnnnnnnnnnnnnnnnnnnnnnnnnnnnnnnnnnnnnnnnnnnnnnnnnnnnnnnnnattctggaatagaaggagtataagagaattttggataatcataaaatgatgacacggtggggtcccacatccacgtcgggtggctgctaccgaccttgacctgccccagctcctcgggagtcgggaaggcaactccgcctcttcatccttcgccgccgccgccgccttcacgtgctccctctcctctgcgagtcggcggcgccgatctccatttgtcgaggcgagcagagcaggggagccgggaggggagggcatcctggtgaggtgagcatccacatcccctttctgatgaatcattcatctctctcccacctggagtagttttttttttgtctggaattcgctcgcgttcgttaaccctagctttctcttgtagatctggaagaagctctcctcttaattaacctgtgtaaaagtttgtttgttcccccaaaaagtttgctttctgggattactaccaggaggaggagaggggatagatagtctgtcagatgatgatgatgccgctgcgttgcctcttcgagctggcccgccgccggcctgatcgcgcggtgagaatctactcattttctttctttggatgaatcattcagctagaagcacgtcgctgtgtcttt

SEQ ID NO: 27999 - DNA, 581 bp, Oryza sativa
  unsure (1)..(581): unsure at all n locations
ttggcttgaaatattgtcataattatttttttacatttatgtaacatttatgttgcccaattatcatatagttctaaaaattcaaaaaaaatattaatctcaaacatattaaattaaatcatatatctacttaaaaatacacaactaatttgtattgttttcaattattttacatatgtagctttaaattagcattatattatcatcaagtgttatttgacacctaaaatatgatgtaaaattatttaaaataggaaaagtacgaattaccccctaactattacggtcgaccgaattaccgcataaacccgaaaactagacatttttcaccctcaattattaataccggatgaattacccccccccccctcccaaaaaaaaaatcaagccgaagtggttttggtcctacgtggtagtccagtctgcattttaaaaataaaatatgtggggcccacttgtcacactctataccctctcaatccctcctgtctcacctctatcttttcctctcttcttaatcccattccccagcctcactcttctcnctccaattgctgctggggccggccgcaagcacgccg

SEQ ID NO: 28000 - DNA, 1739 bp, Oryza sativa
tgatgcaaaagttaagattattcggactgataatggaacagaatatatcaataatgaatttttgtcatatgtctcagatgaggggattattcaccagactacttgtcctggcacccctcctcaaaatggtgtaactgagagaaagaatcggcatttgctagaagtggcaagatctctgatgttccagatgaatgtaccaaagtatctatggagtgaggctgtgatgacagcagcatatcttatcaatcgcatgccttccataatacttggtatgaagtctcctgccgaactgttattgggtaagcgagagttcaaggttcctccaaaggtgtttggctgtgtttgttttgtgcgagatcaccgaccttctgttggcaagttagatcctcatgcaagaaagtgtgtgtttgttggctatgcttcgagtcagaaggggtataaatgttgggatcccattgggagaagactgtttgtgagtatggatgtgacatttcgtgagtttgagccctattataaaagtaaaggagatcttgaccaatttcttgaggaattctcgactgtcatggaggttgatagtcgagagggggagagagagagaggtgacatacatgaaaaaaatgttggtgacaagaatggagaggcagtagtgattggatcaataccatgctctattgatgatgcgagtaaagaagtagtggaagtcattgaagatacacaagatgaggatagagaaatggtccctcatgaagaggatggagaagaaggagaagtagttgttgggacaattccatgtcctatggagggagccgaaagggtgaaacaaaaggatgtgctagtttaccaaaggaggcggtttgatagtcagggggagaaaagaaaagggttggtgcaaagtcaaattgaagagttaccacaccaaaaatgtccagtccctgaatcctcccagagtctctctcctccagcctccttggcttctcttgagacaattggtaatacttctccaactcttgaacatgtagaattacctcttgcacaacgtagagagactagatccaatgctggtagacctcctatacgtcttggttttgagcatcttagttctatgcatgacattgcaaactatatcacatattctcatgtttcaccagcatacaaaacatttattgcatcattacagacagtgcctataccaaaggattggaagtgtgcaaagcaggatccaaagtggaaagatgcaatgaaagaagagttgaatgcccttgtgaagaataagacttgggagcttgtaaaacttccaccagaaaaaagggcagtgggatgtaagtgggtctttacagtgaagcaaacccctgaagggaaggtggatatgtataaagcaaggttagtcgcaaaaggctatagtcaaacatatggaattgactatgatgagacatttgcaccggtggcaaaaatgggtacagtgagagctttggtatcttgtgcggtgaactttgggtggccccttcatcagcttgatgtgaaaaatgcatttctccatggtgatttacatgaggaggtctacatggagatccctccaggatttgggaatagccagacagttggaaaagtatgtaaactcaagaaatccttgtatgggttgaagcagtctccacgtgcatggtttgataggttcaggcatgcagtgtgtgatatggggtattctcagtgtaatggagatcacactgtcttttacaaacata

SEQ ID NO: 28001 - DNA, 19844 bp, Oryza sativa
  unsure (1)..(19844): unsure at all n locations
nnnnnnnnnnnnnnnnnnnnnnnnnnnnnnnnnnnnnnnnnnnnnnnnnnnnnnnnnnnnnntttctccatggtgatttacatgaggaggtctacatggagatccctccaggatttgggaatagccagacagttggaaaagtatgtaaactcaagaaatccttgtatgggttgaagcagtctccacgtgcatggtttgataggttcaggcatgcagtgtgtgatatggggtattctcagtgtaatggagatcacactgtcttttacaaacatagggggacacacatcaccatcttggctgtgtatgttgatgatatagtgatcactggtgatgatgtagaagaaatcaggtgtctaaaggaaaggctgggaaaggcatttgaggtgaaggatcttggtcctcttcgctacttccttggaattgaaattgctcgttcatcaaaggggattgttctctctcagaggaagtatgttttggatctgttgacagatacaggaatgcttgggtgtcgtgcaagtactacgcctattgataggaatcaccaattgtgtgctcaatcaggtgatcccgttgataaggaagcataccaaagactggtgggacgcttgatctatctttgccatacaagacctgatatttcctatgcggttagtgttgtgagtaggtatatgcatgatcctcgaactggtcacttggatgttgttcataagattctcagatatctgaaagggactcctggaaagggattgtggtttaggaagaatgggcatctaaatgtggaaggatattgtgatgctgattgggcgagtagtatggatgatagaagatctacatcaggttattgtgtgtttgttggtggtaatcttgtttcttggcgaagtaagaagcaggcagtggtggctcggtctaccgcagaagcagaatacagagctatggctttgagcttcagtgagatgttgtggatgaggagcttgttgactgaattgcgagtgctaagaagtgacactgtgatgcttcattgtgacaataaatcagccatcagcattgcaaacaaccctgttcagcatgatcgcactaaacatgtggagattgataggttcttcattaaggagaagattgatagcggggtgcttaggttggagtatattaagtcatgtgaacaactagctgattgtctaacaaaggggttaggtcctagtgagattcaatcagtatgtaacaagatgggtatgattgatatcttttgctcatcttgagggggagtgttggtgtaaatatgtattgtaccaaggacctatctgtaaagtgttatgctaatagaatagatgaggaaggggtgagctgagtaggcaaaccctagaaaaattccccaaattgaacaatagaaataaaacatattcaacctgctccttgcaacacatgagtaagctagtatttcaaataaaataatttcactacaacggctcacaaatgagagagagctataagggtagaatatgaaaaattgtttttaatggggatacataagacatattaagacaaatttcacacagaaatttacaagtcctatgtaattttatacctcaatcatagaaacaaagttgtggatcaaatctttgagctataagtggaagtacctctaaaatgaaatcatgatctcacgatgtatggaaaagcatggctctgacatgcatttgattcaagtatgattcaaacctaaatgtcacagaaaacattaccttcttccgaacactgcagtatccactgaactggagtgtggcacccaacactgaatcaatcagactgccaagcaaaccagcagtagcagagatgggtattactagaagctgtcgaagagccacgtcaaatgagcactccacagtcaacagtccaacaaaaacaaaagtcagacctatgattaggccacctgctgtggcagcaagaaggccttgtaaggtcactccaccgtttgtacctttcctgacaggcttaaaaatgatgttgaattatcagatcacacagacagacatgttcgcacgatattaccatgcacatttcaaaaaacaggagcagtaaaatgacgcaatgcagtaggaaataacatcacgcctacaaaaggaacatttcccttataccaaactaccttggttctagtttccaattatgcctattgaatttatgggaattgggcattaacctcaacccattgaatatgttgttaatattccaaacttgcttgcctaatgtgatcaatatgtgatccataagttgcatgaacaacatgaaagcatttctagagcagtaagtgttagttgtacacttgtgtgatccaaaaaattggcaaagcaatttgttcaatactccctccatctacttttgatagtcatatttcatcttggcacatagaccaaggataagtaattctacttatcatctatttaaacatgctactagttattcctcgtaagcaagcgattcattaataatgttgttggattgaaatatgcctattaaaaataaaattttcagatttgaaaatatgactatcaaaagtagatggaggaagtacaaaatatgttatgtgacaagattttttgccacttcagataacctgattggtactcacaggccatggtgtgttgtatagtcaaatttgaggagaacaaatcatatgctgtgggttcctctccaagaaaataataataataataaacccattgtgcgtttggcttagaaaaagtttagaccagtggctaaaacctgaaagacaccaaatgtggtaggctggtggccaagcataaccttactacttctgcatgaagattgcagaaactagaaagataatcatgactgaaaggaacatctgacccaaaaaaggaacacataccttcagagtagtaataagacgtggctgttcatcactaagcacaccaagttcggatgaccaagtatctccattgcagcagcaatagtgaccaatgatgccaccaataataccagttataacctttgactcatgggagtccaggcattgatcttgtcctccggtcattgttgccaatatgatgaccaatatagtagctattaagctatttgctaggacttggatcctttaatgtaaaacgtgatggtaagatacaaaagtaaaatcaagttgacaaatcagcagctgttgtgttatatccaactataaatgttatgctgtccatacaataaatcactaatttaaatatttgataaggtccacacaattcactaacatcttcagagtataagttttgctcaaataaggtgatggttccaagaaagaatagaaccagttcaagaatagttctgaggaaagaaaataactaatcataatgtattttcatcaaatcaattaactgtaaggggggttattctttgatttatataatagctttacacttttcctatggcatgctgatgacagtattgaagtgtactcctaatttttaacactgacatcatatgatcgaaacttaatgaagctccattgagttctcaatcttataaactgtcttccaaacaggcattgacttgaacgttgatgcgcataatatataacaatcttttgcaactgtactaatagtctgtgggcaatgggcttattgaaaccaccacatagcaaaacattgcacaccaataccatttgcggcagtagctttatatttctatctagaataacgactacatgattatcagacactcagcagtcagcatcattagctgccaatttagacatactaattaatttagttggagatggcagattccgtggcttaccagttgcgctggccgccctccttgaagtcgtcctcgatgcggcgcttcctgtccgcgccgatcttggtcgccttggacgaggtgaagaagaaggccagcacgagcgcgccgtacctgtacccgcaggcgaggtggatcgccatgacgacgaacccggctgccccgccggagccgtccagcgagcggcggcggacggcgcgcgcggcgatgacggcggccagcgccgcgccgacggctgtccgggccgcgactgaggcggcggggatccccatcggctgcgctgcgcccgcccgcggcgggagtcaaaggcgccagcgattggggggtgaatcgaatttgtggtaggggcgccggattctgggagaccgggatgcgactgtaccagtagtagtccaagtgacgactagtaagtatgcagttcagcaaatctgaaccgtcggttatttcctccgctgatgacattgagcaacgttgacgtcttcttccctgccctgtctgtcgaattttttttatttttttagaatctttatgttttaattttattaatagaccattctaaaaatatcggtccttttagcgccagagtcgctggcgtggtctctctgatgctgccccctgccaccacggagatactaacatgcccacccccctatcccccgctcccgcgcccctcgggggctccctccactctccttaaattcacttgttgtgtgtttttgtttttgtttctgttgttttttgtttttcctgtagtaaaaaaatagtacattttttctcttattaaaaaattagggttccttgagtttgttttttacattcgagtgtccttccttcaaacagacataattttctcatatggactcggaattaagcaaattatatatatatatatatatatatggatatgtatagaaaaagttacattcgattctcaaccgccttaccagattaagcgaaattagaatctccaaattccacttgcaagattgtgttttcgaggcgagaagcttttctgtagaactttagaaaattctacctgtcacatatttcatccatttgagtttactttttacatggttggtttatgtgtgctcctaagtgtaaaaaaatatcaaaaaataaaaaaattgcacatctctcgtctacactagagaggagaggaaaaatggcgtggggggtgtggcgccagcctcattggcgcgctccccctgccacgtcagcaccgagccaccacagtggcaggaggacggcgccaaagtcgcaccccagaaaggctatttcttggataagtttttctaggggtatattgtgaaataaatttttcaaaaggaccaaattatgaaaaatccatagcagctagcgtggcaggccagcattgccacggcagctgcatgtgacatgacagagttatttggccacgccaggcgggttggcatagccaaaaggttcatttcttagaaatacttttagggatggtctattaataaaattagaacactaaaaggtaaatgagcttttcttaagtgcggttagcataaacatgcataaaggtacgcgcgaccaatcaaggagcgccacctggtagctgagtaaattatggggttaaattacctgaggggtattaaggccattaggagaccggcgtaaactctaatcgttagtttactctagtcgtgattccacaccggaggaacgtacgcgatgttagagttcgctggagaagacaaagataacctcgccagtgcttaagctaggtttacgcacgattccacattggttacgtcacaactaaaatatcgataaattgcctgcagactctccatgaagtgacatgcacgttatggaatggcattccagtcaccggaaaactaagaagcgagtggaaacttgaattacgtgctagttcttatggtttactctctatattgcgccgctactgtagatcacgtttaaagaaagccattgcatcggcacacgtacgtaaatagtggtacagatgatctgatgtagaagatcctagctaaaagcaagcgatcgtggttacatcctatttacgttggtctacaaatacaaaatacaaagtacatagccacataagatcgctagcactcctctttacgctgtgagaaagaaaaatttttacggtgggccaggcccacctacatttagcaggtaatcctctcaaccgtgtactgaataacgataggagtaaatcccaacgtcagtccattacgaagcccattttggcaataactgttttatataatagtcctttctgattccactattatgagccaaacgcagcatcggttttattgttagccccttattattatccaaaatattgaaaatgtgatatataatttataattttgtcaaggtcttgtcctcggttcaccaccaccctcggattgcggacgtaagcacatcgattctactcatatgttcgatgtgcttgtttatgtgcgcaatccatcgtgtgcgtaaaccatcatgtatgccttgaacgccaagcgtacagtgctttgcgagttgcgttaaagcctttaaaggtcctcattcttcggcagtcgtatgttgttgacaatgcactgaaaaaaaataatctagcgtaccaacggagatgtttgtgacgacaaataaaatcaagcaaataagatggacttacctcatctttgtatgcaatttagaatattagtattccctccatttcatattataactcgttttgattttttttcctagtcaaactttagtaagtttgatcaagtttataaaaaattatagtatttttaacacaaaacaaacacactttcaaaatttattaaatgctggatctcacgaaactaatttatatatgagcctcacggcccatgagtgactgcagcgcgtgccccatggcacttgtaccctcgagacatgttccacgaacaacttgaatccatctacatggtctacgcgtcgagtaggataagagattaggggattggtagtaatactcatttcgtttttacacacctcgtgaattaaaccactaatttccctacgtgcgaaaccttcgtagcttcgcagctttattgctagcccattcgacaggtccacatacacataacggattaggcttttccctaaaacaattatcacatctggattaaccattttacactagagtgatactatgtaaacgccaacctagagtagaccattcacaccttcatgcacgtcgcgaccatgcccctgtacgcataaacctttcgagcgtaggctcgatgtgtttacgtccagagatacccatgtaggcctataccatataggcacctaacctatcgaatttgaaccacagtccaaaatggacgtgtttacgtccgaaagacacaacgatatgtaggctctatctgtttagtattctttttataaacaaaagagaggaagtcaatttccaacgcatttgcgtgggtttcttacatactctctccatttcaggtcataagatattttgacttttatcaaagtcaaactgtttcaagtttaactaagtttatagacaaatatagttttatttataatattaaattagttttatcaaatcaataattgaatatatttttataataaatttgtcttgggttgaaaatgttgctatttttttctacaaacttggtcaaacttagtcaaaaacgtcttataacctgaaacagagggagtaatagtaaaagatgacatggcgcgacgatcggcacatccaacatccaaactacttaaccctcgaaatataactactagttcaactatactgtataaactacaatctacttgcattatttctgcttcttccttggtggcaggtatccagatgaaccgtcgtcatcatcgttccagtaggcattcttgtcgggtgatgcaagcggaggggccttctcgtcggtgttccagtcatcgtctttgtcttcctcatcaccggggtcgggcaaagagtaatcgtctacaactaaccccattaattccaaatttggggaatacccagcgttggtgttgaaatcaatggggactctgttgaaatcagcgacgatgcctcgatatgaaacatgggtaccattcctcctcgctagaagatgaatcagaggatgaggatgaagaactagacaaagaacacatggtggcggttgtggtttcttgtttggttgtagagtaaatgaatggaagatctaagtacatggtgacaacccccaggaaccgccgaagaagaagcgcccctcccaggcggaggcccaagccgacgagatcaagaggctgcagaatgagttgcgtgacgccacagatcgtgtggagattcgtgacggagccttacgccggatgatggaggaatccatccaaaaggccaggcaggtggtcctacggcttggcctcgacatcccgctcatacccaatgccgcaacgagcttcgcggatactgtcgggcactacgtgctcaaattttcacatctcgccgacgtgctgagtagattgccaccgtcgaagaggcgagagcggaagagggcgcagttcgtggccaagcgcatgttggtagcaagccgtgctcaccgctgctcgccgccaccgccatcgccactcctagaagaaagcgatgccacggcatgcggagaggtcgccgaagccgactgagttcgtagggtgtcagtacgtaggggttatgtggggacacccgataaagtcatggtgtcccacgaatacgtaactgcccaggatgttcagttactcatgaaatgatataaaagcataaacttcgattatacaatacttaagtcacttagttcacaacacaacataaatacaaaccattacatatatggcctataaagccttatttctaaaaacagataaactgctagactccacccacaggaactgccttagcgtaggatgacctagaaaccgtaatcgtcccactctaatgggtcaacaggatctccataagcatcttcctcctcatgatctgaacccatttatgagtacaaaaggtactcaacaagatatgcttatgataataaatacaataattgcaatataaaacatgcagtattgagagccggaaggtttaaaccctaaccttaacagttatttcatagagcctaccttaataaacatttgatataaacatcactattgaaaatttaatttaaacaataataacgagcataacatataaatgttacttataaataaattgaatagaacatcaagtaataaataagttaaccatattaatggccttttagtttaacttgtgcccataatctggaatcacccatagacacatatccattaaccgggagcacagcgtattcgaatactcaacgactctgcagcgtctgcccagctttacccacacgatacccacagctggccgggctgaaaagtaacaaggtgtaatattgctccttatatctctcccttctgcctagtaagttaaaagatgctcgggatgttgctcggagtgatccggtccgaggtgtgtaccaacctacctccgcatccacttaccattgttcgttactcgatgggcagcccagaacttcatggacccatagggtagttctgaactctcggggcccatcgagtccacatatataaatcatataaacatgaaccatgtccctttgcttcacacacttgaaagctaatggccagtacaccgaaaagcctgcagaagtttaatcaattggagcaatatacggccaggttcgacagatcgatcgtgtggatgggcgaaactatgtcattcttattgacacaagggggttgattattatatcaatttaaaataagaaataactatacatatatccatcacgaccataaacaggtccataaaaccaaacacataaactctatcatgtgtaccacccgctcacaagcggtgttaacaattttcagcatgtagccataaatagttccataagcatgctttcagatgcaataataataatatccatattaaatcaatagcatgtaaaataattaacagctcatttaggtgttcctcaaattttatcctaaacttgttagactctagggctcattaaggtgtccataatagcaacagaaagtataatgcaataatagcaatctaattaatttaaaagaattcgtgcagtttatcgtactccaaaggacgagtacgctaccaaaataactctctaactactgggattaaattgttcaagggagggtgcatgtcttacaaccttcgggctcgatgtagtcgtacaaaccgtctcctcctagcgcggagatttcactcgctccgtctaccggaccaacgtcaacgttttctatttacgcaacaatcatcaccacaataaataacagaaaaacaaagataaccaaaagaaaatagtatcacaaagtgcaacaatgggtgaaaaggatttaaagaaataattttagcgatttttggaatttcggtgaacggcgaaccctagggctaaaattagggcctcgacaacgggtgctcggattgcaatgaaactgatacggatggattcggaataattctaggagggtctcggattttgttttcgaggtcaaaaggatggtcaacttaataggaagagaaaaaggatttttccgatttatttttcaacaggaaaatcggatttttcttctcttctctcgctctgcacaggaaccggccggcaactccctagcgccggcggtggagatgaccggttttgggcaagggggcgccggtttcacgatctaggggtcgaggcgactccgttcccatggttggcaacggcgcaggcagcggcggcgaggctggcgacggcggccaggagctggaggcggcggcggccatggtggcggcgactccggcgatctccggtgcgggcgactggcctggtgagaatcagggaaggaagtggagcgcggtggtggcggcggctcggcctgtggcggccgggagcggcggcgcgccgtgcagccggcggcggccgaacagagcggcgacgccgggaggcggcgccggcggcactccggcgtcggatgggatggggaaagagagggtaaagggagtactatgcatggataatccgtttttaccttcaatttcagaggatttgcgatgtatgcgatggcgcaaatttagggtttcggggatttttcctccggtaatggcgatttgattcagcgggagtaggggcagatttaaggaggtgaaagaggttgaaattgcgcttcttttgcctccggtcttgagccttctagttgagagacgaaggagatacggaggcgagtagctggaggtgtcgcggcggcattcgttcgtcgttcgtcctcgtgcgagcgtgtgcgggcgtgtggcgcgcgcggggcggcacgagctcagcgcgaacatgcgcaagcgcggcgtgggattggcgcgaggcggcacaggctctggctcggcctggcttggcctagccgagtagagaagaagaaagaaaagaaaacgagagaaagggaaggagagggaagaagaacagagaaaggaaaaaaatatggaaaaagaaaattaaggtggaaatagagaaaaggaaaattttggggaaaattaaaatagataatatttgaattgatgtggaatttagatggtccgacattcaggatagatttaaatcggattcaaaggaattatttgagggatgatatgcactttgcaacaaaattaaacgagaaaagaacatcgaaaataaacatggaaaataatattttaaataaactattaactcgacggttatatttttagagaatcaaagcaaactaaatcggttttaaaaagttatcaaattttagggctgttacaggttaattatatttgcgatcgtaagatgcgatcgagtggataacgtcatctaggccagacggttcctctgcagtggtagcctctgggtctacggacgggcgagagattagagtgggtggtcaccgcatctcaatttaccgagcacgtacgtcttgcctctcacgcgtacaacgacactgtgagctagcgtaggatggatgtggcatcatcctcgatccgcgggcagcgatgggggtgaaccttgtaggcacttagcgatccccatgtatgcgtagagcgggcacgactcgcgaactagcatatcggccatcacgtatgtgtaaaccgtgttgtaggtagtacgctctatgtttttacgtccgaaatcccgatgtaggtgtaatgcacacacctcgggcatagtgctgttgtacgcgcgagaagtgcgtgaaggtttacgcgtacgcgcgtgaggatcgtgagttgcctacacatgtggttcacgcctgccagtggatcgtggacgtaaactaatctttcgtgcgcgtaaattaacctttcgagcgtagcatgaatgtcaggatgtgtttacacccgagatccacacgtgggcgtgtaccatatagggcaccttgagatggccgcgtaggcgtataagccttggaatttgaccttttgcagcgtaaactatcatcttgatagcgtagacagcaactggtagtgtatgggttgattccctgcttggcgtaacccttgtcgtcctcgacatataatccatattttttggtgtatgggttgattccctatttggcgtaatccaatttttcaatgttccaaggaggatgaatagtagttgtgatcctacgagagtaaccacatgatgatttacacaattacctttgagagattcaaacgtaattacctatcaatctatggggtatcaaataaagtatctaactatagttaataaatttgaaaaatgttaaggtgctatatggaatacaagtgtaagaacttgagcataattatgaaaacgtaagggttttagtagtaaaatagtatagctcagattggctattttcatatacttctgttgggccatccgctatgaattgcagtgaggcttttcagtcttttatttttaaaaaatacgatgtttacgaaccttggttgtggggatagcccataacataacattattttttaacagaacgtaatccatttatttagaccgggtctgctgtggctatgtactcgcaataagttgttgcgtaaacatgtaggaatttatgtaaacgaataaccatacacttatccggatcttctacgacgggtcatctaaactagcatattgaggtgtgtacaaaaaaactacatatataacttaacttgtattctacttctacaaacgctaaataaagcagcggcttggtaagaattaataaattctgtccatggcaggttcttctccattagcataaaccataactatattaacgtaaaccatgcgcaacgtctatcttttctggcgtgtcctacttctagcctggtaagaactaataaattccggccatggcaggtccttctccattagcgtaaaccataactgtattaacataaaccatgcgcaacatctatcttgtccggcgatggttgtgtttttgcggtgaccatatcgtccggcaggatatcctggtgtggtgctggttggagttgtttgcgtaaaccatcaggacatcatcgtaaaccatgcgcatgactgttaaaatgacgtggatacccttctgtagtgtttatgcacaatgcataaagcctttatgcggtgggaggggaaacaccctcacaggcgtcggatgtggacacgtggcgcaatgtccttagttgaccgcattgaagaatgtacgatgttaattatatattattattagaatttaaaacaattttaaaacttgcatatgttaattatatatgattttaagaatttaaaacaattttaaatctagcatatgttaattatatatcatccacataatttatttaaaattttaatctgttttaaatgttttgtcattaattttgtgattttatttcattttagtgcatcatttactattttattaaacctatatttaatgaaattaaatagacccggtgtaatgcattattatatctttagtcccggttgttaaccctagccagttcaaaaaagaatttggaaatagcgagacatttagtcccggttggtgagaacaacctggactaaatatcaaggggtatatataggcccgaggcggcggcgtcttctccaccaatacttagacgattttctgcttcgatctcggcctcatcggcttcatctctagggcatcctcgcatcgtcgccgccgacaccgccaccgccgccgtcgctacctccacctccggcggcactgccgcacgccgccgccgcttccacctccggcagtgccgccgccgccctcgccggtggcgccacgcaccactcccgctgccagtgccatcgccactgccgtcgccgccgcccatgccacctcgaacgaacgagaacgaacgtgttaacaaacaagaacgagaacgagaacgagaacgagaacgtttcgctaatgtgaatatacgttaacgaacgaacgagaacgatagaaaatgagtggaacgaacggtagaaacgatagaacgaacgaaaccaaacgagaacgatagaaaacgagtggaacgaacgtgaacaaacgatagaagcgatagaacgaacgttaacgaacaaacgagaacgatagaaaacgagtggaacgaatgtgaatgaacaatagaaacgatagaacgaacgttagcgaacgaacgagaccaaacaagaacgagaaaacgagtgaaacgaacgtgaacaaacgatagaaacgatagaacatacgttaatgaatgaacgagaacgatagaaaacgagtagaacgaacgtgaacgaacgatagaaacgatagaacgaacgagaccgaacgagaacgagaaaacgagtggaacgaacgatagaaacgataagacgtacgttaacgaacgaacgagaacaatagaaaacgagtagaacgaacgtgaatgaacgatataaacgataaaacgaacgttaacgaacgccaaaacgagacacctcgttaacgaacatagaaattacatttgtattaggataattgagactaatacatttgtttgcatttaagaaaatacgtggtccagcaccgaccgtcgtcatcgctcaagcttaagtggtagtaagccctcgaaggaaatactcaggcaagttatattaacagatttaatattgctttcaattgtaataatcatttatgtctggatacttaaggaaacgtaatacccaaatcttaatccattacatattctaaatatataaaccatcccctgtaaccagacgataaactagcgatgtgagtatatgtatatggtacccatagtatcacctgctatactcttttttactattctgtttgctatactcttttttactattctgtttgccgaacatgaatggtctggatcgtcgacatcacagcctttagctcccgaagtacgaaggtccattgcaatctgtcccggatcattttttgaagtttcgacacagctcggaaataatttaattttgaatgctttcagacaaattcaaaaattcaaatgttatgcaataaatttggtcaaaattcagtcagaatttgtcgaaaagcagttaaattttgtcaaaaaccatgataccgatggggttcaaaatttattggtcaaccataaacactggtgagaagccttgttgttaagcgtattatcaaatatattctcaaatatagtacccacagtagacgccagtgctttcacctctgcaaaaggtacgccaccaattctatctttctataaagttaaggcccactgcattctaaagcttaacatgtaaagatggcacatcatccactaacatttattagtacgtctcaaatctcatgcaagcatgctaatttattaagttttagagctttaaaatgtaagcatgttaattaaattatcatcccacataattcacgtttgtaaggcccactacattctaaagcttaacttgcaaatataccacatcattcactaacatttactacatctcaaatctcatgcaagcatgctaatttattaagttttagagctttaaaatgcaagcatgttaattaaattatcatcccacataatttacataatatttcaatatatatcttcgtcactttttataatatcctatatgcctatatagttcattctcacttaaattttagagctttaaaaaatccaagcatgttaaatcattattccacataattctcaaaatatttcaatatatctctccatcattttatataatatctatatacctatacaattcattctcacatagttaatgctatttctttcttctctcattaagccatatcacctcaattgtttttagccctcaaataattaatcaatggttggaattatctccctcattttcttctctcataaagtcacatcatattacttttaaatttggatcatcattctatatactatttaaattatggtaaaccatatcagcttatacaaacttctatcgtctagatattttacatattatttctatttcttattttcatacgaaactctcgcgacaacgcgcgggtttcacctagttttaaaactactactaccacatttttctctagttgtatgcttaggcaaaaatgcatctattatatagtaaaagtctattaaatatcctataaatgctctcaagccatcacatagcactcctccaatcgcccctacgcggctacgccgccacatggtatttaatcatctagccgtcgtttttcactaatatactgtggacccattattttctaccattagatttattcatccaaataaaaagggataaaaaagaagggcccgcatatcccacccatcccatccagtaagtatgcttgcgtacgtatgtgcacccctcatatttcctttctcttctattttcctttttagttagatggaaaaaaatattccccgcctgtccaataagtatgcatgtgtgtacttacccacatatttcttctcttgttttcctcttttagttacatagaaaaaatattttatgataacaaattttaaacaattatattatctaaatcatatagataatttttatttgcacacactattagattatttactataaaatttaaaatgaagatccaaattaactatattattgaagaaattccttattttagtcatatattctacgaactatagctcgctattgttcactaatccatgcattttaagaaaaaaatcataatatattttaaaccttccaattaataacataggtaggcaagtttcacaataacaaacctaaccaattaaaatacgctcacttcattatgttagatatagaaacaaccataatgtttaagctactttttttttaaatatttctatgccttttaaaccggtataaccattatttctaacagttaaatctatctttattaaaaaagtgtttattcatggtacatgacatttcaaaaatattattgtcctatgatacttcatagttatcgtatttctactaggttgcgtggagtctctcatccacactatataaaatgttcatagatagatcacctctcaaaatatatcaattatattaggctatataaacccatgtatttagtggagcttcatgtaccacccaatttatcttttaagagattatgataatatattatacaattaaaaacaccttatttttattttacacttaatttactttcgttgacattttttctaaagaaaataaatctatttctaaagaaaataaatctactttcttttcaaatgacaaagaagattataaataattgcttatagatattacttatatatatatatatatatgatataacataaagctaatgggataaaatattattaaacaattaattaatgctgacaaaggcaatttatgaagaaatcatgaacaatattctctggttaatacctcgcttttatcaatacgtacgcatgatggacgagctcctttctagttatattaatgtatccaaaaatgcattatattattatttggattttcttccagagattgatttcaagttttcggtaaataaaataaacaagtttggctactttttttatgtttactcccatgtttaagcacctaagaccgtcagataaccatttgtaataatatatgccgatggtagtaacgtttggtgaaacggcaagaatcgtaatgacaatgtttttacaccactcgagtttcaggcttaaatttgttttttttattaaaccaagccaggcatggtcatcggtcacatggaagtacagttcgtcaaacctatcaaagtttacagcaaatagtccaaaagacaggttagatgtcggtatgacaacaacccatcaagatcaatcagcacaatcagacaggtaacgaagaaatttggccatggcatcaagtccctattccgagcggaaagtacagattacattacacaaggatccattagacaagtggcatggctataaagtggaaaaataacacacaaaattgaggaaataaaacaaacaccttcaagccccaacagtcaaaacacaaactactccgtatgtagaatgtgcatgaaagcacaaattgacttaagcaggctattttttttctgaatgaaagcttcaagcgtaaagctagttccacacttgagttagctgcaataggaatcagttggttgtggtcatctgaaaaggatatacacaggttcatcagtgcatcactaagcaaactatcaagacttcaagagcaaacaaggattgaactccagcaatttcagagaacagcaaactagattcatcggcgaagtgataaatcgctttaaatacgcaaaggctacccatagaacaaactaataaagatatatacttgcagatgatgaaatagggagaactaggttgaacgtttcagccctaaaagcctcctaagttctgaagcatccagcattatcagattccagtagagcaggaaaccaaaagatctagagctgctgtgcaaagaagagccgaaagaggaaggataagcatggcgatagaagcaacttttttcccaacaaggaaaagggcactagatactggtgaccaagtatgtactgctaccacctaaattcctagtaccctccaccacacctgcaacaatattaatactactgctatctggcaacatacatcatcaccaccatgctcatacgcatggagcacaatcctgaaaaaaaagttattttttcttttaaaaaaagaaaaaaaaagcgctaagtcaagaagactcaagaggagaacgatggaaatccagaacagtaaagctgctcgagggtgacaaaagatgcagagctcccttcaatccaaagagggtccatgtagggttgatgcagctcctggggcatgcaagccataagcctatcccaacaacgagtactccatcattttcctatctacacacatactattagtataaattggagtagtttctttcagatctcgagctgaatgatgaacatggagtaggctaacgggatccatgacccagcagctcaatcgacccacagcaacacccctttttggaccgaaaggagctcaacgtccacaacactttccagcaacgacaagaacagctcaacataaccaaacgaataagaacaagaagccatggaagaaaaaacaagcttagcacaataggctaaccctaacgaaaagcatggaatctgcacacagatgattctgcgagaaaacgagagagaagaaagaagaagaagaaaaaccctcctacttcccccctcccatggcaccggctgcctactgccgtggatggagatgctactaggcgctggtccatgctttaaagaagaggagaagcgagagaaaaagagagagaagaggaagggggaaggggttggctcgaatcttcacaaggggttctctcgggaagcgagcagacgccagcccagccctggtctctctgactccgagcgcttcacatgcctttggctcggacgaggcggccatgcccaatgagtccatgaccaccaccaccacagcaccactccctcgacagatg

SEQ ID NO: 28002 - DNA, 9533 bp, Oryza sativa
gggggggggtgtggacttggactcagcaacaggagcgggagcgcgcggctgggaacgggaaagcgtgtttagcctccgcaccgagtagactttcttttttgtttacccggtaacagcgcatgtagctcaacagtgtttcttacctgatgggtgttgttgtcacgttgcgtcctgtgtgtctgtacgtgatctcaagatagcctctgcctacctatagaaacgaaaaacatccgcttgtcaagcattgaaattaatagtcacctctagttgttttatatgtgcaacgtattatctctatcacacttgctccagtacattatcataaatttattttattgttcactcttacggcaggtacaatagaagactataagccagctataaacacatttcaaaaagataaaagggaagagagaagagcagcgagctacatatttatagtcagctgcaatatgaactccaagatacatgtgtgtatgatagatgtaatcagatattaattatgtagtatatgtttatatgtaactattgtatgaattgcctattaaattaactatggatgatttggagctaatagttagctatactattaaacttgctcttaatctattagggcccctttgatttgcatgaaaaacataagaattttgaaagatttcattcctatagaaaaaattcctgtcaaaacctatgaaataaaagatagaatcataccatatcctttgaaaatcatatgaaatggacaaactttggaggaaacttagcaagaactccaacctcttgaaatttttcttccagcctatctctttcatctaattccaacgattttcttacgatcctatcaaatggtcatccttatatttttttatgtgttttgtaatcctttgttttgtacttgcgttccattcagaatcatgtgtttttcctattcctctatttttccattcatgtgatttaaaggggcctagtttatttttcatctcttttagagcttatgcaaaggttgtctcttacacaatggttttagtgtaattttttagttccatcttatatattataaaatgtttttgtcagggttatggataccacataactaatagtagttgactaaatctcggcaggacccaccacataccatgttttatacggaaacaatcttcgggtatagaaggagttccggataaggaaagataaatagagttctgcatggaaacgacaagtactactcggattgtatccatattgatttcactagttctacttggacaaggggacacctataggtataaatacaaagccccctaggaggagaggggacacggaacaatagatcaagacacaagatcaacatacaagccaatatacgccaagacaagccgccggatatcgacatcggagataagcctagttagtccccatacggttcctatgactaccgtcaggagggatctagcgctgtctctgatctcgtcggacacggattcgaggaggaagactactctgttgtcgactacgggatggttttatggccgccaagttgatgacagatagataggctaccccaaatattgtactggtatgattatgatgaataagagcaacgaccggcttcggccaataggattagggttattacctgacaattcaggggcccgaacctgtataaaaatcctcgtccccatctcttttactacaatctcatatattctagtaccaacgatctccatactatgcaaataccagaatcgcgacatcaaacgtcgacagttttgctttcttcaagtaagtttaatcaagtttataaaaaaatctagcaatatctacaatatcatattagttttattagatctaacaatgaatatattttcatagtatgtttatttcgtatttcaaatgttgctatgctttttaaaacttagtctaatttaaaaagtttgacttgaaaaaaaaattgaaagagtcttgtagtatgaaatcaagggagtattgtttaacatgttgcctctcggtagcctctcacgctcaatccagttttttccgttccgtgtaacaggcgaaaacaatgacaagttttcgccctcgtcatatccctctcctaccagcgcaacgaagaggatgtcacacaaaggaaggtggcggcgacgtggatctagtgaggatgttgatatgcgaggacgagatggtgacagaaggcgagcgtagggcgggatggcatggtgacaaggcgaggtggggagctgtcgcggacatgacttcctttttgcgcgggagggctgcgctatagagaggttgtttgcactagtcaccattacgggcttccttgtcgatagccggatgcgcaacggcaggaggctacgacttaggggcgcaattagtggcataggtcgtgcgatccatccctggccacaacaccctcaggcatgtctccttgcttggcctttggtggcttttgttgtcagctgcaagtccgttgctaattgtcgtttgcttgacccgaccgtagtggccatgagcacccaaagactaacatcggtgacgcctttgggcatcaaacacttccctaaaggtgatgatgtctcagcgccccttctgtcatacatgccatgagtggaatcttgtgacatcctagcccaaataggatttagcatgtgtcagccatgagagctgtgtgcgcatgtttagtaccaccttactaatttagtaagggtcggtgtgcgggcatatggtgcatgtgggctctatgtgaggtatatggcatcggcactggacgtacggacttgcattaaggccctgtttctttcagcttgggattattataatctagattattaagtcagattactataagctagattgttataatctgcagtagaatagattgttataagcggttagttgttcccttcctagattattagagcatagattattgggtttgtaagtctaaaaagggagtggggtggcatggtgggtaatttttcatccaataatctggaaaaagctcacctaaatgagcttatcatattataataagctgggctccagattataataagctacttcaataagttatctgtttctttcagcttactcccaataatctggattataataatcccaagctgaaagaaacagggcctaagaagggacatgttactggacatttgcttgtatagttgtatgcttgtgtagctataaaggttcacgaaacgaggacgaaagtgtaagtggaaaggtgtgtaagtggacccgcctatcggatgggatgtctatgcggttttggagggaaagttgtttgcaactctttgagtgaaaacctagcgatgatggtatttaagatgtcgcaagcttcctaaagacattatgttagatgttccttgatggtactgcggtttccctattagattgggttcatttggtggtggtaagatctagactaatgattgatttacaactcagataatctttgatgtttgatgccattcaccagcattgatgggagctgaattcaatgaacaaataattgaccactagttttggaaaatttgtttttctagtttaagaaagataaagtctatgtacaacttgtaagttgtttggtcgtggtaagatctagactaatgattgatttacaacttagataatctttgatatttgatgtcattcgccagcagtgattggaggtgaattcatcgacaaataattgaccactagttttggaaattttgtttttctggtttaagaaagataaggactacgtacaacttgtaagttatttggtggtggtaagctctagactaatgattgatttacaactcggataatcattgatgttcttccacttatgtttgatgccattcaccaacagtgatgggagctgaattcatcgacaaataattgatcactagttttggaaattacgtttttatggtttaagaaagataaggattgcgtacaacttgtaagctgttgctagaaacaactgttacgcacactatgatcaacaatggatagagttctctaaatactttagggtggacttcttagtggtcatcttgtttttaattaagctgtaattttgtaatttgtagtcatttatcatgttgtcgaggagtgatcctctctagcgggaggacgtgaggcccccctttgtgagttcggccaggggatagggcgcgatgatcaagagcgcatcttcgccgtggatttggctagtgtggtggatggcgatcaagagatagaccagggattatttaggttcgggccgctgggaagcgtaataccctactcctgtgtgtggattcatatttatgctattacaagagtgttaacagtgaaatttggtaatcggtaaagacgtcatcggctaagaatcattatcggctgcagcatctcggaatcagccgatgggagttatcaagtcgccaatagtcgaattcctgctatattcggttaagaaaatcaatctactaaaggaagcttatccctaagtgaccgagtttaaagaggatgcggcatgacagtttatctattaattatgaatagtttgttagtttccttttatctttaggaaagtgtgtttagtgtccgataaggactttatatttttcttttatctttaggttagtttctttcttgtccgacaaggacttgtatcaacacatgggtataaatatatacacccggggtctatgtaatctatcgctacgatcaatacaattcagcgcatcgccaccctttttacttctacttttgttttttacgttccggcggaacttggcacccaggcaattgtctcatctacatcggcgtcgttcaaggctgcatcagtacattcgacctcttggattgctctggtttggatgatatatttgcctacctatttattatatgtctctgttaatctagtcttagcatatcaatttagctctatcggctgtctctcgctttagggtttctgccggtatcggctaaatcgccttgctagattagattagcataggtatttaccaccctgaaaatcagtcatcggcttgattgtctagatattatgtttcttttcatacttagtgctgcatcagttaagtttgatctactaagtcgtgcttagaaccataatctctagcctgcttattgattgccaataagggtttcatcggggtttcagccggtgagttatctggacgttgcattggctcatgaggattgcatatacatataagttggatttagccgatgacaacaaaggtttcactgtttaatataatcttgtggatttcatgacatcggacctccatccgatgtgtgctttaaccttcggatcgatgcttatttatcatatcattgctagccgattggtttatattggattatattgttattttattacattatcatcagccgattgcctttatagcattatctacattggacatatagccgattgcttaaaccctatcgctatcggctggtatcgacatcggctattatcgactatcagctggaactactccataggcttgtcagccgattggctgttttgatctactatttgcatatcttgtcagttgcaggatcaaactgactggcacgcccgcatctcattatatttggacctgcactagagctaagcagatctcccaggccagtgtgttcgatttttcgtcaacaaagagatctcaaaccctagagaaacggttgcttgggcaacgcgcgacctgccatgccgctttaaatgcggcggaggtggttggggcgccacccataaatgcgcctggcagcgtcccttcctccgcctactcagctgcgacgtggcagccgagtgagggcctcgtggtgatgtagcccctcgggcccaaggggtgtgacaagacgccccgaggcccctatatagttacgggtgcctcttagctacttattacccgcgcgcccgacctcccatgaggggcccaggccgtgcggccacgtggctaggaggaaggaccctttcccctcagcgtgggtactccgggcccatatcaccgacacatgtgaactctataataattagttataacttgttttacttaagtaatggctggaataaattcgattatgaaaaatgaaatgaaacatgaatagtggagggttcctctgaccgttttaatgtttactgtttttatttagaatttcataaaaaaaacgatgtaatactgacatcccttaaaatataaaagaaatgctacgttttgtcggtgctgatgccacatcatcgttactaagtaatcaaaatagttacctcctactttgaatttgtaaaaaatattgtatatggtgtaaatatactgtaaatacgattgaattgctcgccattgtaatacgtatgttcgaggttttgttctaaatttctaatagttatgtttctgatattctctctattcccactctacagtcatatttaccattgtcatgcccgtgcattacaacgtgattaaaattatggagttcagtttttttttatcagtttttgggttgattttcacgtgaaaacacttttttaagtgatggtttattggttgttaatgtgggatgtacgatcgaatcataagaactaagccaaccagagaggggtgaatggttggtatacccaaaaaccgaaaacttttagcggaaaataaaagttaccctcgaattcgacggaagtcggtctgaccgagaatgatctgccgagattgatctgccggtctgactgaagcatagccgctggtctgaccggtgttgatcttccggttggaccgccctagaatccctgccgcgtctgatgtcgccgccggtttgaccgccgcttgccgccggtctgaccgccggtgagttgtaagttagaccgccgaaaaccggtgaaacacaaatcgaagaactcttaaagtagatgacgactttattgattctatctgtgtttacaaagtgcaccaacagcactatttgcaaaaatttcgactaaactcgaaaccctaactcaaaactcaactcaattgctctctaaagcgatacagggaagcctcatgctccccctctatttatacatgtggtaggcagcctaaagccacgaaccaaactcatactaagagtactaaacaccttaggaaaccctctagtacaagaaagaaactttacataaccaatcgtaccaaatttggactccttccaaattcgactccgcatcccatacgcacacaatacctccatcgtatgccatatggaatctccatcaaccacgtgcatcaactctagcctaagtatcccgcatgattatcccgcatgatctctgaccaccacggacgtcgtcttatccccaagtcgactcccggtccatcactgcaaatactctcccgagacatcgagtcacctacacatgaaataaacaaagaaactatatttcgagaccaagctatctccaacttgactcattagtagcaaacaatattattacattcgtatagtatccatctagaagccttaatcatgaaataatcacggatatccaaacaaacaacccgaaaccgaaaccgacacagcgtcggccggtcagaccgcgggctagccagtctgaccgagcaaaacacgcaggtctaaccggctaccagcgcccagtctgaccggtcacatgaaataacaaatcctgcgatcacctgtgaaatccaatcctgtccaaaaccgcttcgtgaataaattccaaatatcaaaatcaataatctccaatgcccaattgttcatcacagaataataatcaaaaacacctttgattttacaatctcccccttgatgaacacattggcaaacccatcaaaattgttttggtgtttggaaaaataaaaacaaaagtagtaaaaagcacacttcgtacaaacgtacacatcgtgctcaaaaatccaaaagaaaacttctaaaatccaaaagaaaatttcttcccctttttaaaagaaagaaattcccaattgaaccaaaaacatgctcttctcaacaactctccaaaaatccaaaaattttcacattacttcttccccttttgacaatgatttcatcaagcatatgaattacgttcattaatgttcaagtgcttagcatacatatagcatatcaagtcatgtgttgcaataaaaagaagatgaacctatctataatatacaagcatgtattaaagtataatcatgaaccaaagattttacaattaagcttgaatcaacaatcaaaattgatgatttcatatgatttataatggaacatcttaacaagcacataggttgaagaataaacactaaatacatatacctattgcatttatcactctttctcaaataacctttagcacaaaataaccaagagaatgtctttaactttttcttttcttgagcctttttgctcatatttttctcttttattccgggtacgtccctgtcgtcaagactgtttccagagattcggcacccattattttgctcacatcgaatacgtccttgtcgtcaagactatttacaaggattcggtattcatttttttcatattttttattctctttttcacaatgagcaattaaagctatttgaggaataacaagtcaataaagcatatatatagagcatttacaaatcaaaccgtatgctagcatcaacattgcatatttgcttaattcaagtagaatttaagtgtcatgcttcatctcccttaaaagcaaaatctaaatctcatgaaaagattagaataaatacaagctatgctagagacaaataaaccttcaaagtattgttagtatgcacaagaaaataccatatgcataaacaaagctctcttttctcaattttttcattgtcatattattgcttgataaaaccatgaggtacaaactccccctcaaaccatgccaaaaggatgaattatgcccaattcaccacgaagaaaagcaaagtgattagaatccaaaggtttagtgaaaatatcagcaatttgcaactttgtgtccaaaaactggaactcaacatctcccttctcaacatgatcccttagaaagtaaaaacgaatatcaatgtgcttcgtgcgtgagtgttgaacaagattcttatcaatgttaatagcactagtattatcacaaaagagaggtactttctcaaaagtaagaccataatctttcaaagtagataaaagtcaaagaatctgtgaacaacaactagcagcagcaacatattcagattcagcagttgattaaacaacactatattatttcctagaagaccatgcaatcaatgatgtaccaagaaaatgacatgttccactagtacttttcctatcaattctacaacccccaaaatcagcaccggaatatccacttaagcatatagaagatgaagtagaataccaaattccaaacttaagtgtatgattcaaatacctcattattcgcttgactgcttgacgatgtgaagcacgaggagaagcttgaaagcatgcacacaaacacacagcaaattgtatgtctggcctagaagcagttagatacaaca

SEQ ID NO: 28003 - DNA, 15163 bp, Oryza sativa
  unsure (1)..(15163): unsure at all n locations
tttgacataaacttcctcctgtataaaaccatttagaaaagcacttttcacatccatttgatacaatttaaaaccttttgaagcagcaaaagccaacaaaagtctaattgcctcaattctagcaataagagcaaaagtttcatcaaaatccaaaccctcaacttgagtaaaaccttgagcaacaagtctagctttatttctcacaatcaaaccatcctcattttgtttatttttgaaaacccacttggttccaataatattatgtccagaaggtggttcaactaaagtccaaactttgtttctctcaaaattttcaagttcttcatgcatggcgttaatccacgattcatcagttaatgcatgtgacacatctttgggttcaaaagaagcaacacatgcagaattttcacaaacatcgtgagtcgttaccttagaccttgtagtccactcacctatattaccaatgatttgttccggcggatgtcgtcgttgaaagtgcaaaggagcagcgacttctgaagttgagccacgttctgtatcagtattggtcgaagttgtaatctccggaggaccatctcgatcagcatcaacaataccggaacccgacgaacctggccggtctgaccgctcctcctgtggcggtctgaccggaggtgtgccggcggtctgaccggcctggcgcccggtctgaccggccgagccgacttcgttgttgtagtcgtcgtcgctctcgtcttcaaaactacgaccatcctccccctgaacctgtgacagtgtacctgaaatatcgggtctagtacctggactagtctcatcaaaaaaaactttgcaagtctcaacgattttgttagtctccaaaataagtacaagataaccacaagtgtgtgcggggtaaccaagaaacaatccatcggtagaatgtgcctcaaacttatccaaatttctagatttcaagataaagcacttgcaaccaaaaacacgcaaatgtgaaactttgggttgatgtccaaatcgaagttcataagaagtttttccannnnnnnnnnnnnnnnnnnnnnnnnnnnnnnnnnnnnnnagcagtgctaatagcctcagcccaaaattttctaggagttttatattcatccaacatcgttctagccatctcaaccaaaacacgagttttcctttcaacaacaccgttttgttgaggaacacgaggagaagaaaattcatgttcaagacctctttcattgcaaaattgttcaaaagaagcatttttaaactcaccaccattatcacttcgaattcttttcaaagaaccaggaaattcaagctccaatcgaagaaacaaaccacaaaagtgttggaaagcttcgtccttagttgccataaagaaaacccaagaatattgagaaaaatcatcaacaataaccaacacataccactttcctccaacagatttcactctagccggaccaacagtgtccatgtgtaatagctgtcccggtgcatccgtcatcacagaaacaataggatcatgtgaagaagcaaccatcttagcatgacgacacggtgtacaaaacaaatcaagatctttcttaagtttaggcaaaccacgaacaagatccaaaccacttaacctagtgagatgatcaaaaccaacatgtccaagtctacgatgccaaaacatcacatctttatcaaacttagcaaccaaacatgttatcacaggtgaaacaggattttcaaaatcagttttaaacactcttccatagtgagaaatattcaacacagcatcaccacaagaatcaaaaactttacttccagttttcttaaagtgaacctcaaatttttttttgactgaagtgaacctcaaaattttcatcaacaatttgtgaaaccgaaagcaaactgtactttaagtcctcaaccaaagctacattcttcaattcaaaattttgaattacctaaaccaaacctgtagcgagaacagcacttgtagaagcatcaccaaaaataattgattcagtcttggatgcctttttgagtgaggagaaccaattttattacctgtcatgtgccgcgaacaaccggaatccacgatccacacgttcttcttccttggcaccaaagcctacacacaagcagaagtcgaagcctcagtactggggttagatgataataaaaatttaggaatccagtactgagacacatgaccagaagatccaataggcatatatccacgtgcaaaaatcaattttagaattttcagaaaaattcctccgaggccggtctgaccgggggccggtctgaccgcctctgtaccgccggtctgaccggtgcccggtctgaccgacgctctgtagccggtctgaccagtcgccggtctgaccgcgggacccactgcggtctgactggtttcctcgaggnnnnnnnnnnnnnnnnnnnnctttgattttgcaaaagcaatctctctctcctttttctgtttatgagctaatctgaaacaaaaactaacaatatgtccatctttgtcacaaaaagaacaagtatatttttcacgatgattagacacattggtagcattagaagatttagcaacacaagcaacaacaggagattttgcatgcacaacattggattttgaagaagatgcactcatagtagacatgataccagcagatttatacacagttttattagtatcaggtttaaccaaaatctcaccacttctagcaccaacacctaacacaacaggaggatgtctagaattatgagcataaggattaaaacctaaaccatggttatgtgtgctaacctttgattgatccaaaatcattttgaggttcttttacgacattttctaaatttgcacaaatttcacaatctaccatgacacctttgcttttacgacatttggggcaagaaagcacttcattgttttccacaacatcttctatgtactcaacatgacctaaagcatctttcaatttcaacttattcaaattacatgttgagcaatccaaaacatcatgaggttgttttaactttttagcagaaatcatgttaaacatcaaactagcatgaaaagcaatttgctatttttgcaacaactttttagttaaaaacaactcatccaaagtgcgtgtgtgcaaagcaaaactacaagcaagagaagatctatttctcaaatcatgtgcagcattaacatctctaatttttgaaatctcattcattaaaacctcataatttgagcaatcatcatcattaggaataagagattttaatctagcaatttcagatttaagagatttaatgataaattcctgttttctatacatcttctcacacttcttattcttttcactcaaaatattattagcttcctcaaaagcacttacctcattatattcatactctgtgtcagattcaccacgcgccatgaagcaaacatcggagatgttctttcccttatcatcatctccactttcaccatctacatcacttagtggctcgaaggcggcgcaaacttcttgaaaagccttcctgagattctccagcttcctcccttgagatgaatccttcggcttgctgttgttggacttctcaccatctttgtctttgcctctcccaagcttaggacaatgcgaacgaagatgatcaattgaaccacattcaaagcaacgatttggaccacctcttttcctgttcctggcattattcatagctcgagcaattctgttagcaaccaaagccaaatcctcctcctcgatctgttcgagttgatcatcggatgtggcattaaaaacagcaagaaaagaaggcttagatgaagaagcatcaacatccaaagaagaagaagaagaaaccaaagcactcgaataagaatcaccttttcgagaaagaacattcatcttatgtgttttcaattttatataaagtgaatccaaagtcaaagtagtcatgttaacagactcctgaatagatgtaactttcatctcccaaatagacatgtcaagaccattcaaaaagtgacgagaaatctcagattgtggatagttagtatcataagaagaatcaacagatctaagatcactcaaaattttaataaacctagaaagatagtcatccaaagcttctccaggtttcatctcaaatttaatatactcctttttgaaaagatctcaatgaagttctttaatgttattagttccttgatgaaaattactcaaagcattccaaatctcatgagcagttcgaagatgagcaacacgatcataatccgaacgagaaatcccactcaaaagaatattgcgaactttgcaattttgttcaaactcagtttttaaagcaacaatattaatctctttaggaatcacataaggatgagaaacttttctccaaatatcatagtcttcagccataatataacattgcatcctactacaccaatgagaaaaatcccttccatcgaaaacatgaggcttagttgaaaacctagcgggagtagccatggcaaaaactctagatcgataaaaatccaaagaagaaaacaaggctctgataccacttgtaggatcgaatcacaagaactaagccaacaagagggggggtgaatggttggtatacccaaaaaccgaaaacttttagcggaaaataaaagttaccatcgaattcgacggaagtcggtctgaccgagattgatctgccggtctgactgaagcgtaaccgccggtctgaccggtgttgatcttccggttggaccgtcctggaatccctgccgtgcctgatgtcgctgccagtctgaccgccgcttgccgtcggtctgaccgccggcgagttgccggttagaccgccgaaaaccggtgaaacacaaatcgaagaacttttaaagtagatgacgactttattgattttatctgtgtttacaaagtgcaccaacaacactcctttcaaaaatttcgactaaactcgaaaccctaactcaaaactcaactcaattgctctctaaagctatacagggaagcctcacgctccccctctatttatacataagggtaggcagcctaaagccacgaaccaaactcatactaagagtcctaaacaccttaggaaaccctctagtacaagaaagaaactttacataaccaatcgaaccaaatttggactccttccaaattcgactacgcatcccatacacacacaatacctccatcgtatgccatatggaatctccatcaaccacgtgcatcaactctagcctaagtatcccgcatgatctctgaccaccacggacgtcgtcttatccccatgtcgactcctggtccatcaccgcaaatactctcctgagacatcgagtcacctacacatgaaataaacaaagaaaccatattccgagaccaagctatctctaacttgactcattagtagcaaataacagtattgcatacgtatagtatccatctagaagccataatcatgaaataatcacggatatccaaacaaacaactcgaaaccgaaaccgacatagcgtcggccggtcagaccgtgggctagccggtctgaccgcgcaatacacgccggtctgaccggctaccagcgcccggtctgaccggtcacatgaaataacaaatcctgcgagcacctgtgaaatccaatcatctccaaaaccgcttcgtgaataaattccaaatatcaaaatcaataatctccaatgcccaattattcatcacagaataataataaaaaacacctttgattttacatgggaaactataatggaggagaaggaggagcacgaccctgcttttaaaatactgtgatattccgacaaaaaaaaaggttgctgacatagtttgatccttttctcacctgtttctgttcctatactccagaggataatataaagtaaatatcacaatatctagcttatgttttcgggtttgtttcaaaaaaaacctatgcattgaagcaatccatttcatacaacatcgctccttgctttccattgcctgacatgggggagagacaggtcagtcactagcgctttgctatgagtaaattctctgtgtaccaatgaaaattcactcgatccctttcgtactcctgaaatttacctgatcccttctatacccctaaaattttaacttgattcctttatgtccctaccgttacattttccttcttttcactgtgacgtttggtggtgaatgtctgttatgctcttgatgattaatttaggtttgaatataagcttgaaaaaggttgaaatttttatttgagtgcacagtatatgcattttatgaaactaatgagagtaaataattagagcagaaaattttgacataaattttgaaaataaaacaaatataataaattaaaaaaaatatttgaaatattaatagggtaatgtttttttatcgggaacattcataaaaagtcatatatttgtatgaatgctactcatttttatgaatttttaaaataaaataaatacatattttttatttcattatctaaaataagttgtgtcatgatcaaggaatatttctccaaactgttttatagaaatttttctggtcgctgcatggctcctttggaagcagagtaatgatttatttttaacaatgtttctccctccctcccaaggtggaaatcaagtctcaagtaggagctaagtctaaatttaactagcagcccgtttggttggagggagtttttaatagggattgggagtttagagggatgagactattaagtgttttgtttggttgggagacatgagaattttggtgggatggggatggggaattgagaaaggaactccctcattttcaatacgtgggtaggggcaggtaattgggagggaattcctcatttactttgtctaagcaaatctcagccattcgtttttattaatgatctaatctccaactaaactccctatcaatttccatcacctctaccaaacaagatattgggattaaaaattaaattcccatcttaatctcatcatcaattcccttgtgtaaactcccaatccccttccctcgagttcccaaacaagccgtaggcttaaaaggcttaaagtacatttcagatcttttcttcaatcatggattgataacttgtaattcttttgtacagttttcctttttttatataaatgaaaattaccgtgggggcttcccccactgtttcctggtaaaaaaagaataagttgtcataaatagtgtatcgcacaacaaactcataattataatagtctaatgcataaacttttacatttttaataatgtaattcataagtttttatgttcatccaaagggtaaaatggacatatttatagaaattagatggtcaactaacggtcaactgacgggaggggcatggaagggttcaaaatcaaattttgtggtatacaaggaactaaacaaaattcagaggtataaaagggattagctaaaatttcaggggtatacaagggattttctctctcccacatacagtactatataaatacattttcatccctcctaggctcccacatataccaatacaaaattaaaataccttcacattattaaaattcaatataattattttttattttattatatttatcctctagctaacaaactccaataaatacgaccaaccggaggagctaaaaaacaaagttgttccaagatgaagggaatagtcgcttgagctacctcagcaccatttctctgaggtccggtttgagatgaagaattatttaatatattagagtaacttatgttttgaaagtttttgcacaaaagacatcatgccccattattttccgattaagacgaagattctaccacagttttagttagtatgctttccaatatgtgaaatgatgtttttcatacgaaagctttatatacagaagctgctctaaaatactaaataaatttactttccatgtttataaaagtcaattaatcgtgcaaagatgattttctcgtttaacatgttcttacttaatcatcatctttattagctgaatcttataaagataaaggttaaatacgggcacgtaacacgagaaagtcattagcatattgttaattaagtttagttattttaaacttaaaatgactttatttgacatttaaagcaacttctggatagtaaattttaacctgaaatacattgtttagtggtttaaaaggcatgctaacaaaaatctaagcaaattttgtatcttaataaaaaaaacaagacatcgttgctcatttcaacaacgacatactcccttcatcccaatagacatatcttagaataagatatgatatgttcttatgacaatacgacaatgaatccttcttgtttatatatcacatcatatcctgattatgtgttttttttaatggacggagtacgttgataatggagacattaatcacaaatcataattgattttttttaataatggaatagaacatctcagcctttgctcagaatagctacaaccaattattacaatcaagcactctagttcaaataaaaattgaaaacaccaaccaaaaataagaaataaccaatgtaagataaggattacacatttattgaagtctatttgtgaatctccatccataattggtaaaaagttacataaccgtcgtcttaagcttacgacatgcaacttttagaaactctccatcttcatcacacctttgtagttatgtccaaaaccgaagccaatatgttaccctgaaaattacctgcatatatgaaatagatggtgatttgtcaaaaaccatatcattcctactcaaccacagagcccagggctctgtatagtagaagctccaataagtataaatttgctctttttcttgtccacaccaaaagccaacgataaaaaaatataagatatgctactagaaaggtataaaccaaaagagtaatgaactgctctccatataaattttgcataatgacaatccataaaaatatattgaatagtcttatttttcatacagaaacaacatcttacactggctttccaattccgtcttgccagattgtctttagttaacacaacccctttaagcaagtaccacataaaaatcttaatcttaagcagcttcttaagcttccaaattatcttatttctctcaatatagccattattaattaaagctaggtacattgacctaaccgagaaccgtccattctgattataattccatctaaaacaattagaagagtgattcaactggatatgtacaatagaagcacacaaatcaagccaaaatataagattctgaccaactaaagctctcctaaaacaaacactaagcggaacagaacccataacattagcaattgaagaactttttcttcggacaatagcatataaagatggatacttatcttggccaagttacctaaccatttatcttccaaaatcttgtttttccccattgctcaaaatccaagaatccatatttaagaaagtactattgactttcatgagacctgcccaaaagtggaaatcaccttcaaccccattgtttggcttttctatggaataagtcaaatggcatatttgcaaacgaaaaatattttgtgacttttatatacgtgtccttagcgatgtaaaagcaaaggctgcaaaataaacttcgacgaaaaaacctcaaaaccagcttcaaatttaaggttgaaaattcaaattttggctgataagtataagcataagagaaaagatgagaccccttgtttcctatcaactttggttataaactgattataaagatattttctcttcaataaatcctgcaaaaacacttactcatttattaacttaaacaaccatttactcaaaagacatttattttgtatttccaaattatgaatcctcaaaccaccctgatctttgggcatgcaaatgatatcccatctagtaagtctgtactttttcttatgatcatccccttgccaaaagaaacgtgatctatataatcaattttttaaagaacccctttcggtatctcaaaaaagatatcataaatatagctaaacttgaaagtacagaattaatcaaaaccaatctacccccaactgacatatacatttatctttccaactattaagtttgttctcaattctttgtttaataaggccatgtttaattcccaaaacaaaaattttcacgctgtcacatcgaatatttagacacatgcttggagtattaaatgtaggaaaaaaatcaattacacagattgcatgtaaattgcgagaagaatcttttaaacctaattgcgccatgatttgataatgtggtgctacaataaacatttgctaatggcggattaattgggcttaataaattcgtttcgcagtttcttggcggaatctgtaattgttttgttattagactacatttaatacttgtgtgtccgtatatccaatatgacaactaaatccaaaaattttccccaactaaacaaggcctaactttccaatctttgttaccagcatagtaactgattatagggcctaagggcatccacaatgtgcatataaagtgggtaataaagaataaatactactactatcaggttgtatacattgtgggagtagtaagcaacaaataccaggtaatatgcttagggcatccataatgtagtacaaaaatagtccatagtgcataaactattccattcagccacctagtaaaattgtgcaactagtccatataaaagaaataacaaaaggtacccatataaaataaataatactccctccgtccaaaaaaaatgaatctaggactggatgtgacacattatagtacaacaaatttgaatagaggtatgttcagatttagggatagcaatggggcaggtcgagggcaggttgggctggaacgtccccgccccgacccccgaactctccacccagcctcggccccgagtggacatgcggggccaaatcagcccgcacccccggcccctccggggccccgctacccaaccgggcccccgcattgagtagcaactcaatccagtcatctgtgcaccgccgttgtccctctgcgcgccactgtactctgtgccatcgccgcgcctgtgtgcagccgctgtgtctgtgtctggaggggagaccgggagaggaggggaggggactatacagtgtctggaggggagaccgggagaggaggggaggggactgtacagaggccgaccgaaggggagggattgggatttggggagagcggcaaccaaagatacgggaatggggtctggggagagcggcaaccaaaggggaggggatggggagagcagcgagccggcgagatccgaactcgagagcgcttctgcttgtgatgttcggcgacttggggtggagagggagcgcgtctacggctgtgcggcggcttggggtggggaggggaggtctggttggggtagggttaaattttttttccttatatatgctgatttccatgggtttcttgggcctatgttcctataatgggccacattttaagaagtaatatacccccctcgggggcctacgggtcacccgcgggtggaatgttctccctgtcccctcacccgcaaaatgcggggccacagtcccgatggacccgcggggcagaaatgtcacccgcccccgtaggggcgggtccccacaggagacacggtcccgcgggggaaattgccatccctatgcagattcatagtactaggatgtgtcacatgcagtactaggttggttttttatgggacggagggagtattatctatctctactgctctctcttctcctaatgctacattgtatccgtatacattgtgaggattgctatagttaaagtttatttatgtggggtctcatctatatagaccacttttgcgatatacattggtgatgcccttactacctaaccataaggaataaacaaataatttctctcattcctctctcatggctagtggttgtgggacccaacttactacccactttttgttcttttaccattgtagctttaacaataactaatacccactgacgcagggcccacccttattcacaaagtaccccctccggtttcattttaattattgttttggacaagattatggtcaaacttttataattttgaccattaataactttaaaaatacttagtttaaagaaactagaacaacatactccatccgtactcgtaaaggaagtcgtttatgacaatatttaagtcaacccttgggaatataaatcatgaataactctcaaggtgttgagtttaaaaatgtaaaaattatatgaatagatttgtcttgaaaaatactttcataaaagtatacatatattatttttcaataaatatttttatagaaataagaagttaaagttgtgttttggagaccgtgtcgctgtccaaaacgacttcctttacgaatacgaagcgacttcctttacgaatatggagggagtatatagatcggtctttcaaaacactataataaaaataaacatgcatttatttattttatatattataatacaaaaataaggtcaaatatatatttttgtagaccgtatcatttttcagaatgttaattaaaatgagaccgtgtctttttccctccattccaaattgatctacatattttattggtacaccaagaccaagaaaagctattaactctctcatactatatttattctagcaacaaactcgatgcatgcatcattcctactatttcttagccaatagtaaatcaaaatattgcatgtgggttataaatacatgtgtgcatgcatgtatcaatatccatttacttcaatgcacaaataacgaatagacctaataaatgaatataaatatatagattatttagaaataaccttaaaatccaaaactacgtgtatatcaatttggaaaggagggagtaaaggagtaggaagtaataataggtgatgtcctcctagccaatgcagacatgatgcagtaaatattgagattcgctcatctgcctgcctgactgcctctgcctgcgtgccctcgcgacgctctcctcgcccgcccagaccccttgattcgctcgaattttctggtctgggaccaacttcacaccagcctttggtgcacgtcgcgcgagtgctcaccccgtgctctgcgtttcgcctcttcgtccccgtgcgtacgtgatcatcggcagcaaaacgtggggcggcggcagcaggcggcctagccgcctaggggcgcgccgagcgctgtcacggacggacgggacggaagacgggacgggctctcagatctcgcgaaccagtgcagtgtactccagtgcttactttttttactccctccgttattaagtataagtatagttttacactgttcatatttaatatatttaacgtttaactatttgtcttatttaaaaaaaatttattagtcatagttttattgttgttaaatgataaaatataaatagtactactttatatgtgacttttttaaaaaaaattataaaatttttaaataaaatagatagttaaatattggacacggatacctatgactgtatttattttaagataataattcgtctcctcgtaagatggctcagggctgcactgcacgagggagagaggacggacggaccgacggacagggcccggccgggattgcgctttgactgcctgccgggcggggctccaagagggagtggaccatctcgccgtcgtctcactttgctgtcactttgcgagggcggcgattccgacgccgatctcccagatccgctcctgtcgggggaaacgcccgcggatcaacgggctacccaccatggtggaaaaaccgaacctgggaggctgggactgatcagtgagctttcaccggttcactgcttggaccgccggttcatcggttggaccacgatttatggctaattattttttatcataattaacgctaaaactgctaaacagaatagttattcagtcctcgccaacaaatttttcttacacagttggttaggtggaaagtacaaggcatgcagctcatcaagtctgaggtttaactccccatttgctcaaggttttttttgcatatttgttttaatagttttaagacaattcaccagaaaaccagctggttcgatggttttttttcatatttgttttaatagttttaagacaattcaccagaaaaacagttgattcgatggttttttttcatatttgttttaatactattaagacaattcaacataaaaccagctggtttgatggtttttttttcatatttgttttaatagtattaaggccttgtttagttcggaaaaaaaattttaggtgtcatattagacgtttgaccggatgtcggaagaagttttcggacacgaatgaaaaaactaattttataactcgcatgtaaaccgcgagataaatttattaagcctaattaatccgtcattagcacatgtgggttactgtagcacttatggctaattatggactaattaggctcaaaggatccatcttgcgatttccatgcaaaccgtgtgattagtttttcattttatctatatttaatactccatgcatgtgtccaaagattcgatgtgatgttttagagaaaaactttttggtaactaaacaaggcctaagacaattcaggtcttttatgcaaaccaaaccgtgacatgcactggttccagttttttcatgtccaattttacaactattactaccataaactgtcagggttacggataagatatactcacccttggatatacgctataaatcgatatggtatatctgagcgtatacagacgttctctgtatgcgctaaggaaattcatcacggagtccacaaatggaaagattcctacctggataggactgggtcgtcactgtatcgtgtagggtccgatcactggtggagaaaccctttgtagtcccggttcgtaacccctctttagtcccggtttctaaaccgggagtaccaatctgggactaaagatcgctatctttagtcccgggtgaaataatcgggagtaaagatcgatctttagtcccggttggtaacaccaaccggtaacaccaaccgggactaaagatcgagctgaccttttttttttgcatggacctgttgctgcatgggttatctatctatatatatatat

SEQ ID NO: 28004 - DNA, 3646 bp, Oryza sativa
tgcatggtttatatatatatatatatatatatatatatatatatatatatatatatatataaaccatgcatatatatgtttcaacacatatatatgtatatatatatatatattatattatattatattatatgtatatacatgcataatatatatgtatttatacatatatatgttatgcaaatgcatatgtatatagatatatatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggtagtggcaatactcgcacacgtaatagccgcaaaagttagttccctgcttttgctttgcgcactacaaataaatgacaaacaacgagagatctaattaatatacacttgtatgtatttgaatcggagaaatataaatgtagagcatgtgtattcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaacattgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtattgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcatacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttctagaagatgctttcttcagcgttcgctcatagtccgatagcttgatggcctccttgacagatgcagacatacccctgaagaagttcctgacactggggtctataggaatcttcttttctagacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcttgaggtggagacggtgctggcggagcatgaggaggagacggtgcaggatcctgaggaggagatggcggagccggaggagatggtgcacgagacgccgtttgtcgcctagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgccgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgtcacctcctcttgcatgttgagttcgtagctcgatacccggaactctaggtctgcaatcttcgcctcggtatctctcttgctcctcatccgactcctgtacgtgtcgatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcaaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctctgaatctgggacaaaactctcatgatctccgcgtgcccttgttcttcggcattacaccgtactgacaggcacgt

SEQ ID NO: 28005 - DNA, 695 bp, Oryza sativa
tgtaccgcctgcgccatataataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaagggaatatgcagctcacatggtgtccgttgcatgatgtcatcaacagggcaggtggtttcgtcctgggtttgcatggcgtccatgcactgtgatcctacctgccccgttgaggcgcagctgctacgattgcctgatgggctgaccattggaggaggtatgtgcagctggggatcatgtgactgatgtgctgccatgcgttcatccaccttccgtgccacctcctcttgcatgttgagctcgtagctcgataccctatactcaagatatgcaatcttcgcctcggtatctctcttgcttctcatccgactcctgtacgtgtggatgtcctccttgaaaccaatcttccaaggaatcacccctttccctcgtgttcgtcctgaatgctcgggagtctgtaggg

SEQ ID NO: 28006 - DNA, 599 bp, Oryza sativa
attggggacagaggaagataagcaacctgaggccgcgtctccagatcgcaaacaagattatcttccaactggatgtagcacaaggaaacaggtccctgttgtcgcaagagctgcgattcagggctggactcaaagggcaggctctacctgacgcttgcctccctagaaaggataagcgtatggcaaagggcaagaataaagtttttaaagagggggatgcaaacacatatttcttccacatgaaagctaaggcgtgagtgtgtgacggcacaagttgattatcggcccttagcatgaatcatgatggtcacatggcaaggggatatattgattcggtgatgggggttgccgacaaggaaaacagagtgatggatcttcaagcactaggtttggtaacagcagatctgtctgacctagaaccgcaattcacagaagagggagtgtggagtgtaatcaaggaattatccagtaaaaaggcaccaaggccagacggtttcacaggtcttttctatatatcatgctgggccatgatcaaacgagaagtcaagctatacaatggcaacaaacacaggtgcatgaactactgtacatctgataag

SEQ ID NO: 28007 - DNA, 1301 bp, Oryza sativa
  unsure (1)..(1301): unsure at all n locations
caacataaattgccctcctctgcctcctgaacaataagaacataacaatagcggctaccactgtcactgataggctaacaggtaaccaaattttcacgggcatgtgcttggttgacgcagctgtggccatgacaggagggaggcttggcaacttggcgtagtccaggtcttgggctatgccggacaggctaaagctccagccaagaacgtagtgagacgtgtcgtcggagcccgtcgacgacgagaatccgacgtacatttggtcggagaacgccgcggagaggttcgccggcttcacggacagcagtggcctcgccggcttcggcttggtgagctggtgcagcgtgacgtcgaggcgcgcgtcgccggcgtcgtactccacccacacctgcatggcgcggcggctggtggctcaggttcctgaacgagccgccgggcgtgtagtaccccgccgtgctcgcggcgacggagtccagcccgttcacgtcgacgccgacgtggttgtcgtcgatgtcgcggaactccggcgtgtacatcgtgtcgagctccacggcgaggacgcggccgctcgccgggtcgccgttggtggcgcggttgaagaggcccaggtactcggccgcggcggcgccggagaagtcccgcgtcgaggagacggcgaacgcgatgccgtgcccggcgaggtcggtgaacgacgacataatgctgaacacgaacgtcgacgtgaaggacgggacgccgccgccgcngccgctcccgttgcggaagccgagcggccgagcgtagaacgcgtggcccttctcgccgctgccgccggttagccgcaggaggccgtcgggcgtgacggaggcggcaccgtcaagcactagctcgccgtcgccggcgccggcgaacccgttgtaggcgaactcgtcgacggcgccattggcgaccgcgagatcgagcagcaggaggagcaaaagcgttgcaacatgcatggctgcgacgacgagaacgagacgtgagacgatcgatcgagcgaggcgtttcgcgcgcttttgtgaagcgttttggcgcgctagcgtggttgaccggttgtggaaatcgcatggcgacgcgtggactgaactcacactctccgtcagagaacgagctggtatgttcagaaccaagtgaccacagtgcagcgttcgagcaaagtgtacggtagcacagcacgtttgaatttggtgtacaagagagtgcttgacggggtaaacggatcggactaatttggattacgacgagccgagcaaatcattccctgaattatggtatcgtcgtcc

SEQ ID NO: 28008 - DNA, 479 bp, Oryza sativa
ctgccggcggagctgaccgggctccgcgggctcatgcggctgtccgtcggcgccaatgccttctccggccccatcccggcgtcgttggggcggctccagttcctcacctacctcaacctctccaacaacctctccaacaacgcgttcaatggctccttcccggcggcgctcgcgcgcctccgggggctccgggtgctcgacctctacaacaacaacctcaccagcccgctccccatggaggtggtgcagatgccgctgctccgccacctgcacctcggcggcaacttcttctccggtgagatcccgccggagtacgggcggtggggccggatgcagtatctcgccgtctccgggaacgagctctccggcaaaatcccgccggagttggggaatctgacgagcctcagggagcttgacattggttactacaacagctactccggggggctcccaccggagttggggaacctgaccgagct

SEQ ID NO: 28009 - DNA, 872 bp, Oryza sativa
  unsure (1)..(872): unsure at all n locations
nnnnnnnnnnnnnnnnnnnnnnnnnnnnnnnnnnnnnnnnnnnnnnnnnnnnnnnacaatgagactaatttgctggtttatgaatacatgcccaatggaagcctgggggagctgctccatggcaagaaaggcgggcaccttcactgggacacccggtacaagatcgccattgaagctgcaaaggggctctgctaccttcaccatgattgttcccctttgatacttcaccgtgatgtcaagtcaaacaatatccttcttgactcagactttgaagcacatgtggctgactttggccttgcaaagttcttgcaggacaccggtgcatctgagtgcatgtctgccattgctggctcttatggatacattgctccaggtaaaacatcatatctcatggtatttcagttcgttctgcagtgtattgatagtattgtatttagttgcaaagtaatatttcctctggtaaaagaaatgtaagagtaattcttgaattgctgtttttagttcctcgtgctccttcatgaattgtgttgcttaataatctgacatgtctttgttcacttcaaatggactgaaccttgttggattgtatttttgtggatgtccagaatatgcatacaccctcaaggtcgatgagaagagtgatgtctacagctttggtgttgtgcttcttgagctggttactggacggaagcctgttggggagtttggagatggcgttgacatcgtccaatgggtgaggatgatgaccgactcaaacaaggaacaagtgatgaaggtcctggacccaaggctctcaacagttccacttcatgaggtcatgcacgtcttctatgtcgctttgctctgcattggggagcagagcgtgcaccgtc

SEQ ID NO: 28010 - DNA, 7044 bp, Oryza sativa
  unsure (1)..(7044): unsure at all n locations
nnnnnnnnnnnnnnnnnnnnnnnnnnnnnnnnnnnnnnntaaaagaaatgtaagagtaattcttgaattgctgtttttagttcctcgtgctccttcatgaattgtgttgcttaataatctgacatgtctttgttcacttcaaatggactgaaccttgttggattgtatttttgtggatgtccagaatatgcatacaccctcaaggtcgatgagaagagtgatgtctacagctttggtgttgtgcttcttgagctggttactggacggaagcctgttggggagtttggagatggcgttgacatcgtccaatgggtgaggatgatgaccgactcaaacaaggaacaagtgatgaaggtcctggacccaaggctctcaacagttccacttcatgaggtcatgcacgtcttctatgtcgctttgctctgcattgaggagcagagcgtgcagcgtccaacaatgcgggaggttgtacagatcctcagcgagcttccaaagctagctcccaggcaaggagaagtgctttcacacgctgtcgatggttttgcatccaatcctccagctccagttccttctgggtctgcagaagcactaactggtgatgcgaaagatcaacagcagcagcaaacaaattcagagtcaactacacctcctgatctcatcagcatatgagtaaccaagtctaaaattgctgtcaaccttttgttgcaaagttcgcaagcttcagtatcggaaacttatctaggtatggatttaggtcttggtaagtttttaggtgttctgtgctgtacatattccagtttggtgggttgtcctgttaccagtttgtttcctttggtgctgcaatgtaggattccgtagcgagtttcggtactttagagccttttatcatccatcttcaatgtaggcaatggctttctatccaatttagaatcaaaatctaagctttactgtggaaccaagtttcctttaaagcacttcctgagttcctggtcctgtgtaaacagttcaagttgggtcctttaaattgagaaacccatactagaatgccatcatggaaaagcacccttgcatggtgaacagatatgcactaaatcaagcaaagtcaaagtattctgctctttttattcttttggagctgaatgaaatcaaagaatcagagtgcttcttcctttgttctcttttgtgatgtgtatagaaagctggcacaagaatggttaacaaatgattacccttttgtggctgctttgcataacatgaagtgcactattgcaacatcagattatgtgggatcagcatatatgggggagagaagaactgtgctaaaaatccacgctttctaatgtccaaaaatttttgttagcctgtttggaacaaatatttactataatctttttgcatattgaaatctggagtagtgaaataaattctgttaggaaaatcgctcaaattccatttaaaaaaaatgcaaaatgaaatctggagattgacattcagagatcaagactctcccgagcatgactgccaagtgctggagatagtgctgcgtgaggtccatcacatgatgatgcctctctgctcccctactacaatcattcagcaccagtgcctaacctttttgaagtttctctcctgttcttgaatctagagacatttttgttgttaatccagagatataatatacctatcgaacaccacgaggtacttatattcgaatattggttcttctaaaccttttcttcttcaaatattggattgtcttgttccgaaatgaaaatcccgaaaaatcctcgcaaaagtcggtttgctcgtgaaggaatggacatggtcggctgtacctatagatttcattgtgcaatgggtgataatgctaggaggcgaaaggaccatcagatcagatcagatcagatcataaggagagtgcgacggtattgaattctgacgctgcactgctgccgtttattcggtgcagttcgatgcgtccacaagaatggtcacatcggcaacgagacgaagcagcaaatgttgcacacagtggcaacgccatgtattcacacatgcacaaatcctctagtaataactcctatcactcaagagtattaatgtattgttgctctcaactatctatttaagcaggtaaattcagtttatctgcatgtaatgtaaagtaaaagttcaggagcttacattctgtcaccagctattttgcagaaggaggtgcttctgtttctctatctgtatctgcaaaacaaaaaaaatagagattgtcagctgcgaggttaaggttgttttgcttcatcatggtaggagagaaaaacaaagaacagaaaggttccccaagaatttggtctcctttggagcaagcagcaatgctgtcattactgcaatcatgcaaagcaaacagttctccaactacagcttttggttttgtggctggctggtcgtcagagacgagcaccaatactgctaatgccagcctcagtgtctcactgatgagttactgttcaccacaccactatttaccacagtaataaacttagagtagtatgcttcagctaataaacaccccactgtgtgttgtacatttgcagagtatgttcatgcatgcaggcatgagccacaagtgtaccggtagtagaaagcatcaactcgagattcctctcatctggatccattgctggagcattttggacaagaatacaaggtcatgcaggatgcagcaaaggacttggctagctagctagcactgtagcctcatgtgcctaatgatccagccatttgtactgttttgaacaggcaaagtacacttagattctgaaactaagggaggtcactccaaatgatgctctgctaatggcactgaatccactgatcaattcccataatgtgaggcagaagcaagcctgtaattggggtggtggtccattgatgaacagagtacagagagagagagagagagagagagagagagaaagagagcttgctactgctcacatggtaggggactgggactttgagctgctgccattcttctttctctgaagaagatgtgcacttggccgaaacaagggcctacattggcactgctctagagaacagtgacagggcacgcaggagggaccatttgatgatcaatcgctcacgcatgttcttttgtttttcctttctttttttttgtttgattttcgtttcttgtctcgatcagtctctctcttctgttatgcagatgttggatcggaataataaggaacagttttgtgttcgcgtcgtgttaattgcaaggaaaatgattgctcatcatctgtggattcatggagagacaccataaaccctaggagtttcttggattcagaagtgaaaactcaaaaaggaaaaaagaaaaacgcggcaacgaaaaggacaggaaaggagaaagaaatcgaggggataatcaggagagagaaatttaccaagggaagcgcttggttttacccggattcccgagaattttcatggagagagcggctcagctccccacctccgcctccggcgccggcgccggatcgctcgccgccggcgaacctgctcgacggcagcggagagaaaaggcgagcagcagcgatcaccgttggatacaaaccgtgcggcccagatctaactgaaaaggatgtgctggctaatttactaataggaccctctattatgttgtatttccgtaaaatgcccgcttcagtttttaaaactagggtatacctcgcgcagtgataaccgcgaaattgtagggtgactgtaaccctattcaaaacggttcggtaaatcttggttggcactcgattttctcatgtcatcttgctgatctgcaacaacaggggcactgattgcttaaaatgccagcgaattttattttcccatggagaagttggtagagaagaaatgcagaggcatagttgggacacaaatgcgagttaatctaagaccggacacaagtgggacagggagaatcctatggaaatgatgatcacatcgatcagagattcagaggcgcactcacgcaccaccaaacccaacaactccctctattcacagaggacagaaaagggaaatgcagggaaaagctatagagggagagaagaatcctgcagcattttgcgtcagaaatgaagtcaactcatgctagttctccaaaaaggaaaacagtcagctcatgttttcttctcctccatcgatgtactctttgattggcccatctgatgttctgcaaaaacttcctcagaggcattctccttctgataagatactcacatgatgctcagctcaggtaacctgtctcaagcaaatcctgatactgaaattcagaaaggttatactgctctgttccgactgtttgtccaaaacctgataagagatggtctagaatttatgtgaaccttcatcagagtttggactctgtctccatgcggggcagaatcccttaatcaaataacttagacataggccccaattatatgaggccttgtgcaagcaacgcaggcacacaatcggcagcagtaaatgcaagtcaaactgttggaagcctggagcagagcaaaacaatgtgatctgctgaagagatcatcaaatccagattaggccacgacaccatgaaaataagcatgcaaaattgttcacaacaggatgttgtctagtataggatttttattccatgatcaggaaaaaaaggtttagtgcaactaaagggtaattagcatttcacggtcgttttacagaagtgattttacatgtatatgagcccggcgaaaattttacatgtatatgagcactatatataggacactctttacatgtatgcataactttgtcccttcatacacctcacttgttcatgaaatcgatgcccttctgaatgctctccatcagctctttctttgccatctccaagccagctctgtcgtgtcaaataagttaaaacacacattaagcacaccaattatttttggatggtatttgcaggcaactgcatttgaaagagaatatttagatacaactaatgtacctctcaaaatcattcaacggccccagagggagaatcttccccggctccagcacgacctaacctcacttttgttgcaaagaacggcaactcggtcacctagttgaaagaaaatgagaataatcataagatggtgttatcggttgataggaaggatgaatgtttggatggtgtaagcataccgcagatgcaacatatgaacattccacaacgccagcatcaccacgcattgctcgcaagcatgcatcaccaaattttgctgcagcaaaagcctgagatggttttctgtcagtatgcatttataactcggatactattcacaaagaataagcagccatataacctaccattgacaaagttgcagagcctgctcctgcctttgcctgaatcacaaacaaaaggaacattatatgtatgaccaaataattagaaacaccaaaactgaaaaaaagaatccccatagtttcagacatgtaatgacgtgtaactaaagtaatatgcaaataccgctatctactgttatcaacagctttcttcagtctccgttaagggcatccgttacatttgtagtgtaggagctgaaattttcttcctaaaaactcaaaaacgtttgctcatcaacacctagtaacttggcctactaaggctatggggaacgaaattatagttgaggcaatatttgacattaaataaatcacaaattcatagttatatttttttttctttctggaacctagacagagctagaaggtttgttaattgaaatcagacattttgaatcaacaggactagaacttggcatatagacattgcttctgaatataaataagaaatttgggctagattagacaactccacacaaataactacattatggtagctttatgcagatttttgtgtaaataagatgtgcacatatgcatgtactgtttgtagaaaatcaaacaaagagaatagttggggcaaaattaatcacgtgcatcaaggctaatttcagcacttcgaatatgcatgcattgtacctcaacaacttctgtgccaccattctgtatgcgtttagtcaaatagctgatttcatctggggtaaatgagcatggggggtggacctgcagagagacaggtcttggattagcaagttattatatttgcagaagttgaaatgcggataattagtgtttacatgcgctaatattgatggaataatacctgggagaggaggggtaatatagtcactccagcatgcccaccaacaactggaacattgacatcttttgggtcaattccaagtacttcagcctataagcagtagaaaaagaaaaattttatggtcaaagagcagtacacagtatttacatgtatcttaatgttatctaagagatgatatgaaaacaatttgttagaatgcataccacaaaggtgtttgcccttgctacatccagtgttgtaactccaaggagacgtttgggatcataagttccagctttcttgaaaacctctgctgcaatggggacggttgagttcactgggttgctgatcaagttcacaattgcatttggacagcacttggcaacgccttcacaaagtgagcgaacaatcccagcgtttttgttgaacaaatcatcccttgtcattcctggtttccttgggagaccagcagggataatgacaagatccattcctgtaagtgctgcctcaagctggttgggcccaaggaaaccacggacctacaagggaatttgggtacagttatttgttacatcagtatctatgcacagataaataactaatcagtaatccattcgataaataactaatcagtaatccattcgaactatctgaaaatagtggagtgcaattgtaagttgcaagtaaaaaattatcatttttttcacttctatcctttttagcttgcaggcaaatcttttctctttttttcctttttttataaatgaattaaaaatttcaataacaagaggtttacctacagtaccatttactgttgataatgattaaactga

SEQ ID NO: 28011 - DNA, 914 bp, Oryza sativa
  unsure (1)..(914): unsure at all n locations
nnnnnnnnnnnnnnnnnnnnnnnnnnnnnnnnnnnnnnnnnnnnnnnnnnnnnnnnnnnnnnnnnnnnnnnnacatgtgggtcctgagtattttattattttttcggctcgaattgccacataagcgccacgtcaatgccacgtcagatgaagaccgagttaaattagccacgtaggcgccacgtcagccaaaactgccctcaaaaccgccgagggacctaatctgcactggttttgatagttgagggactcgttgtgtctagttttccgggttgagggatgaaaattggattcgttgacaagttaagggacctcaaatgaacatattcctttagcgggcgatgaaccgaacggatgccgttccccttcctgcgggagactgagctgtctgaggttgaaaaacgaacatttccactgtctctataaggatgaagctatgaacacaaatacctatcttaaacaatgaaacttaaaaaataacctgtcttggattgaacaatgatgctatgaacacaacatagaaaacaacctatcttgaactgaacgatgtagctatgagcacaaaatagaagaaaaaaaaagagagagaaattgctttcgttgagagtcgaactcaagacctcccgcttactaaacgnnnnnnnnnnnnnnnnnnnnnnnnnnagctctttgttgcttgtctttcgtagctcaaaatctctgagtttctttcgagtttatttacttctcttgattgtatagacgtcaattgcttaatgtgtgctacgcacaagcatcttggttgctcatttgcttcagagctcaattgcttcatgcttgtcaacaacaggttgaagcttgaggcatgaagcagttgagttctatcccatttccataagagaatgatagagaagatgcttatgaaatgggaaatg

SEQ ID NO: 28012 - DNA, 774 bp, Oryza sativa
  unsure (1)..(774): unsure at all n locations
tcacgatcctcacgcgcggacgcgtaaaccttcacgcacttctcgcgcgtacaacagcactatgcccgaggtgtgtgcattacacctacatcgggatttcgggacgtaaaaacatagagcgtactacctacaacacggtttacacatacgtgatggccgatatgctagttcgcgagtcgtgcccgctctacgcatacatggggatcgctaagtgcctacaaggttcacccccatcgctgcccgcggatcgaggatgatgccacatccatcctacgctagctcacagtgtcgttgtacgcgtgagaggcaagacgtacgtgctcggtaaattgagatgcggtgaccacccactctaatctctcgcccgtccgtagacccagaggctaccactgcagaggaaccgtctggcctagatgacgttatccactcgatcgcatcttacgatcgcaaatataattaacctgtaacagccctaaaatttgataactttttaaaaccgatttagtttgctttgattctctaaaaatataaccgtcgagttaatagtttatttaaaatattattttccatgtttattttcgatgttcttttctcgtttaattttgttgcaaagtgcatatcatccctcaaataattcctttgaatccgatttaaatctatcctgaatgtcggaccatctaaattccacatcaattcaaatattatttnnnnnnnnnnnnnnnnnnnnnnnnnnnnnnnnnnnnnnnnnnnnnnnnnnnnnnnnnnnnnnnnnnn

SEQ ID NO: 28013 - DNA, 661 bp, Oryza sativa
tgtcttttggactatttgctgtaaactttgataggtttgacgaactgtacttccatgtgaccgatgaccatgcctggcttggtttaataaaaaaaacaaatttaagcctgaaactcgagtggtgtaaaaacattgtcattacgattcttgccgtttcaccaaacgttactaccatcggcatatattattacaaatggttatctgacggtcttaggtgcttaaacatgggagtaaacataaaaaaagtagccaaacttgtttattttatttaccgaaaacttgaaatcaatctctggaagaaaatccaaataataatataatgcatttttggatacattaatataactagaaaggagctcgtccatcatgcgtacgtattgataaaagcgaggtattaaccagagaatattgttcatgatttcttcataaatggcctttgtcagcattaattaattgtttaataatattttatcccattagctttatgttatatcatatatatatatatatataggtaatatctataagcaattatttataatcttctttgtcatttgaaaagaaagtagatttattttctttagaaatagatttattttctttagaaaaaatgtcaccgaaagtaatttaagtgtaaaataaaaaaaaggggttttaaatg

SEQ ID NO: 28014 - DNA, 669 bp, Oryza sativa
caatttatcttttaagagattatgataatatattatacaattaaaaacaccttatttttattttacacttaatttactttcgttgacattttttctaaagaaaataaatctatttctaaagaaaataaatctactttcttttcaaatgacaaagaagattataaataattgcttatagatattacttatatatatatatatatatgatataacataaagctaatgggataaaatattattaaacaattaattaatgctgacaaaggcaatttatgaagaaatcatgaacaatattctctggttaatacctcgcttttatcaatacgtacgcatgatggacgagctcctttctagttatattaatgtatccaaaaatgcattatattattatttggattttcttccagagattgatttcaagttttcggtaaataaaataaacaagtttggctactttttttatgtttactcccatgtttaagcacctaagaccgtcagataaccatttgtaataatatatgccgatggtagtaacgtttggtgaaacggcaagaatcgtaatgacaatgtttttacaccactcgagtttcaggcttaaatttgttttttttattaaaccaagccaggcatggtcatcggtcacatggaagtacagttcgtcaaacctat

SEQ ID NO: 28015 - DNA, 656 bp, Oryza sativa
ttgaaaatgttgctatttttttctacaaacttggtcaaacttagtcaaaaacgtcttataacctgaaacagagggagtaatagtaaaagatgacatggcgcgacgatcggcacatccaacatccaaactacttaaccctcgaaatataactactagttcaactatactgtataaactacaatctacttgcattatttctgcttcttccttggtggcaggtatccagatgaaccgtcgtcatcatcgttccagtaggcattcttgtcgggtgatgcaagcggaggggccttctcgtcggtgttccagtcatcgtctttgtcttcctcatcaccggggtcgggcaaagagtaatcgtctacaactaaccccattaattccaaatttggggaatacccagcgttggtgttgaaatcaatggggactctgttgaaatcagcgacgatgcctcgatatgaaacatgggtaccattcctcctcgctagaagatgaatcacaggatgaggatgaagaactagacaaagaacacatggcggcggccgcggcttcttgtctggttgtagagtaaatgaatggaacacctacgtacatggtgacaaccccccggaaccgccgaacaacaagcgcccctcccagcggaggcccaagccgacgagatc

SEQ ID NO: 28016 - DNA, 919 bp, Oryza sativa
  unsure (1)..(919): unsure at all n locations
gattttgcaccttttccaaaagaaaatcagcagcagcttttctttgtccaaaacaacttttgtatgaaaaactcacacagttaagtcaacaaatccttaggtcagtacagaaataacaacagccatcatccacacgacgaaagtccacaatccttagctcagcagaaaatagggttcaggagtcaggactatccagcttatcactttcacattaagtagggtaactgtatatgcttagacaactgacacttttcagcttgcggtagcaccaaccaaccaaacaatgtttttcttggagtagtgaacaacgttgagtgaattgaatctttctcatcaagcagccaaaatgcctaatccatcatttcattgtcttggggccatgccttgacacctttgaatggaattgggtgtttggaagaaacttgagtaaaaagatcttcaaaagatgcgaatgcacgcataagctgtaaccgcagttgttagtagcacagatacagcattaaccgcatcattatccaggatagtcattccagaaatcttggtgactgtagggccccgtttactgaccacctgcaaacaagcaagaaactattacatgtcaggaagctaaaatcacctgatggtgtgtggctaaaagaatcattaaatgccgaagtagattaaacttttatgattgcaaaagcttcacaagcagttttcaaactagacaaatatattaagtataatggtgaatctagtgagggtgaatctgccaccacctaccaactgatatgtgaggccataaaattggtgaatctgccagctactcccactattagctgatatgttgcgctactaaacagtgacgtgtgtagactattcattccnnnnnnnnnnnnnnnnnnnnnnnnnnnnnnnnnnnnnnnnnnnnnnnnnnnnn

SEQ ID NO: 28017 - DNA, 814 bp, Oryza sativa
cccatagtaaatttgatagtatcaataacattcttcatcgcagtatcacaatttggctccatattagactagaggccgggagtgatatcaagatggttatcttgatttctataaaagcttgctttcttttttttaaaaaaaaaaaaaacttggctccgtgttaacagtaaaccgaagaattgacagggtagagggatccaaaacggccccaagttcttagcaattgtgcagtggtgcacacgaagttaacagggccttaacctgtcagtcattcagttaagaaggtagccagactgaacaagccccagctggctgtcattgtggatatggcatttggtgcagttgcaatgtgctcgccgtgctgcagctacagctgcagcgtagcattcatcaaccagactgagagagcatgaatgaattgagcatggcaatggccgggaccattgcttgtgggttaccttaccagcttacctgagctgacatgaatggtggtctccagagtaggtgaggtgagtgacgcccaggaggttattgaatgatccggaggagatggagatcctacctgcaacaactagcagcccatgcacaacacatgcctgtgcccatcggccatgtgtcctgttgatcaatccatttatcagtgtggcaagaacaattaacatgcacatgccttgcattccagaagagagcacaaagttgatgtgaacagtggtgagtgatgctgatatctgctgaagtagtactcattttgtttcatcagtgttttgagaccgatcttggaataattctgttgatttgatgggtgcaaaggggg

SEQ ID NO: 28018 - DNA, 1107 bp, Oryza sativa
tatccccctattttgtccatctttggccataaagcacactcctcagcagcttaccacctaagattctgcacctggaggctggaacatttagagaggaattttcctgcactgctcgttcctgatcatctaagcatgttctgttgactatgtgggcactggacatgcttaagtgatagctgccaataaatcagtacagttttctctctgatacatagacacttaattatctctcaatcctcacatagctagcataagtatgttcatcatatataaagttatagataatatttgcatcaattagagaaaacctgaatttcttctgttggactgaaaattcattgccttttattttttgcaatataggtcagacattattactatcgtcttgttcgacgcatgaagaaacttcttggtcctgagttctcacttgatgcaaaaaattcaaaggacactgttgctgctatgctccgctggtaacggaatgaatgtctgcatgcaaattaatctgattagatgtggtccctactgcttgatattatttatataacatgattgcaaagggtagtgtttggcctcaaaaatttgctgagctatcttcatgatatatatccttttcctagtaggctaggaacctaggactgtagtaggtacgtgatccttttaatttacagaggacacgtctataatttactgctataatgcctagtaggttagaactatggggccttcataccaatactgtatagacaccttaacatatttactgcttctgttttagattgtcagacctgtcccataaaatggtctctgaaattttggtggcatacttcgtggttcagaatattcttctgatgaaagatatattttttatttccatgcagattgcattctagtctatgcacaagaaagatactgtctgttgtttattgtcattgcttttgatttgatctgatgttgtttcttttacattgcatggaaaactctccgatactgaatttgttctatgcaggtggtctctgcttgaaaaatttagctgcagtgcatcaaaactgcatctgaagcctcggagattcaaaacattcgtagaagcattggtgcatgaccatt

SEQ ID NO: 28019 - DNA, 1867 bp, Oryza sativa
gttctcagttttgctttgatatctgaagtttatcggcatactgtgttgtttatgatagtatgcgagcagcgtttgtttcttcaaggcgacgccagaattttctgatgggtttggttaggctggaaacctgaccagtacatgcgagatcgctcagttgggcttctcccaattaattttgggccatacccataggtaatcttgtgcttctcccttcggccagattcctcaatgttcgctgaatatgtaacagcgattcaaggacatactcagacataaactcaggccctaatcacaacctatataacaagctacatcaagtaagaagtgtagaataattggctcataaggactcgtcaacagatgcaacttcccaaatcgggtaaaggtgtaatctgatcgtcgtagaagtaggaacaatggcaccagagataatatcgttattcgtaaagtaaagaactaagattcacaaataccatcaatatctattggagaggcagcgaatcgtccattttgtttccctttttttctctctctcgcctctctatttcctccaccatgaagaacacctgacatgtgcatgccatcagcaatgccaaaccagtacgtcaatttgataccatgaattcgtgccttcatggccacatcgacgacgacatcgagcaaagcatggtgattggtgagcgtagcacgacagtacgtacgagggccctgatgccgacaccatgcatgcccttgcgggcaagcaatcagattgcagttgccgctaaattaaagaggattttcaatggtagcagcagcagcagcagcagaagagcacgcaactgcagccgtccgtcgtgcggttcatggtggctacaagttagagagagagagagagagtagagagatttaactggggcaaatgagtgacccaaggcatggggatctcatgttgcacgccgagccatccttcccagcactcgctcgtactatgtgtagttgacgaggagagctatagatcggcacacgcgaaattcgtgcgttggtccattaagaaaaatctgatcgcactctacatttctcaaagcgtttagatcacattggacggagccaaaatcatccccactgcctggttagacccaaccgcacttaatttgaccgacagaacgaaattgatttattacggtttgttctgttcaatgagaaaaaaaaaacccctcaatttgaaagctaaaatttctgacaagatcaagatgtgaagttaacacctcaccaaattttggtatagttttatgattaaaaatttgttgaatttttatatgttattccctccgttctaaaatataaaaacctataaccggatgaaacattttcgtctgtccagattcgtaatagtaggaaatgttctattcggtcgtaggttcttatattttgatttagtcttgtttagtttattgtcttatcaagaattgactatactaacatttggggcttgttcaaattgatgtcattttaaattataatatttttttaagtaaagttatcaaatatatgcatccatttagtttattacgaaactctagtaattaaataagaaatcatgctaaaacttgataatattattaaattgtctaaatttaatatgatttattttggttataatctgaacctgataacgttagtttcggcaacagatcgaacaaagctcttttaatacctactagatgagcatcgtgtattcgcgtccatatgtgccgtgtcatcaggacggataacgcacacgcatgcacgccatgttaccccgaacggatcacagaggcgtcgtgtcaaccatagcaagggcccccgtcaccactgtagcagcacacgacgctcatcgatcccggaa

SEQ ID NO: 28020 - DNA, 1404 bp, Oryza sativa
ggcggttgattgggaaggctaccattccggtggatctcaagggcgccgaggcgaaggccgcggtggtgcatagcggctggatctgtgttgggaagaagagcggcggcaagggcggctccgcggcggcggagctcagcctcaccgtgcgcgcggagcccgatccgaggttcgtgttcgagttcgacggcgagccggagtgcagcccgcaggtgctgcaggtgaggggaagcatgaagcagccgatgttcacctgcaagttcgggtgccgcagcaaaagcgacttgcggagatcggtggttcagacggagcgggacgccgccgccgccgccgggaaggagcggaaggggtggtcggtgacggtgcacgacctgtcggggtcccccgtggcgctggcgtcgatggtgacgccgttcgtggcgtcgccggggacggaccgggtgagccgctccaacccgggcgcgtggctcatcctccgccccgccggcgacgggtcgtgggagccatggggccgcctcgagtgctggcgagagcgcggcggcgcgggcgcctccaacagcctcggctaccgcttcgacctcctcctcccgggcgtcgaccacgccgtccccttggcggagtcctccatcgccgcttccaagggcggcaagttcgccatcgacctcacctcgatgcagccccagagccggggcggcacgccggggtgcagcccgcggggcagcggcgacttcagccagtggccgctcgccagctacagctaccgcggcttcgtgatgtcctcctccgtccagggcgaggggcggtgcagcaagcccacggtggaggtcggcgtcccgcacgtcggctgcgccgaggacgcggccgcgttcgtggcgctcgccgccgcggtcgacctcagcatggacgcgtgcaggctgttctcccacaagctcaggaaggagctctcccacctgcgctccgacgtgctcaggtgaccaccgctcgccgccggtgagcttcccgcggctcacgagcaaaattgtacataagtagttgagactcttttgacacgagatgttctttagttggttcgttggtgtgttagtgttagtagtggtagttcagttttggtgatcagttggttgagttttagatagatctctctctctctcttttatcccctgcgagtgtgcttgtgttcttttggattggctactttacttcaagccaatctcggtaacttcctttcagatgtctataattgggagaaatttgtgaccatatgaacctgtttcttccagaactagaaaatcgaaagctcttgcggttccgattctgatcgtgacatggaatcgacgagctcctccccatatgttacacaaacccaaaagcttcattttagagttcgtttcaggtgacaccgtacgg

SEQ ID NO: 28021 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnnnnnnnnnnnnnaaatatgtttgcaactggcttatagccttctattgtatctgctctaatcctcaccaggtgggttgtcgacatggggctcctcgcctttccatgtagcgacaaaacggtgttacctttccaccggttgacatcggtatttttttttgcatcttttgtaaaataaaattaggttgtttcggtaaaactgaagaactatcaacaggggatggatgacttcgcagtctccatatccgtaggctccgtttgttattggcttatgttgctgctcctgcccgatcttgtactcaagcaagaagaactgtcaacaggggatggatgacttcgcggtctccatatccgtaggctccgtttgttattggcttatgttgctgctcctgcccgatcttgtactcaagcaagaagaactgtcaacaggggatggatgacttcgcggtctccatatccgtaggctccgtttgttattggcttatgttgctgctcctgcgcgatcttgtactcaattgagagcgaaattacaagtcagtaaaacgagtaacatcatattcccgccaactagctttctcgccctctctccctatctagccataactactgaaagcaacgtgatttgcctacttgctcgcgacgagaaatgtccaaacggggc

SEQ ID NO: 28022 - DNA, 1233 bp, Oryza sativa
ttttaaaccactaaacaatgtatttcaggttaaaatttactatccagaagttgctttaaatgtcaaataaagtcattttaagtttaaaataactaaacttaattaacaatatgctaatgactttctcgtgttacgtgcccgtatttaacctttatctttataagattcagctaataaagatgatgattaagtaagaacatgttaaacgagaaaatcatctttgcacgattaattgacttttataaacatggaaagtaaatttatttagtattttagagcagcttctgtatataaagctttcgtatgaaaaacatcatttcacatattggaaagcatactaactaaaactgtggtagaatcttcgtcttaatcggaaaataatggggcatgatgtcttttgtgcaaaaactttcaaaacataagttactctaatatattaaataattcttcatctcaaaccggacctcagagaaatggtgctgaggtagctcaagcgactattcccttcatcttggaacaactttgttttttagctcctccggttggtcgtatttattggagtttgttagctagaggataaattaataaaataaagaatagttatattgaattttaataatgtgaaggtattttaattttgtattggtatatgtgggagcctaggaaggatgaaaatgtatttatatagtactgtatgtgggagagcagacaatacccttgatatacccactgaaaattttagactaatcgccttttatagcctctgagatttatgtgatagttgccttgatatactcacagaaattatgatatttgagacccttcacatgccacctcctcgtacagtgtgaaccgtctagtatgactcatcataatttactatagaatatgtcacattttacacctttggaatgagacataaaaacattatgacattacgattattaaataatgtaaaagtgttatgcattagcactattataattatgagtgttgttgtgcgaatacactattatatgacaacttattacttttttgtaccaggaagacagtgggggtaagctcctccacggtaattttcatttatataaaaaaaggaaaactgtacaaaagaattacaagttatcaatccatgattgaagaaaagatctgaaatgtactttaagccttttaagcctacggcttgtttgggaactcgagggaaggggattgggagtttacacaagggaattg

SEQ ID NO: 28023 - DNA, 2225 bp, Oryza sativa
  unsure (1)..(2225): unsure at all n locations
aaatctatttgaattgtcagtattttttgaatcttggagcaggctattgcacagtttcagtcgacatgagctttttaaaatctcatacttcagcaaactgaaaaataatttggagggtttcagtctaatgttgatctaatgcatttcaatggtagcaaaaccaaggtcacttgggtgcctggaggtattcacatgcctgaaatatctgtatgattttttttcttctttattctgaatgacccatcgtcccatcccaatattgttcccatgttaattatgtgtggagcttgttagtcagttaactcatttgctgtgaaatttaatcgggaggctcaacaacaacaccctgtctggtccattcccttctggtccattcccttctgcatcagctaacttgtcacatcttgttgtcgagtgattttaatatatgtgcacagaagtttgagatatgtgcaaattatgtacaaaatttaatatatgggcaaatttgtacacaactagagatatgactgtttggaccacaatgctctgtttttttttatcctaggctctaatctaattgttgtgctttgttaaacaccactgtctgaagatgattttcacttgaggaaaatcttcagtccattgtgacaaagtgactccttttctgaagaaattctttattttttgaagaaattcaagcatgcttgcagttttagcccagttacagtctatatgtattgtagttacatatgtaacttttgttatttctcactgtaactaactatagatatatagtccttgaaaatttatcaacgctacaatctctaatttgttgtatataattttatgctagattatattatctgccaagatcattttatggtgcataatgctaggtgagcatgataactgacctttcaatgttttcttgcttcttatttctctggacaaaattttgtcactttcatatctctccgattgcatatcccctgatttttcagactgtaacccatcagaccctgcatgtttatattatttgtaacataatttagaacttgttataataggggaaaatatttaatgctgctgcatgagtactgaatttttttgaagaaattcaagcatgaaagctgttatagcctagttacagttcagatgtaatgtagttacatatgtaacttttcttatttctcactgtaactgactatagatagataggtctttagatttttcaaagccgccatctctaatatatgtgctagattaaattgtctgtcaaggtcaaatatggaccataatgctaggttatcatgattatgacctttagttgtcttcttgcttcttttttcatcagacgaaattaatgttatctctttcagatctctctgattatgtatccactgttacttgagatcgaattgtaacagaacctgcatagataggttatttgtaatataatttagataatgtatattagacaaaatttttttgaagaaattcaagcatgattgtagttacatcccagttacagtcaatatgtactgtagttacatatgtaacttctgttacttctcactgtaactggagatagatagtttttcaaaaaaaaaaaaatcatgctttcatgtatacaaaattgtgctagattttatgactgacaagatcaaatttggtgcataatgctatctgtccattgttctcaccttcaagtgtcttcttgcttattaatttttctgagaaaattttgtcactttgacatctatttgactctgtattcacttttgcttgagcttctaatctatcaggcgttgcatgtttcaatcatttgtagtacaatttagaacaagtcataatagtaaaaaaatgttaatgctgttgcatgagtactgaattttttgaagaaattcaagcatgattgtagttaaagcccagttacagtcaatatgtactgtagttacatatgtaatttctgttatttctcactgtaactggatatagatatatagttctttaaaaatttatcatgctactatctctaatttgttgtatataaatttttgctagatgacattttctgacaagataaaaaatggtccataatgctaggtgagaatgattctcacctttaactgtcttcttgcttctcatttcttcagacacaattttgcttctcatttcatatccatctnnnnnnnnnnnnnnnnnnnnnnnnnnnnnnnnnnnnnnnnnnnnnnnnnnnnnnn

SEQ ID NO: 28024 - DNA, 488 bp, Oryza sativa
tagacttttgttggcttttgctgcttcaaaaggttttaaattgtatcaaatggatgtgaaaagtgcttttctaaatggttttatacaggaggaagtttatgtcaaacaaccaccaggttttgaaaatcctgatttttccaaccatgtttttaaattgtctaaagctttgtatggtttgaaacaagctcctagggcatggtatgataggcttaacaactttttgcttgcgaaaggttttataatgggaaaggttgacaaaacgctttttgttcttaagcatggtgataatcaacttttcgttcagatttatgtggatgatatcatctttggttgttcgactcacgctttggttgtagagtttgctgagactatgcgcagggaatttgcgatgagcatgatgggtgagttatcgtattttctggtattgcaaattaagcaaacacctcaaggtacttttgtgcatcaaacgaagtatacgaaggtttttt

SEQ ID NO: 28025 - DNA, 3040 bp, Oryza sativa
  unsure (1)..(3040): unsure at all n locations
nnnnnnnnnnnnnnnnnnnnnnnnnnnnnnnnnnnnnnnnnnnnnnnctccttgttcaaccccttcaagaaatgaatgactcttcgcctctgcagccatttatttccaatcacaatgtcatcctcatgtttcaatagtaggggatcatagtgatcaagatctgcccataactgttgcagctcgctagcgtactcttggactgttctcccctcttgcttcaaattctccactttgttctgagcctcaaccatcatcattacatttccctctcctgaatacatgttgctcagcgtcttccatacaactgcagcattctggatagcttctatcatcctgccaatagaaggagccaccaaggtcatcaaccaagataccacagtggaatttgtagtattccacgtcctccatgcttggctctccttatcagaaggttcttcacaactctctagtaaaaaatgatccaccccttttgctctcaacatcagttgggctctcctacaccaactcaaataatttttgctcccctccaacctcaactcatttggcatcaattctagtttcacttcagacactccagccgcattcctaggacctatcatgcccatcttcagcaaatcctctagcaaacctttcatatcacctttagtaacaagcaatgaagtatccacaacctcctttccctccccagaagacatttttttcttcccttagcttcttctttaccacattaacagagatacaacaaggaccagacttcaatcccccatggcagatcaaatattagccaaatcaactaataggagcaacaacactactcctcggtttctcaccaaaacagaacagcagcaatagcactacttctcagttttcagcacagcagcaagtactcagtttcttccccaaatcagcacagcagcagcaaatacagcagcaacagcaagccaagcgcccacttcaccttctcaagtagcagcagcaccaacacctcagcagcagcagcaacaacctgctcctctgccacacgccgtcaccagctagccctccgcacgcgtcgtcgccgttggtgctccctgccatcgacaccgtcgcttcctcactccacgtcccgccttagcagcgctgccatcctgcgccggcacagcgcctcttcctgccacggccaccaaccgtctccgccgcgtgcggccacgctggcctcgcgcgtgtgtcgtcgcgccgcgccaacctcgcctcggcccgcgccgcgccgctgcgacctcgccagctagggttcaacctccccagtcgccggcgacccgctctgataccatattgttcaatttggggaatttttctagggtttgcctactcagctcaccccttcctcatctattctattagtataacactttacagataggtccttggtacaatacatatttacaccaacaatttctgtctcctccattagttgggaatgaatagtctacacacgtcactgtttagtagcgcaacatatcagctaatagtgggagtagctggcagattcaccaattttatggcctcacatatcagttggtaggtggtggcagattcaccctcactagattcaccattatacttaatatatttgtctagtttgaaaactgcttgtgaagcttttgcaatcataaaagtttaatctacttcggcatttaatgattcttttagccacacaccatcaggtgattttagcttcctgacatgtaatagtttcttgcttgtttgcaggtggtcagtaaacggggccctacagtcaccaagatttctggaatgactatcctggataatgatgcggttaatgctgtatctgtgctactaacaactgcggttacagcttatgcgtgcattcgcatcttttgaagatctttttactcaagtttcttccaaacacccaattccattcaaaggtgtcaaggcatggccccaagacaatgaaatgatggattaggcattttggctgcttgatgagaaagattcaattcactcaacgttgttcactactccaagaaaaacattgtttggttggttggtgctaccgcaagctgaaaagtgtcagttgtctaagcatatacagttaccctacttaatgtgaaagtgataagctggatagtcctgactcctgaaccctattttctgctgagctaaggattgtggactttcgtcgtgtggatgatggctgttgttatttctgtactgacctaaggatttgttgacttagctgtgtgagtttttccatacaaagctgtttgggacaaaggaaagctgctgctgatttcctttggaaatggtgcaaatcctccattttaatgagaaataaagcatccagtgtctatgtgtctctcctacgtttttcttctggtccaaacaacccaaattttagcagtcctgtgttttatcactttacagtatatcatactcccgtgtttttacctatgtgttctgtattcctttcttccaaacagccttaagtttttctacccactatcagcagtgttttggtccatgagagctcaggaattaatctggctacagtacaaaaagagctttattactgaagagtaaattccctattatacccttgaaaacccactcaatccttctcataccttgaaatttacccaatccctcctatacccccaaattttaatttgatctcttcaatttgatctcaaatttcgggggtatagaagagatcgggtaaaattttagggtatagaaaaggtcgggtaaatttccgaaaccgcgacttaagccaccaccattcacatgcatcaccgatgcaaagtcccaagccagtgccagtggttacgtcagcggcgtgttcaatgtctccattgatgttattgttgtcattggtgggtgtctccggttcccacatcagaaacaaccttctacatacatctccttatgaggcgcacccttggctatgctgcccaattgtgctgaggcagtaggtcttcgatccttctgtgcgacggccagccagataatgttgtcatgaccgcgagcttagggggtt

SEQ ID NO: 28026 - DNA, 20679 bp, Oryza sativa
  unsure (1)..(20679): unsure at all n locations
ccccttaacgtcgctgctgccctcgtgtttctctatcaagtacgtacgcgtcattgtgggggtgtagggtcctcagtggcgtgcgccacagaggacacgcacgccgatgccatcgctgtcgtcctctaggcgggctaccgccgacaccttcattacacactggttggctagtgtagggagaaggtggctagtgcgttccacgaggcgcacgactgcctcttcctctgggtggacgtcgcaccggaccagatgcgctatgcagtggtacatatacgcaatggtgcacgtggacgacatgttgtggtgcaggttggtgggcgaggcgcacgccgtgttcaacgccggtcggggcagcctaccagagatgcacgagtacccgcttggctagcgtgatggtgctggagatggtgatgctgaggttgcggacatgctagagcgcacggtgcgcgacgtcaaggccaacacttacggctagcgtgcgctccatcaaggccaatacttatggctggctgttgtgcagcagcgcaggtggcgaagagcccaagacacgtcgactcccttaatgtaggtagatgcagttgcagtgttaattagtggtgtacggcgtaaaaggagatcaattttttgatgtgtttacaccttttttgacttgaaagttaaaatcaatcgtaactcccagccatcttttgaagtgttttccctgtactgcttattgcattgcaatgttgccacttctctttgtaacaggacataaatcttttttttttctgaaaaaaagaacggaagcctgccattagtgtaagagaaaatttcaagcaataatacagcacagaacatgataatattgtaaatttcttgattatccaactattagcacaggatggcctaatttcatagtatacgtcgtattatatcctgaacatcgatcgctattgacgaccatgttggtaatggtggataaccaaaccaaattgcacttccaccggtttactgtacccgtggtggttggataatgcagagtcacagggtgatctagaggttaattgtgttttttttatctccatctaagtaagaaaatttgaaacaaacggtctaatcttttcatttataattatacttatcagcgaaaattagaattttcaaccttaaatttggagtccatattaaggttttttcatcgaagtttatttttcagcctttgcttttagatcattacgaacacgtatataaaagttttatttgtaaatttttttcgtttgtaaatataccgtttggtttattcccggacccaataaaccatccgatggcctcctttgacgctctaaagtcatgtaatgaatatgtttttctcctacattcaagcgcgaaatgtttaaggagaaaagaaaattttgaaaatgtgtttgtttagatttattaaaaaaaagatgagtttgtttagatttattaaaaaaataaaaacatgagtttgtttagagttttgttaaatttctcaattgattcataattctttattagcatcaatagaaaatgagcttcaacttcaaattagtaaacgaaaagtttctgagttgggaaacgtctcttaatcggcttccagtaattacgggcgacttgagggggttagatgaaatttgtgtaagaaaacttgagggggaacaaattagggccctccttgcgatttcgaggttagggtcggggtcgatccgtcgcgggggaccatctctcggcatcgatcgatcgccgccggtgtcggcggcgaggggcggcgcggggatggcgagcggcaacagcggcgagccgagcacggcgccgcagccgaatcggtggtacgagctccggctgggctcctcctgccgcgacccctcccccaccgccaagttctgcacgctccgctgtacgccccccaaatccccttcctccttccctccctgatactcgtgaggcgcatatgcgtagcgcacgcggccggagcacaggttcctcttcgctggtaattctcgcgcccttcggtggtgcgatgggggggggggggatttggcgatagtatgcttttagtgatgcgtccgtgtccaattggagttctggaattcatcgagctggtggcaaagcactccctgtttagcggcgttggggtcgtgaacacggcatgatgctcttatttggacatgcgtgactcatcatcggtgcatatttgacatttgtgacttttcatcagccacaattggtgggattaccacatgtcagttgtctttgttcttctgaatatgtttcctttggttgatcaggtagcatttgctttatctctaaagtagtaaaattttggtttgttggagacagcaaaataattgttaggaagggttgaactcgcatatatatttttggggtctgtagcattgattccatggttccttggtttggtgaatcgggtgctcttggtattgtgatgcatagtttctgtgctctcttgctctccttttatatggccaacgattcactatctcataagcttttccctcttgatggttatgtgacatgtttcaatttttttttcattgggccaaaacaagtcattggtaataaaggaatcaaaattgatgctcccaaaactgattaaatagttaattttctctccctctcgtggtttgaaaaaggttaccacgatcatgtagggcatgcctgtcctgggtactcttcatgaatgaattagcataacaatttgctgaaatccaatgagtcaccacttcgttggttgctgtctagctttcccttccattttaagtccattattggattatgaagtttgaaataaccatttttcttttgcctgaaaactatttctacaaatatctctaatgtgttgatccttattcttttatattataaatacatatcaggctatgtcgtgttgaacccttttcttatatttgtgttgacagatgaatttaagccagcatcaattgataagactcaagctgggtctctgcagaagaccaaagataacagggttactgtggaattccacaacaatcagcctggcaagccaaaggtgacatttgaaggaagccaagaagagtacaaggataatgatggtgtcttgttttttgatggtgaaacctttcgtctggagcggttgcatcgggctgtcaagagattaaggcatgtccgagttccaggagagtcttcggcagccacttcggctactactggaatgggcgaatcacattcccctccattaccgaaagttggaaagtcaccggccatgagtaaacctgctgtacactcagttcctgtaagttctttcagcattttagatgccctagataaattttgatacattgttatataatttgttacgaccttaggtattggaggaaaaaaagtgataacgttgaataaccggtatgagacaatatatgatgcacactatttagactgacaaacacaaaacatttgccaagagatttttgttatctgggagactggaaccactcatatataggcccttcagtaatatttatcggtagcatattaaacaattcgggctttttggaatgttgtagaccatattacctgattgtcttcatgtagaaagtataaaacattatatatgtgccacaataaaatttcatgtttgtctaaattcaagcctagccagttcataagctcttttgaatctaacatctctcagacccgtaagcatccacaggattatgttatatttgtgatatggtaaagtgattaatatttgaatttcatagtatgttttaggttattagtatttaatggtttatgaaaacattagtctttgagcatctgattgaaaagtgaatattgttaatttttattcttcataatttatatttcagaaggccaaacattggatagtgagtagaaatttcctttacacaacttttatgccagaatacagtatggttagctctgactaccgatgaaagttttttttttttgccaaaatatggtagcaagttctgttccttttctttgaatatggaaatttgatggcttgatacaatggaccatattcaattatcctaattaacttcgtatcacatgacaattggactgggccagggattgttttcctatcatgttaatgcttttctttttatcaaagaaaactttatacagtccttgctaagttcctcgtttcagttcctggatccattaaccccaagcttttgtgacatagtatcattatccctgatggggattttgtcagggcccttgcctgttcaatgcaagtgttcggatgggagcttttgtaacatagtatcattatcatgcaactgtgccattgctactgaatatactgctatattttgggtatcaaagtgatttcagcttttagtgagctcaaagtagagatacaatctctgaacatttgatttgcatgagagatgcatccttgtcccaatctaaaatgtactttacatactttctaagacttggatataggctcataagtttgttatatttctcatatcattcccagtttactccagattatatatattgagactagattcctgaagaaagcatcctaaagtgttataagttcataaatagatttataagctgacaatgttattgatatgctgaccctgggccctgggggatattggccaacctctgtgatatcacgttgtacaattttagtggaattcttgaagtttaagaaactcttctatttaatcatcgtctgacttctgacctttgatcatcattttataggttgaggttgaacgcattgacattggtgaacctgaaaatccaggtaatgtgaccctttttttattgcaatgttgttcttaatcatgaggatcttttagtttcttaacttgctctgatactagagatgatgaatacattcgcgtaattgttgttaaaacaaaggcaaggcatttgccatgtaggttatacaccaaattctatgttcgggtcttgatgttgatgttgtagtttgcagttcttggaatggtccttgtaccatgatatcatcttgtcaaatttcatggtgctggaggaaagatatggcacaatgcaaaaacagtttaacctttctaattgccgttttgacctgttctgcaaaaaaaatatattagttcaccaaatacatgccattctacaactcagaggcgcatgtagtgatttccccctctgtaccatactgccaccattactacaatttgtagtatatttccacgatgaaaaagtagcatacagatcgaagcatacttgaacattgttctcctcgattatagaagcatgattaatacctaaaatatctaaaaatagaggtagtgatgaaaaagatgtttgcgttttctaaaagggttgttaaagattgtcaatgttgccaaattacgtgaaatgttttcttggataggatttatcgtttgttctcattttctagtttgccagttgcaggtctaagaaacaataacaggagcactacataccaacctgttaccacaaatccattttcattttcgcctgatccaaatgatcaagaggagaacctagacatacttggtgatgatgggaatggctcaccgaataacatgttctttggacaaggagcttctgttcgtgggtttgacattaacataccaaaccagcttgacataaatgatgaaattgctgatgtaaatgtcagtgatgaggctgatgagggactcaatgcaaccggggccccatgcgagctcaagtcaatgcaaaagggcagcaggatgagcaggaaacctctagctctagcgggagcagcagcaccagtagtatcagtggaagtgggagtggtagtgnaagcagcagcagtgatagtgacggcagtgatggtgattcagccagctctgggggtgacgttgatatataagtttggtgtacagagttttcttgctgtgtatgccatggttcacaattttacaccagtatcaggaggtgtaagccttgaatgtttaactcatagttcacaggtaacaaaattaagtttcttctgttgtgatcttattctgctgtaatttgtttgttctcctcttggttagtctgctatgtttcttagatctagcctggagcatagcatttgtatgaaacctttgcatgatggattttcttcccaaatatgggatatattttctcttgttttgaagtacagaacggcatatattctgatatgtagacatacatagtgtgcaccatgttgtgggttagttgtttgatggaagtatctgcccactttttgtatcgtacttgctttgctttgcaaattaactcatggagctgttattttttgacaagtaatttatcatgatttggtaacacctactccctccatttcacaatgtaagactttctagcattaaccacatacatatagatgttaataaatctaaacacataatgaatgtgggcaatgctagaaagtcttacattgtgaaacggaggaaatattattctcagtcatgtttgtgcgcatgttttaaacccgcaagttattatagtagtaaattgaaaacttgtgaacctgtggcatgaacctgtagtgatttccccctctgtaccatactaccattacaccattactacaatttgtatatttccacgatggaaaaagtagcttgcagatcgaagcatacttaaatcttcgatttagaagcatgattaatacctaaaatatctaaatatggaggtagtgatgaaaaagatatttaagttttctaaaagggttaaagattttcaatgttgccaaattacgtgaaatgttttctttggtaggatttatcctttgttctaaaaggatcatcacgtccgtccggacctggcagcgaggggttttggtctatttgccactcttccgaatgccgtattctcaaataccattcttccaaataacttttaattttaccatcgaagagagaagatttcttgctcatttgccattttccagcccatcagaagccacatcaccaaatccgaggacgaaagggtccgttttgcccctctcaatgtctttcattctcgctccttgccttgtgcttgggctccagtgaggattgccacgctgataaaccccctggcccgcgagctccagccgtctccttcaccccgctcctctgtatgcgcaagaggagaggatagctagcggtggctttgccccgtgaggacgaggtcggtgatgggtgaggcaggagtgatcaacaccagcgggtaagtggagccctcgacgatgggtcgttggtggctctagtggaagaggatatcgtggccacgacgatcgtacccctcgacagcgagccgatggtggaggtatggcactcgcggatgcttactgcaaggccatgaccctcggccgcaccctcgacgtggagctcacgtggcttcgtctgcttgtacaccttcattgacagggagcacgccggaggagagggagatgatgaaggtgagtgaaggcaaagaagaaagaaaggaggagggcaaggcggccattttgtcctcgaatttggtgacatggcttctcatgggctgaaaaatggctcacgaacaagaaatcttctttctccgatagcaaaaagtcaaagttattctagagaatggcatttgagaatacgcccttcaggacaatggcaaatagtctaaaaccccaaccgagaatgtgagaagaagaggaagagaagtcggtggcactgtggagttgggagggaaggttgccaggggagatgtcagtaagggaagggaaaaagtagttgacatgtgggcacttatgccacgctgtatatgtcgttgcatggaagggtgacaagccttgagtaattgacctggttgactactctaggtgtccatgtgcgggcatgcaagtgagcacgtgacaccatatttgagcggcaatggtgcttgagccatcaacgtgagaagcgccaatgatgctgatcggagcgatgagacagagacgggagcgggagtgggagcgggacggacctacgattggcgttggtgagcttaagacgagcacacgtactattaaagcgagaggtgcatctaaagcgagcatgcacggggtgagcatgattgacacgagcgtgtgagtctgattgctgtggcatgctggtattttttacgatcacagataaatctgcaggtgtacggataccgctgtagtatttcacctagggttattcaaagggtatcgtatttatatttttgcagggaagatgatggtgtaaagataaagtttatacatcattaatcaagctataattaattcaccatagtgtaaacaggggttagaataataaggataattggatagtgtgacacacaccaatctaaaatgtgactcccacctttcagatgaacaagtaagaattagtgtaatccgctaaggttattggactgtaaccgtagtattgatcgactagcctaatcaagtgaatcatataaatgaagtatatcctaatcataaaacacaaaactaccaaagcagtatatgaactatgaacacaagaatataaagaaggtaattctattaattcaactatagttttacaagaacagtaaagtactaaagtcatactggaatctccgagaaaaccatagaaccgaagattactctaagcctatttccactaatattgtagagaatacaatgcagatagagaaaatttctccttgagtatgtgctgtgaagtaaggaactctcctctatttatagcttctaatgacagttgcttagatcggttttggtttgggaattaggcataaccgctatcaagagtgcgggaggaggcaccacgtggaagacggtggcgaggggtacacccctggtttggccgaaccagggactccaccattcactaccgaccttgtcctgaggctgacatgtgggcccttcgattggtgcacggttgattggacacattttaagtcggtttggcctgacttgggcccatcaatccatgtgctcttacgtgattcgctagaaatgtgtttctttgcatgttggctcatttctcctttattttggtgtataatctttgcatacatgttatttctctaagacaagtgaaattatattttttattattgccatacgtaaaaaatattagttctccatttatttattatgatagttgccgtcgacattgatacttaactatcgttaacagagcgcgcatagatgggcttagggcgagcgtggacgtacggttgcgtgtgcgtgagctcgaggcgagcatgaccaacagctagggtggccacgtataggcacgagaagactagcgtgagctcagtaatgccggcgttagagtcatagagtgcgtaagagcaagtttaatagtatagccaactactagcttcaattcatctatagctaatctaataaatagcttatttatacaatagttatatactacactattaatatctggtcctacctgtcatacacacactgcgtcttggagtccgtgctacagctggctacagatctatagcccgctgctcttctctctcatcatttatcttcttaaaatatgtttgcaactggcttatagccttctattgtatctgctctaatcctcaccaggtgggttgtcgacatggggctcctcgcctttccatgtagcgacaaaacggtgttacctttccaccggttgacatcggtatttttttttgcatcttttgtaaaataaaattaggttgtttcggtaaaactgaagaactatcaacaggggatggatgacttcgcagtctccatatccgtaggctccgtttgttattggcttatgttgctgctcctgcccgatcttgtactcaagcaagaagaactgtcaacaggggatggatgacttcgcggtctccatatccgtaggctccgtttgttattggcttatgttgctgctcctgcccgatcttgtactcaagcaagaagaactgtcaacaggggatggatgacttcgcggtctccatatccgtaggctccgtttgttattggcttatgttgctgctcctgcgcgatcttgtactcaattgagagcgaaattacaagtcagtaaaacgagtaacatcatatccccgccaactagctttctcgccctctctccctatctagccataactactgaaagcaacgtgatttgcctacttgctcgcgacgagaaatggtccaaacggggcctggctgcggctccatgaccatgagtccatgatcgtcgtcgtcaggcgcggtgcgcacgcggagagtccggagagcgctacgcgtcggacgtacgacgcgagacgaaaaatcggatgcctccgcaaccgtccgatccatgcacaggtacaccagccatccattatgcatgtatcaaatgaattttaaactattttttctctcaaaatatttatccaaatcatgatccgattgcaccattaaattcgttgcaattaaatctttaaaacaagaccacacatgaatataatccgatgaaattttttttagcttattattaaattatttttaaatgttgcacgctgttgcaccaagtattggaattgtttcactaagtagatcgaaaatgttttattggacgccgtttcgccttatatgaaaataatgtttcagcgaatagcgaaaggatgttttaactcactgcaacatttgattcatacatagtgaaacatcatgagtacattaggtgaaacatttttaaattaaaaaaaaatggatggtcaaatgttgcagttgaccaacaagtaaaacatcatgttatatatatggtgaaaaaaatcagcaactggaacatttaaatattttatgaaacatggtgaagatacacgttgaaacatgttgctgtcacacatgaaacaacaagtattaactgattgaaacacatgtttttcttttatcaaaatataatcaagcgatatcttgttgtaaagatttaattaaaacgaatacaatggtgtgatcggatcttagattgaataggtaatttaagagaaaaatcattttgaagcttgctaaaatacatgcatgtatgcatgcatgaggtggagagagagtagtagtaggtagtttcaggaattttgtgaaacacacttaagacacatattgaaacatatcactatcacatatgaaatattttgttttaacggtttgaaacatacgtttttcttttgacataatataatcatgtgatatcttgttgtaaagatttaattgcaacgaatacaacggtgcgatcggttcgtagatcagataagtaatttagaagagaaaatatttaaagagaggagaaaagaatgaaaagaaacaactagatatatgcatgcatgttacagtacgacagtaccaggctgctgatcaacagcattttcttgacgtcaacagagagaaataagaaattagcaagtaaggactgagctgaccgtaggcgtccaatgtttttcatctgatcggacgttcgaagagaagcattttcgggagagtcctgcccccaaccggattagaactagtagtctagtagggatgagaaagtaattaaaattcttgcttgttacttatctccgacttggttttgaccgaactattaatttgaaaattctaactgataaaaataataataataaaataaaaatagatacaggaagaattttactattctacgaaccgttaccaaaacttaccatattataccatacctgaatctattaacttattaataataaagtaatactcccttcatccaaaagtcttgagacctactccctcaaatccaaaatagaaggcttaaccacttctaacataaagacgaagaaaaaaatttgattatctcctcgcttgaatcacatctatccacgcaagaaatgtgattggggaacttgatggtagaagatttaaaatgaaccaaatttaaaggactaagaggtgatagttaacttatgcatccatgcacgccttatgatatatgaaaaaaaaaacagttgtgctttatattttgggatggagagagtatttcttctgtcaccaataccaagagtaattaacttacccaccacgtgaccaaaccaatgaactatatacgtgcatgcaactatgacttctaggtttcggaatttatcccacaaagattataaatatgtcttaggattttggaaaaaaaccaaaaaataaagtaggtttagacttttggagagagaatagaaaaagaaaccaccatgttcattcccacgatttagaaattaccacgttattagagaaaagtaaaataaacaaaacaaacaaacaaaaaagaatacgttaattggatgaaaataagaaggaaacaacaaatgaacaactattctttttgaaacgggacgtaccaataaaaaatatgcttatgaattgtcatcgtgtatgaaaccgataacaatctcaaacagccaaggattcttttcggaaatgtgatgtagcaataaatattcatgcatgcatggttagtgtaggaaacggacaacagttctcagcaacgaaaccgtgtgaggcacctaagcaatgtaaatatgtaacagaccaatcataattagattttcatgcatgaccttagcatccaagcatgtcagtatataattaaaagtaataggaaaagaagcatagtcttacaatctaagcattctcaattaatccaaagaaaataagaaaaataaaaattcacgattaagcgaagtgagcgtaactcagctggttaggttttttttttaaccagcccaccaggattcaaatcctagatttgacgctagcgctcgcatttacgactaattattctttcaatcgtaggcaacatacccatcaatattaaggcatccgcgacgacttcatcaatcacactatacgccagcttagtattccggatgtgtttataggggtagggtatgaatgtgtgcattcgtagaggtgagtgcgtcgaaaaccctatttgctgactagtcgcgtacacccccctccgccccccccccggcgcgcggtgcaaccatgcatatggcgcacatggagagggggcacggcgggagggcgcaggagagaggcatgtggaagttttttttttcgtttttacttttttttcctttccccccttatttttctaggttttcttctcttttttttatacggacgtttacaaagatgtatgtattttttacattaaaagtgtatacatataaaaaattatatacattaagaaataaatttgggaaaatgaaattaagattaaattaaaatttaaaaatatctaattttgatagaattaaaattaactaggcaattttgacgtgttagttaaaaattcttataattcacccgttgattgaagaaaagttaactttgttacccaatctacattgaaacaataccactaactgatgatattacatcctcgaatctattctaacgtgacgacgaatttcctagagtccaaactgtgaggaacatatgatataatataaactatcatgaatatatatgatacaatatgctatctttagttggtgaagaatgtcattagaaataataaaaggatgctactaaatactaattgtccctcaagataaagatggaggaaataagacaacaaatataccataaaattatatatcctataccgtttgctttatagattgcaattaccgtatttctatataccccatatctactaatatgtgtaagtgtaattactttatctcatatttcatacaaagaactactttttataatacggtagttatggtatctcatacaaaaccctaatttgacaatattttaaaggagagatagtttataatttttatatcgtaacttgaatggatttttcactataacgggattagtcatctctaacgggcttaaagcatcatctctttcgggcaggcccctgtcactaagcaaaggtcagtgatgtgacaaaatatctcaatcgggcatccggccgtcacggatgagacatctcaatcgggccaacacaaaagcctgtcacggatgactctcatctctaacgggcctagattatagcccatcacagatgaatataatccaaaaaaaaataaattttgtttttttgttagcctcgggcctttgccctcacttgtgtgccttcccagtcggtcacccatccgaacctcacttgtgtgccttcttggtaggtcacctatccgagaattgctctaggttaacctcatagttctttggaaattggctttcgagagagaaattgtaatttgttggtatgagtattctattaatcctattaagccctgggctaggatgtcacaccctagcatcctctattcatatacattcattcacataacacaaccacattcacataacatctattttgatcacatatttcaccagtaaatccgagttaattggatcaaatatatatttagcaagtattatcataagtaggaggcaaattagacttctaggaaaaaataaatttcgaattgaattttatgatactaaatgaactcatataaaaaagctataaaaaacaaagttgtataactcattgagatctaccatttttattttggtcatttctccatccgggtttgattgaactatataaaatttgtattttaaaatataagaaattcaaatattttttcaggtagtaaatgattttaaatagagaaatcatcaacaacaaagttgtataactcatcaagatctataacttttactttggtcttttttctatataacattttttgaacagtttaaatttgaatttaaaaatatgacaacttcaagcaatattttcaaatactaaatgatttcaactgaaaaagtcatcaacaacaaagttgtataactcatcaatatctataactattattttgttcatttatctatacaacatttttttttgaacagtttgaatttgaatttgaaaatatgacaacttcaaacaacattttcaaatactaaatgatttcaactgaaaaagtcatcaacaacaaagttgtataactcatcaagatctataacttttattttggtcatttcttcatccgacaaagtgatagtaacattgtttataaaattcacatatctctcatctagttttgtaaacaataaaacatatatgtaaattttgtgaacaatgttactagcactttatcggatgaagaaatgataaatataaaagttatagatcttggtgagttatacaactttgttgttgatgactttttttagttgaaatcatttagtatatgaaaatattgtttaaagttgtcatattttcaaattcaaattcaaactgttcaagaaaacgttatatagaaaaatgacaaaaattaaacttatagatcttgatgagttatgcaactttattgttgatgacttttttagttgaaatcatttagtatatgaaaatattgtttgaagttgtcatattttcaaattcaaattcaaactgttcaaaaaaaacgttatatagaaaaatggccaaaataaaagttataagttatagatcttgatgagttatacaactttattgttgatgacttttttagtttaaatcatttagtatttgaaaatattgttttgaagtgttatattttcaaattcaaattcaaactgctcaaaaaaaatgttatatagaaaaataaccaaaataaaaataaaagttgtaaatattggtatgttatacaactttgttgttgataatttttttcatttgaaataatttagtatttaaaaaattgtttgaagttgtcatattttcaaattcaaactcaaactattaaaaaaagttatataaaaaaataacctaagtaaaagttatctctaacgggcatcaacaaaaacccaacaccgatatgagtcatcggtgacgggctttaaagtccctcatctctgacgggctcggtatctaggcccgattgaggtatgcgaggtcatctcaatcgggcctaaatatttgcccgtcacatatgagtgttatcggtgacgggctatatgtatttgggcctagagtaagtatatctataacggtgcaaatttaagtccgattgagatgactttgttctgacggtccatatagtacacgcataattgaacccgtcacagatgatagaatctgtactagtgtttatgttcatattctgacgttagttaccttgtagtttcattttcagttttctaatatatatatagtatagtacttttggttctacgtctactgttttagtggtgttttcgagttatgcaatgggtgaagatatttttgaccgttttcattgtcagaaaactatgtatttatcatttatccatattctctaataaaccaaaacgatttattagaaaataaaaattaaaatttttattggtaaaattttatatatgtgttcgcttcgatattaaaaatcaacgctaacaaaaatatgtcaaaaatatctgaaaataaacatcaaaattaagtttgggaatttaaattttagttttactttgattttggctaattattatagggtaaccaattggactctagtacgcgcgacgcgtcgcaaatcggtgcttccgaagtttctgggcccgaatttagtagtcgtggtcggcggtcgcggacgcgcggtttgggcgaccgaccgaccgacggacgtgtcgcgtcgcgctggtaatggacccgcccggtggtttcgggactctgtacaggttaagtacgtgtgtcgctgctggtcgctgccgaccattacaggactgcgtgcttagtatggccagattaacttgccgagcctcactacacgtacgcacgatataattaggatttagggtcaacactctccaacagtctattactcctactaatttgctggacgcatttcatcagtgattagattataattgtacactgcacatcttacagggagagtagtgatcacgatctctcctcatctttcagtactgctgtgacacctgtttttatcttccgtatcatatgatattttaatgggtactttcctatttagcatgcaatatattttagagtaaatttcacaaaattacataattatagaactatagattaaactcggtgtatcaaaaaatatatttaaagtcaaaattatcatataactatacattaatgatgaaatgtaacaaaacattttagtaacaactataggtttagaaccaatttaattataaaactacattttatagctctaacataacaatggtgttaggatttaaactctaaaatatgtagttctgcgattagtttaatattaaatatatagtattgtgatacattgtcttagatttgtagttttgtgataaatttgatgttaaacatgtagtttatgataaacattttaaatctatagttctatgatagtttagtcaaaatatttgaagttttgggaaatttacactatcttttaagtattcgaagatctccagtcatgctagaaaaaatacattatatgtttttttggaaaagctacaactctaagaaaatttctcttgttccgttcattgtgaatgactatcacttaatataatttacttcatttttcttgcctttctttcttcgaattttctgggtttcaaccttttttcatcgttgaaatttctgaatgttctctcggggtttctttgtttcttgcatctcttcccaccgtccccccaaaccgaatgagtttttttgccaatttagtaccgtcatgtggccctgatatttaccggtcctccttcgctgccctaggtgcaaaagatgcatgcatggttagtgttgggatacgcataggctacgatagtataaattaaaattttctatcgcgtaaaccaggaatcatgcaagtattagatcatagatcgttaccactcgacgcgctacgcaacggaagaaggcgctaagaagtcgaaggaattctcgcgaagtagcgcgcgtcgatgtagaggaagtagtcgatcgcaccggctcgaccttctcctcatgcgttctcctcgctgtattcccacaccgatcagcactacaaaccagcggtgcctctactggtatccacacgtacagggacggaacgccacgcgcaaatatgctagcacccgcgcgcggctagggttttgctcggggaggggagtgacggctagggtttctcacgtgatgcaatacctccgccggtcacaccccttacaaatatataggatccattactcgggcctccaaggcccgtaggactcctattcggatctctatccgaattaagctcatattggatctccatccaatccccttattctagcctattaagcgtgcgatactgtaggttcatgtacactccgctgtaacccgaaaagtccttttcggtccacgcatcaacagcggcctctagcagaacatattgactcaccgggcatacataaagatcatatcggctgaatctctagtgtatacttgtatgaacccctttgcctcacaatatcgattaagctcaaggctagatatgtgccatactctaatagctcaatcattcactcgaacctgttgatagattatataacttgtgatatactcctcaatcacctttggcatgccatgcacttccataatttacaacatcgaggggtccagagatatctctccataggaggggcaaatcccatcttgattattcatatctcactacatatttcatagcatacccgaaaacaacttttataactacccaattacagagtagcgtttagcagtccctaagtaagctactacacatgttgggaaccatgataatatcaggtctaaggattcaacaccaacactaaatgagattactgatgacacaacacatatggctcttgcagtgtctcatgttgggtctattcatcaacatgttcaccaacatgtgtccacattattaatttggtatctctattccatgatccatgagacatgatcatcaattagtacatgtgctgatcatctaaacatatttgttccacatatgatatttgatcagggatcctttagaaatagcaacacacaacataaagagtctcatgaaagaatcacatattcattaaccaataatgagttatctatttcaagtaacaaagtcggataaatatgtaaacatagtatgtgatacaatcatctctatgattgcctctagggtatatcactaacagttagatggatggtgtacgaacaagtgcgtaacaactcaaccaattaggttgcagtgagacgtgccagctttaaaattatagatagattagcctgttatttgtgcacttctagctagtcattctaattcaacatttgtcaagattgcggttgtaagcaaaggatctctcccagatagaaacatgtagtggtcaaaagtacacatgcacaacaagacgacatattcaatcaacaaattatagaacaaagaatcagagagtgacagcaaatcaacaaaatcgatcagatcaggtctaaggaaaagaaaaacgaatgctgatatggcgctttgagatatcagtcatgtttagttgaagtcatggccctcgatccccctaacttagggcctgtttagatcgaatgtttgatatttgatatgtatagaatattaagtatgaaaaaaaactaattacagattacgtgtaaattatgagacgaatcttttaagcctaattgctctatgatttgataatgtggtgctacagtaaatatttattagtgatggattaattaggcttaataaattcgtctcgcagtttacaggcggaatctataatttattttgttattagtctacgtttaatactttaaatgtgtatcgatatatatctgatgtgacacagtgaaacttttcacccttgaattagcagacaagaagaaaacgtgttacatgtaaaatagcagcaataaaatgagtgacccacgcgcagactagatgtggtagagcaaattgcagtgtatcgaccattcaatagctcacaaccacacgccaataacctgttggataagtcataatacaacacgcaattaatgaattaatgatgagagttacttggagaataaatattgatttagatagcttttatcagtgtgaacaagttattacatactcccttcgtttctaaatatttgacaccgttaactttttagcacatgtttgagcgttcgtcttattaaaaaaactgtgaaatatgtaaaactatatgtatacatgaaagtatatttaataataaatcaaatgataggaaaagaattaataattactttttttaataagatgaatagttaaacatgtttaaaaaagtcaacggcgtcaaatatttagaaacggagggatagtaacctgcttatttaattactgaatttatataattaattatttgttttaaaaaatccatacaatgttacagatgatatgatactactcttccatccctaaatatcttttagctatgcatctcgatgagtgtgtgtctaatgtttagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28027 - DNA, 1882 bp, Oryza sativa
atcctttgacctggccattataaatgaaatataagctggattgcactatgtacatgatataacttatatgcttggacaaccatgtttctgatttatattttagggggggaccatgtttctgaaatttatcatctggaaaaaaatcccttacattgcttactgtacactaggacctttcacaaaaatactaatgtattttccaacctttataatgatttcctacaaaaatacctattgtatactgtatactaaaatttctgagtttaacattgcagtcttccgaattgatacaagactcagagatgatacactaagtgcggcaaaggtgagtcatgtgtggcaaatatatatatatatatatatatatatatatatatatatatatatatatatatatatatatatatatagtttttgctggcagatataactctcaccattgatcaccattgagcaaaacaccacattcataagtttaacagctatttatctaaatttaatttttcaaaaaaaagttttgtttaatggctgaaactgcacagtgctactatgatctttgaaccaaataaattgtctgagtttcctaccaacaaattgatttgttcacggatttaggtggtcacgggccataataaatcattgagaataggccatataacattcagttatgtcatcacacacattctgattttgacaaaattaggcaacatagaaatcaatgtatgcaagtatccagatacctaacaccattggctgcttattgtttcgaggggttcactgcttatattttattgagcttagctatattgtatttctttaaactgcataaccatctcattgcatagcccatatctttatagcaccgtaacaataacaactacatctctacaagattactactgtgataagaaatgaaggattggcggtacataaaatgcctcaagttgcctggaacaagcaaccatttgtagatccaaacaatattgtcgttgttattgcatacagcttgtttatataacatatatatctttcagcctcaaggtggagaagtttgatctctacataaagaaatagcaatcggtgttttctgcactcaaatatgtaaataagctatagtgtgtcagatattacaatggtgttcagtatagagcacacgtgcagacaacatttttgcagtgggcttatctatgaatatttttttattcatcttttgcatggttagcatgtgctgtatgtttcattcaattcgatctagatttgtaggtacgtccaaagggggcatgtgcatgtatagtaaacatgagttgggttactaataactaaacagatgtagtgtatgtatggagaaaaatatgtttgtcagtggaccgagaattgcatttggagatataaccaataaccaaacaacaggtgtaatgaaatgggaagttcattgtatatattactattgatcccttggaaaattaagatcatagaaaaatatttttttgctaacattaaattttagaagttattaaagacaaatagtattgcaccgtagcgtttagcatgggcatattagttccttcttaattgtaaactgagcgagcagcagcggcttcgccttatgccgtagcctcgtgcaggatgaaccacagctgagaccctgtccgttatatttcctctaagggcatgtgctacattagcacaatctgtctctgggatcatcgggagattaatccattttattacaagacgaatacccttcagacaggcatgagcttcggcctcctccgcaaacctacaatgtctaatcagcttctaggaaaaacataacataaaataaattaatgattaacatatattattaaagatcatataaaaaatatggtttataatttgg

SEQ ID NO: 28028 - DNA, 2220 bp, Oryza sativa
ctttcaacttttccatcacatcaaaattttcctacacacataaactttcaattttttcttcaaacttttaattttaatcaaactttcaattttagtatggaactaaacatagccctagattagtgttcgttcagattcaattttagaagcttttttagacggatgacgtgtagtaaagcctcaaatcaactttcagaacaccagacaatataaattgctgcaatggtttgaaacccgaaatcaatttttttttagaacttaaacccgggatcaattcaatctcgttccaattaataaactgtactacattttccgtcaaattaggcgggagatattttgctctccgcatatgaagtagacgagatggtcatcgcctggcacggcacgagcgtcgccacttggcagagaggatatcattcaatatggctctctcgtccacgttaaccaatgatgccaatcagtttctctttagagcaagttcaatagtatagccaactactaactccaattcatctatagccaatctaatagctcattcatataatagttatatactacactattaatatctagtcccacctgtcatagacacaccgcgtcttagagtccgtgctacagctggctacaaatctgtagcccgctgctcttctctctcctgatttatcttcttaaaatatgtttacagctggcttataggctgttattgtacctgctattagagtttagaagaacaaaatgctgacaaatcctggtcatttcttgaccgtatgaattctagaaaaataagattagtactcccttagagcaggtactatagcaggctattagctagctgtaaacatattttaatgagataaaagatgagagagaaaagcagcgggctacagatctgtagccagctgcagcgcgaactccaagacacaatgtatgtatgacaggtgggatcatatattaatagtatattaagcaactattctatgaattggctattagattgactatagatgaattggagctagtagtgggctatattattaaacttgctcttaccgacctttgaatcgatttcagtgacgtctcgctcgatctcgtcagctttccatggcccaattttctcgacggatatatccacatcagcgtgcatacaagtgtgtcaaagctcgtgccagtctccaacacacggaagcttccggctgctggtcccggtatcttgcacttgggtccaaacgagacaacatcacacaaggaaaaataaaatcgcatcttccaatcgcctcacactgcagcggcgcgcgtggtgatctgtccatttctcatttgtcgccgccactggaaaatcagaggagacgaagacttccagcaaccatgtcaagctgactcccaagcttatatgccgcgccggcttgcacgccctctgctccacgagacgcgacgcgacgcgacgcgcgcgcgcactggggagagtgtctttcttgctgcaatggctgagaagaagggggtgggttcacttcttcccgggctcgccgtcgtcctcgttggctttgtggtcggcggcgccgggagcgacgaccggttcgtctacgccggcttcaccggcgcgccgctcgcgttggacgggacggcggccatcacggcgagcgggctgctcgagctgaccaacggcacggcgcagctcaaggcgcacgcggtgcacccggcggcgctgcgcttccacgccggcggcggcggcgacggcccggtgcgctccttctcgacgtcgttcgtgttcgggatcatcccgccttactccgacctgagcgggcatggcatcgtcttcttcgtcgggaagaacaacttcaccgccgcgctgccgagccagtacctgggcctcctcaacagcaccaacaacggcaacaccaccaaccacatcttcggcgtcgagctcgacaccatcgtcagctccgagttccaggatcctaacgacaaccacgtcggcatcgacatcaacagcctcaagtccgtcgccgtgaacaccgccggctactacgacgacaagaccggcgccttccacgacctgtccctgatcagcggcaaggccatgcaggtctgggtggactacgacggcgccaccacgcagatcagcgtgttcatggctcctctcaagatgtccaagcctacgaggccactggtgtctgccgtgtacaacctctcacaggtgctcgtcgatccggtgtacgtcgg

SEQ ID NO: 28029 - DNA, 1782 bp, Oryza sativa
agcgatggatttcaacatttgatatctccgtgttcaaattcggtatgacaactgaaaagagctaagtgctttgcaattggtacaagttcactttaggtcccttaatttttcgtcgagtttgaaattcatccctaaaaccgcaacactagatatgttgcgtccctcaacttgcaaaactagtgcaaataagatcccaaggcgatttcaactaatatggcgcctatgtggctgatgtcacgcctaccatgggacccacatgtcagtgagtgtccggttaaaaataaaaaaatgcaatgcagaccacatcatcacccatatctttcccctcttatctcccttcttcctctctcgccagctcccccgccgctcaacccgatccgactcgatcgccgatcgaccaaccggcaccaccaaaccctgtcacctcctccttcgggattccagcctccgcctctccggtgtccgaacccacccaccctgccacccgatggcgagatttcaccatcgccaacccatacctagttacaaggctcgtcgtcatggaggcattttctttgactgattagttcgaaccgagtgaatcgactagcgagtggtggactagtggacctggtggttaccacgctcaaagcaaggggcaccggagccaccttgaccctgtggataggtcatctcctacccggccaaactggtgactagtgagtttcgcatccgtgaagtattggtctctctgtgaggagaaactgcctacttttgtttagttatttttttggttgggtatacttagatcatcatgtcgatgttccgattttagtttgatttgtcagtcgatcggctctagtagtaggtctgatgcctggatgcttagcgttgctcgtttggtggtggggagtacctattggatgagttgatcgacatcgctgctaacagccttgatgtggaggtagtagtttaactaatgacgtcctagctctccgcacgggacacctgcgggaacacaacgtttttgtgtgacctggtcatgcttgctcatttcccagttccttagcccctggatgtgcgggtcgccggcatccactcccctctcggcgcctgtagcagccgtcatcctagcaaaggcagggaaagggagagagagagagagagatagagaggaggaagggatagaagaggcgaaagaaaggggatgatgatgtgggtcccgatgcaatttttcaactggacattcactgacatgtgggtcccacagttgtttcttttttttagggtaaagagagattttattaatggctgaacatagggttacattcttgattcagaagatcaaggatttctgcaggagcacttaacttccactccgcatcaattcctgaccttaacgccatttgagctaaagcgtgagctatcctatttgaatctctctttatgttgtgcacctgcacctgcaccaaacattgcattgctgctcttacttctgaaattattccaccccattctgctctggaagcgcttgttgtatttaggtcagctaccacattaccattgtctaattctataatcattggcatatgcacccactcagtagctatccgaaacccttccaaacaaagcccatgtaggcgcccactcagtaatcattgtcctacagttgtttctgactttaagtgccatgcaatgcccacgtaggcgccatgttagttgaaatcgtcgttcaaatcgtcttgtgatcttatttgcattggttttaggagttaagagatgcgtcatatgtggtattacggt

SEQ ID NO: 28030 - DNA, 556 bp, Oryza sativa
  unsure (1)..(556): unsure at all n locations
atcatgggaacatcatgcgatccccagaggcttcaagacccgagccggtacatgccgtccacaacgaacggccagctgcccatgtacagcggcagcgccgccgccgccgccgccgccgcaaggccgccgtcgtggccggagtgtcggaagccgcctccggcagcttccactgtcgggaaggtcatgcctgccaccggcgtcggcttccagtgccgcttcctctggttgatgaaccagttgctgatctgcttctggtccagccccgtcgtctgcgccagcgtcatcttctccacctcctgctcatacacacatgtacacccgagaagttcacgcattttcataagatcgagtttggtgcagaaaaatgtggttgaattgatcaaatgggaagcatatatatgcgtgcgtacggagggatagggccatttgtcgtagtgcagctcccaccagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28031 - DNA, 714 bp, Oryza sativa
tgtattacctgcccgcaaggtcaaccaacgcaagctttccacgaagaacctgactaccatattgtcctttttgttttcgcttcacagttatctccaggacagcatgtgaccttggatttaaaaaaaaaggataaatcttattaatagaatgtagtaaagatgtccagcactacgtcctacagcagctgtcttcgtagaaacaaaatctcagtgatacatcagattaagatattaagtatcctccttaaatagcagttcattaaacagatagaaatgcattgttttgctaagcaagatatcaacaaattcttcaaaagctgaatggccataacagcatctacttacagaaaggaaagaaggaaattcacaatatgtaattaccgtgaagaagttgagtttgcttctgtgctctctgtcttgcgccgactgttgcctatgttcaagagttcaagaatcttatctgctgagtgaacctaagcaaataaaagattgatcatcaaaatattcttatatgtagaggtgaatggaatgttgactaggcctatttttacgaatatgatgaggaatggcatgcaaacacagtagaccacttgctgttgttacaaagggcagaaattggttgtatgaactaatcattaaaagaaaaaagatgaataaatagctgaagaagtctgaaagggttggtatctacaagtatttcttccataaaggaca

SEQ ID NO: 28032 - DNA, 4705 bp, Oryza sativa
aacctaaccaattaaagattgatcctccaaaatattcttaaaatgtaaaggtgaaattgaaattgtttgaccttagggccctattttttacgaatatgatgaggaatggcatgcaaacacagtagaccacttgctgttgttacaaagggcagaaattggttgtatgaactaatcattaaaagaaaaaagatgaataaatagctgaagaagtctgaaagggttggtatctacaagtatttcttccagaaaggacaaaaaaaaaaccatgcagataaattaaatagtgcaacttaaaaatcatctcttccttaattggctcaatgacgagaggatattatatgcacaaaagaggttacaagcattaggatggccaaaaaaatatgaagaaaacaaaacaaaaaatgccagaattgacactattactacaaggcatttgttttctaattatcacaaaaattaaacagattagaggaagctagaaaccttaatgcttcttaaaccagcaaccattataccatgcacaggatcttcacgaagctccaggtgacctgacgatttttcaagcaaatcatagataacctggaattcagaaagcacagagttttttcacgaaagtttatatgtagtatagagaatttaaggactaatagttaacttttttaagaaactatatattgcacattacctcattgtacacttcaagatatgaacatgagacctcaaacgtatctttactgtcatccttctttaccagatcaaagattgtgcgaaagctcagaaccataagaccaggatcactatgggttccaaccattgtataagttttcccactgcacaatcacaaataacagaatatttcacattatgcatatgaagcgtaatactaataagagccatttcagcttctagatcagtattgaagtatttgtaaaacttcattattaatggacacaatgatgagcgtggattcccataaaaaggaaaaatgaacttgcccaaatagtataatagcttcaccaaggaagctccgtaaagtggctaagtcatatttttcatattatgtcatgattaaaaaaaaactaaagaagcctttcttaccaaagttcaagtttactgaaaaggtaggatggtctcagtttgttttagcatttatttaagtttcacaaaacaagaatggcaatggactaaacataatcatgattttgtttacaattggcatgaggtgaactcagcagatatagtatatatcacatatcacaaattcacaatagttttaagttaggcatctcaaaggaaaaaaacataagaggaaatcaggcaaacataatgtggttgatttgaagaaacactttcatatcataccaactgagtgtagcaagtttttcaaatgtaaaccatatctaacaatagcagcaaatgagataattcagggttcagaaatttacggcagtatgtgtgatgatagcaatatgtgcagcaggcagtatgcttgcaaacaacaaaactatccagtgagcatgtaccttccagtagaaccataagcaaagactgtcgcattaaggccttgaactacaccagcaattgtagaagatatattcttatatacatcctgcacaagtaatgtaattgcattatcaaagcacgatcttaaaatgtgatagtggagtacaagagaacatggcatttgcccccagcagttaacaagcaagcaagctggtgcatacgtgtgcgcacacaacagattctcatcttgtaattctcatacattttttcagtaatggaaatatagatactgaaaagctcccaagatcaaaaacaaaatctatcaagacttacagttttaggcaactgcagttcaagaaaacatttgtacataactgcaaaccagttagcatataattgcaaactggttagcccaattatgtataagataattaaaatttatttacagagcatatgttcatttacatgtcttcattaatcagcccaacatggtccaatgatcacacaattatttatgttttgtacatcttgtctatatgaatgtgactgacagatgtcagatatagaacataaagcattttagcgccattgaattttttttcttgttttttttttaaaaaatagggatgtatttctatgaaaaagataattatttttgtagacctgttggactacaataataagataggctatatggtagaataagttgctaccatttgatagtcagttttcttgtttccggccaggatcttgctgactacaaaatttgcagatggattttgctttaaacaggctaataaattagtacacaagcaatttggcgctcctgcgctcagcgctctcatggttgtatggtccaccaaataaacacaagacatgtgcggtaactcactaccttacataattttcagaccttaatacaataggcacaagaggtcgtgtatatctaagatggccgtggtgtcgaatactgtaactgtgtcaggaagactggttttgacagggacccagagttgcaagtattaaaggttggagcaatgaagttaatgtataagcgtgcaaagcatgcttacagtgcaggttttcctaagaagatctaggttgtagagtttaatacaacaactaaactacagtccttttcccttaaccagacgtatgtatttgttaggtagactacctaacactagtaacagtacatactggattgctccagactgaacaatagtacaaatacttcgtgttggccttttgttggtaccaacagtattgtttcaactgtacaaagcacgagaacctcctaaatttagcagttaatgatccaaagaagtaggttggggtttggcctttaggggcatcatttcctaacatgctagttatgaacaattcaggaatttccaaactgtggtgcagttccaagcacttgctgtaatcagcatatgagcccatttggtaacagacaaagcagttccagtttagagcatcacaatctatctgagcctgcataccgcattggagcacccgggcgcatacacatgatcgaagctgtatcttctctccttggtcctgttttggatgagttcaaggtagtccttggacagatcagggtccagcacaacgacattctggggggcaaaaaacatacaggcaacacattacaatcacaatctggcagaattccaactgaacaactgcacaacaaattacgcattttactactaaactagagcctgcaccttatcatcaatgacttgtatgatatgccgcgaacgccgctgctcgctgtctgtcagtggcctgcacttcacagacacctgcagagagacacatgattacacatcgaagcaacagagcaagcagcatcatcccaacaaaaaatcaagaatcgcgagaaatcactccattccatccgtttcatcgcagaaggatctattatctacctgtagcgtggacgtctgcttggaagccggagctcggatgctcggaattgccaggaaccttcgctcgagagctaccaccaaacaaaaaagatgcgggtactatctaccagaaaccaacgcaattgcgccgacgcttgatagccacgccacgcaaaggcgggaaaagggggcgaggcgcatacctaccacacaccaaaagtagcacaccgcggcggcggaaagaaagaaaaaaacacaaaagcttccacggaaaggcgccactgcaccggtgacgacttgcccgggcggccaccaaccgccgccgccaccgccgccgcccaagaaaccgcgaatgccggatcagaatgccacctgaatctccagaatccgcgcaactctctctccaagaacagacaggaaggtcggggcccccaatccacgttgctccctccacccaaattgccgggaagagggaagaacccgtcacggcccccgagacgagcagttggtgggcagcacgacacgacgaggagacgagaagattccggaggaggaggagattgggcgcgaggaggaggggagacgacgagtgggggaagtggaaggaagaacaagaagaagggtggaggtggtttaatggggtggtagaataattaattggcggcagctgtcgcgggggaagaagacgacacggaacagaagaggggtgtgtggggcccactcgcagggccgggcccaccctcaccaacggtccgtttcccttccctccctccggtacacgacgccgtacactacctccctcccatcccacacagcacacagctgcaccaaccatcatccaacatccatggcgcctctggaccatggtgataaactcctccatgcctttgccatggcgccatcctctgcctgctggcccctcacctgacattgacattggattctacacactgatcggtgaaaaatcccaaatccgtggattactcccaaaatgcaaggatcggatttaggagtggtatagaaaatcagcgtaccgttgtgccgcagccaacatcaacagtgtcataaacatctcaatgcaatggcaggctgcagcaaccatagccgcacccatttcatctgaacagctttataatatattgttttacaataaaaaaagaagcatccttaatcatggcatatgcatttttgatgtgttctttgtacggatagatgagtatggaaacacttcgatgcaatggttactgtttatttgtgcgaagaaaaatgattcttttttagacgaa

SEQ ID NO: 28033 - DNA, 4381 bp, Oryza sativa
atgtttaattagtaccttttgattgccctgcctccttaataagccctacgttaaccggttgtgaaagcagcagtaacgtgtaatcaacggaggagtacgtatttaagtttaatgttgacgtacgttggtcacgttcataactgcatgctaaattaattcctccatcaaaatagccatcatctgggatctggaagttgctcccgtggacgcaatcttgcactcatacgcatgctgatgcctgaggagcatcttttttggggacaaatccaagattaaattttaatgtcaatttctcataaatatattcataataggtataaaatcaactttgtgggggaaagtattttaaattacgaatctattggattagttttaaaacaccgcttatactttgagtttgactaattttgtgggccaccgttggaaaatactaattttgtgggtaaattatctggaagtttcgctgtttaaaaacaaacccaataagagaacacttgatactttgatgattgggtaccctatttgaagatcgatcgaatagcaccgtccagtgtactgctagctacaacctcgaatgtttgattttgtatcttgtatttccgtgctaaatctaacctgcttctggatgcaccaaacaatcattgagatttggtccggatcacgaacactattcatcttgaattttgaaacgaacacgtcaacaaaatcattaaattgcttgcacaattattttttcttttttacaaatatcattttcttgcattagtggcatcctccgtgccgcacctaacatgggcacgactttctggtggaccgatagaactgttcactttctggagatgcagtgccactggccactgccaacccgccttctgaacttgaactaaaaaaattttgaaatgtacgtgaaataattaaaaacacccaactacaaaactgactcgtttgttgtgtttgtgctttcatgtcttcaaggcatcaacacaggcaaacaataatttgacacgaagttcagaagttgaatgcacgtggagccaacaacaaccaaatgaaagcaatgtatacctcggtgaagtttttgaaacgtgtgtgtgaacaaaataaaagccccaacaacgaaaacttctggtagttatgcttaagcctcagataccggaggcattcaaatgaaaattcaaaagtcaaatggccatggagccaaaacaattcatatatatgtgcacgcacggcttggatcatacttttcaaagtaatttggcacgcatgtcagcacgtagaacaccaattggatcatggagtgcaaccattccttttgagtatttttaaacacctgcgtattgtcaaccggattttccatttgtgaagtaaccaggcctcttttctaaatacttttagtttggatgattactttgtttgcagaacgaaggaacctttaaagcaaatagttttggactggttgcaaactttgtaatcttttagtgtttttcttgtaaccttgtacgtattttctctctataatgaaattacactactaggcaaagccctgatagttttctcagtcaaaaagaaataagtggaaagatcggaaaaggaatactaaccgaaaaagagtatagtaatagaagagcggatatatatgaaccatctccatggaataggcgacatgggtacatgtgggtccataagctgtggagctcacatgtcagccacttaaagtcagaggataataagttagaggatctgcttttcatgggataacaattaaaaaactactttcattttttttgaagagataaaaaaaaactactttcattttaaaaactactttcattttgatttgttagatttacttcttctttttagaaaatctcacactaaattagaaggtgcaacaaactacactgctaccctcattagttacgtcccaaccatctttctgatgcaagcatcaattttttcatgagcagtactagtatggctatatctattatctatgaatagattaaaaatgctttgaaatgtgagaacgatattttttctaaaaaataatgaatgctagaatgataaataaactggtacgaagaggatacaacattttcgtgtattaatgtttgtttttttctacaattgcatactccctccgtctgttccgtccatttcatattataggttttgactttatctaggtcatactatcaagtttatagataaaattagtaatatctacaacaccaaattagtttcattaaatttagtattaaatatattttaataatatgtttcttttgtattaaaattatagtatatttttctacgaacttaaaaaaatttaactagaagaaaaaaatgacttataatataaaacaaatagagtaaaacacgtgacatttaactatttgtcacttttaagatgtggcaattaagaacttgccactcgctgtgtatgacatgtgagtcctcacgtgtctataatatgttagtccggtggtaaatcctttatcacaacttgtaagagtagcaagtagttaattattccatagaagacggacacaccacacctaaaactgtgaggtggtacttgatactccgtgaacaattcgtgaacatatcgatttaaaatgtacaggagtggagtaaaatgtaagtttggcttgtttggcgcagctccgcttctatttttggtggagttctctctcacaaaataaactatagatgtggagctgggtttaggcaactccacaactacactcaggacccaactcttgaatctaaattttggagttggagctcttggcttactcctcactgactcactcctccgtttaagagcaaggctaatagtatagccagttgctgactaatagtccattgcttaagccgactactagtataatagattgtctgttggctgactacaccatataatcaaatagttaattataaccagtacatatcaatgtatatgatcaagagtgaattgcatccttgtagccatttgtgccagagcatatttagagaccatatcaaccaaaatatctgtagtacaaaaattgcaaggcactattactacatgacattaactcaaatattcccaaaaataaaacttaaataccatagattaatcgataataatctattagcgggcatgagagattagcgaggggaagagggaaagcggataataggggtggatttgtgtcaatcttaccggatttttgaggccggcaaaatagtgagatgtgattttttggggcggatttgtgttaatcttaccggatttttgaggccggcaaaatagtaagatgtgatttttttggggtggatttgtgtcgggaggggaagagatcttcgcgcgcgggaagggaagagatggcgcgcatgggagaagagatggcgcgtgggcacatctacatcacgcaggaggggcggagatcgagcgagcacggctgggcattggggcagagggaagggcattttgctcggtggggtggggaaggggatcggctacggtgtgggggtccacaaatcgtgtttttttattgctgagttgggctgcaatctagcagtagcgcatgggaaagagagctatcgccgggtgatagatttgtcgttcgttctcctctctcatcaattctctcctctccacatagaaatatgatgatgtggcataattttaaagttcgtctagtcagcttttttacctgctctaaaccctgccatggccaaagcctaccgagacggtgcacggctgcacacccttcaagatacgtgcactcactcgctccgattagaataccggaaacggatacccccgttaattgccgcaaacaagcacggctcgtgtcgcgttcatgcgcgcgcgcacggagacgaagcggcggaggccccagctagcgcatacctcaatcacggggaggccacgccacggcggcaaagttgccgacgacgcggtggttggagagagagacacactttggccgtttgccgccactcgccacggatccccgtttattttactcgccgaatcatcgccacgcaggcaaagagtagtaagttcatcattgggctaatcaaccacgaatcatggctcagcggaatctagcgagcaaagcagtgtcatatccttccctttctgctgcatttctttattttttcccgccccgatgggattaatattagctgctggtgtaaggtacggatgcctccgtttcttgtcgacgattgtcgattgcatctgttcctgcagtttctgcgacggtggcagccactgctaacagagggtgttcagggtgtcacatcggttattatatagggtatcatatacgttaataaactgtgagacgaatttattaagtctaattaatttattattagcacatat

SEQ ID NO: 28034 - DNA, 1734 bp, Oryza sativa
  unsure (1)..(1734): unsure at all n locations
nnnnnnnnnnnnnnnnnnnnnnnnnnnnnnnnnnnnnnnnnnnnnnnnnnnnnnntggggaaggggatcggctacggtgtgggggtccacaaatcgtgtttttttattgctgagttgggctgcaatctagcagtagcgcatgggaaagagagctatcgccgggtgatagatttgtcgttcgttctcctctctcatcaattctctcctctccacatagaaatatgatgatgtggcataattttaaagttcgtctagtcagcttttttacctgctctaaaccctgccatggccaaagcctaccgagacggtgcacggctgcacacccttcaagatacgtgcactcactcgctccgattagaataccggaaacggatacccccgttaattgccgcaaacaagcacggctcgtgtcgcgttcatgcgcgcgcgcacggagacgaagcggcggaggccccagctagcgcatacctcaatcacggggaggccacgccacggcggcaaagttgccgacgacgcggtggttggagagaaagacacactttggccgtttgccgccactcgccacggatcccccgttattttactcgccgaatcatcgccacgcagcaaaagagtagtaagttcatcattgggctaatcaaccacgaatcatggctcaacggaaatctagcgagccaaagcagtgtcatatccttccctttctgctgcatttctttattttttcccgccccgatgggattaatattagctgctggtgtaaggtacggatgcctccgtttcttgtcgacgattgtcgattgcatctgttcctacagtttctgcgacggtgtcaggccactgctaacagagggtgttcagggtgtcacatcggttattatatagggtatcatatacgttaataaactgtgagacgaatttattaagtctaattaatttattattagcacatatttactgtatcaccacatttgtcaaatcaagtagtaattaggtgtaaaaaaatcatctcacaaattattcacaatatgtgtaattagctattttttaattttatatttaatattttatgcatgtgttttagggtgacttctaaataggcccatagcatgatggattcctcctgcgatgagatggcagcacagtattagtagtactagtaccacacaccgcgcaatgccccgtgtgtgacgaggtgctgtgcccatgtcggtggcagtaatagtagcggtatgccggtacgaagtacgaactggccagctgggttctcacaattgttttgctcttttgctgaaacacagacatagtgcacggagggtagaattgagttcactccattagtgtctgcaggctacatgatcccaagaaatggccgtgccaagcctacaaatcgattcatcccgagtccccgaccatgtgactacgggagatgggctgcaggtgccggtgacgaatgagctcgtggcggcgcagggaacaggagcaggacaagatcttcctggacgcgtaaacaatggagcacttggagagaggggatcatgctacaagtactagcgagaagagatgccgcgtccaccgtctggcgaagatcgcgtctggattgctgccactggcagcatcacaaacccattatttttgctgccgtactacgtgcaggcaggcagcacggcgggcgatctcatctcgtgaggttggcgcaccgggtcgatcacccaccggcacaaattaaaccgactc

SEQ ID NO: 28035 - DNA, 3396 bp, Oryza sativa
caaaaaaaaagttagtgcatgagtactgaattttttttaaaaaaaaatcaaaggatgattccatttataacccagttactgttcaaatgtactgtagttacatctgtaacttttgttatttctcactgtaactgaccgtagataaatagttctttatatatttgtaacataatttagagcttgttatactaggggaaagtgttttaatgttgctgcatgaatactgaatttttaaagaaatttaagaatgattccatttacaacccagttatagttagatgtacagtagttacatctgtaacttttgttatttctcactgtaactgactatagatagataactctttatatatttgtaacataatttagagtttgttataattggggaaatgttttaatgtcgcagtataagtactgaattttttaagaaatttaagaatgattccatttacagcccagttacagtttagatgtactgtagttatatatgtaacttttgttatttgtaactgtaactgactatagattgatagtttttgttacgagtttttctgaaaaagttacatacttttaactacttgatctaaagaaatttcctattccaagcacttttctccaaaagaaattcactattccaagtgcttttctccaatatttttacagaactgagttgtttttgtttgatttaaaagatgactggcagaatatggtgaagtcaatggggaaaggtaaaggtggattttgtgctaggtaatttgttacctggaagattatgtcttgttgatttcaacttcttgacctcaatgttcttggtaagaatttgcttcttcttctttttctcgttctcctcactgtctatggcgtgctcgatttgttttgctcgatctaggggatttgtgcgaactggtgtggtctccctgtgttattttgtttttttctaacctttattggatgtgaagttgatcattatgggccatgatgtattttgcagttatggcctgtataattttttgtattgttctatgggctagaattcgagcccatgtagttttgtgatctgactagtcagagaaaaaaatatgtagcattttttgtgtcctttggatcttaatctaacggtaggaaaaaatctgggtgattttgacccaaggatttgtcgacaaagacatagctagttcctttcccttgtagtattactccattattaaaaaaaaatggaaatacatggataacgagcgagtgcttcggtttcgtacatgatgggctctgtatgagatttggacattgcggaggggacaaagaaattggtcagggcatcaggcccagaaaagttagatgggctcaactataggccactctaaactaaaagtcaggtgggcttggcacagatttttccttttcgttttatgcttgcttggttgttctacgactaataacaattaacacgaaaatgccaggcgtcaaatgcccgatgggcccgagaaaaatcgggcgccgcgcagcccgcgccaggcgtttccaccacgtgcgtccagttgcaacagtcttccggatataacggaaacaccatattaagcgaatccgttttattttttttccaccaataatattgcaataatcttgtttaactggtccttatacaacaacaatccctcgtatcccttatcataattgtactattgaaacatacatccacttgtttttgaccacgatcatgaagaaaccgcattggagaagagtggatctatcccaccctaacaccgtctcgccatccctcaacatttactttgtgctgttgtccatagagagggtatgcaattttcaaaagttttatggacatattttaggagttcaagttcgtagactatttataaatggattgagaccctatttatatgggaataaaatttttaaatccctatacacatcggatatttagacactaattataaacattaaacgtagactattaataaaacctattcataatcttagactaattcgcgagacgaatctatttagcctaattaatacacgattaacttatgtgatgctacagtaaacattctctaattatagattaactaggcttaaaaaatttgtctcgcaaattagttttcatttatgtaattagttttgtaagtagtctatatttaatactctaaattagtgtctaaatacagagactaaagttaagtctctggatccaaacaccagactggagcctagtactacctccatattttaatgtatgacgtcgttgactttttatctaacgtttgaccattcgtcttaatcaaaaaatttatacaactatcatttattttattgtgactcgattcatcattaaatgttctttaagcatgatataaatacgttcatatttatacgaaaaatttgaataaaacaagtggttaaacgttggtcgaaaaatcaacggcgttatatattaaaatacatagggagtatcagataaccatgctcagacagaaaccatgtgttggagcacccaatgtttcgcggtcgttatgggattctcattatctgcagatgatccctgtcctcgcggtcgtactagtcctcaaacaacaactttgcaccgtactgctgcgttcggtagtacgagtgtacgaacaatatcgacatcaaaccgttgccactcccacacgtatcgcttggccgcacgaacgcgtacacaagcctaacgcaacacgcccatgtgtgtaactgtaccacactgtttagactggtccatgggccagccaatgccatccccacgaacgaaaaatagtttttgaccggtccggaacgtcctttttagcctgccgtgtcacgtcttaaagctcttaattatccgatcacgagaagggaatacaaaaacacacacaaacacgcataatatgaacgagcagtattgcgaccgtgacgcgcaggatggaattccaggtaaaactacaaggtaggagtcgcagattgcaagcttgactcgaccactccggtcactggcctagctgtagctagcttgctgacgctcacgtctagtagtactggtcggctgctggccgagaggggcactgctgccgacgtgacatacgaagcttcttttatcgatgatatatataggtagaccgtccctcttatttaataaattaataaaaaaataaaaaaattagtcacatgaaatattattcatattttatcatctaataacaacaaaaatactaatcataaaaaaattttctaataagacgaacggtcaaacattgaacataaacaatacaaaactacacttattttagaacgatagtactgctactcctcgtcctgaaataaataaactgatataaaataagatactccctccatttcaaaatgtttgacaccgttgacttttta

SEQ ID NO: 28036 - DNA, 3617 bp, Oryza sativa
  unsure (1)..(3617): unsure at all n locations
nnnnnnnnnnnnnnnnnnnnnnnnnnnnnnnnnnnnnnnnnnnnnnnnnnnnnnnntcaaacatttcgaaacggagagagtatattttactagtagtattataaatctgaataatttgatttattttgggttaaaaggaatacatgtttaggttcgtgcacccatgtttagtcgtaaactagctgcactagtattttccagacactgttgtgttgggagtattccgtacaaaagtaggtgtttaatgaaatataactagaattgtaactggtgaagagttgattagagttgatgcctttggtgttgtgtcagcgtgcgcgtctcactctcacccctgtcggcatttggagtggccaatcatgcaagcgtccatgtacacaaacaatctcgacgacccaggtgaagacttggaccgggcagcggccttcacaacttggatcattcggcgacacggcgcatcaaaatcattcgtcgactgacagctatatgctcggacatactatatgcgcacacacaacaaacggaatttaccacaagtcgctcgagtggtgagtttggaattcttgctagatatagctagcttcagccggtaacgaaaataagtaatcgtttcttccattgctacttttccacgtgcagttgccaggttgtgaacttatcatgttgctctctcgagtcgccgtcgtagactgagtaagagtaacatatacactcgtgtgctagacattttgaacgattttcttagaacaggtggagcaaattactctttaaagaagatatataaagtgtcaagtaaaatgacagctatctataaaaccatacgaaataagtggagcaaattacataagtgtaaatgtttataacatttcgaagaaaataacctcgagcgaacacgatgacacgacgagcggcacgcttcctcttatcgtgtgtgtaaaactgatcgagacgccaccttcgtgagctttcctttccgaaaacgacacgagcctaaaaaaaggcgaagtgggatgcgagagaacattccgtatcgcgcactagtaaagagtgggtcccacagacaaggcgacctaaacgtgggccccacagaccccatggcccacgtgccagtgactcagcggcacacgcggggggtgggaatccagtccggtcagactccaccttctgtcgtttagaacctcccattggggcccacttgccagtgaagtgggagggcctcgcagtggggtccacttgccattgagaagaagtggggtgatggtggtctccacccgcgtccccccgcgggctccgcgtggtcaactcgccggaagccgaaataggcaggcagaaggccgcccaaaaaggcgaacaccttgcgcgcaccacgccaccacctccacctccacttcgctcgctcccgctctcgccatggccgccgcgcccgcgccatgaggtggccgccaccgccaccgccacgccactcctctcctctaccctgccgcgcggtgctgtttcctcgtccgtccccatgctcccgcgctgcctcgtcgccgtcgcggttctcctgctcgtcgcgtcccacgccgcgcggggggaggagcggcggcggctgctgctcgcgaggcaggacgtgctcgcgctccacggcctgcgcgggtcgatcggggtgcgggcggagtactggccggtgaagcgctatccctgcagctggactggcgtcgtgtgccgcgccgggcgcgtcgcggagctccgtctcaccgggctccgccgcacccgcgcgggtgcacggagccaggggttcaccgtcgacccgctgcgggagctcacggcgctcgaggttttcaacgcctcggggttcccgctccctggtcggatcccggcgtggtttggcaccggcctcccggcgtcgctggaagtcttggacctccgctccacctccgtcaatagcacgcttccagccgatcttggcatgtccgggaacctgacgacccttgacctcgccggtaatagcatctccggctcgattccggcgacattgttcctcatcaagggcctcaaatttctcgatctttctgacaacaatctcaccggggagctaccaaacgtgtctatctctgccggtgatggaaccggagttttcaacgcttccgggaattcgttgtacggtgccattggagatgtgcttgggcccctcaggaagagatttcgtcaggttgatttgtcgagaaattacttcactgaggtgattggaactggatttgggaacagctccgatggagcagtggacataaacatgaattgcttgtccggatcaagccagcgaagccagggggattgtgaagcattctacaagaggattggtgtttcattgccagagccaccaaatgcattgccatcaccaagcaagaaaggggtgaagtggaagtatgtacttgccggagtcctggcagccgcagcatttttggtggttcttttccttgtagcattagtgttctgcttgatgaagagtgggggacggcgaccgagaggaagagggttggagcagaatgaggaagggattcgttcggggcgcaggagtagcagcgttaatcctgtgatgctgtcatccatggcagcatcaccggcagcaaatggtgctgtgaaaggtctgcctaccattgtagatgagttcacctatgagcagttgcataatgttactgggggttttggggatgacaatcttgtcaagcatgggcactctggggccatttaccttggtgaactggagagtggcttcaatgttgttgtcaaaaaggttgatctgaagagcagtaataagaacttgggggaattgggcttccttgcaaagaattcccatgggaggattgttccattgctggggcatttggccacagatgaggaggaattgctggtctacaagtacatggcaaagggagacttgacttccgcattgcacaggaagtcagtggatgctgaggaggggctgcgctcgttggattggataacaaggctgaagattgccattggtgttgctgaggcattgtgcttcctgcacgatgagtgtagtccaccattggttcacaggtatgcctagtgatattattggcctgttagctaatttgctaatataatgtgcagctgattggtttatagttagtgaaaatattttaattgcaaaaagcatatgataactgtgctaagaaaagtttgaacattaacgccatcataaaaaagagcgcggaagttccacatgttatttagctcacatgaattgccaatttaatgaagaagctgcactgattatggcaagtgcgtgagtgaaagaaacaggacaatttaatatattaatttaaaactgtttctagttacacatttgatagtcttctacttagcctcttgtggccctattgcatcagttggcccactatttcttttctaagaagtatagctgaaaggggaaaacaatatgtgcgaagcttccctgacaaactgtttacttgtgaggacatgaaatcccacatttaaaatataatattatacggactatttcaccaagttgcattggatccatatcagcactnnnnnnnnnnnnnnnnnnnnnnnnnnnnnnnnnnnnnnnnnnnnnnnnnnnnnnn

SEQ ID NO: 28037 - DNA, 2315 bp, Oryza sativa
aaagtttcatgcaagtataagtactgtacagtatgtataattcattatatgattatacactgtctaactatgtgagaaactcatgtctctatcataaaaaaaaattgctgcagttattttatggaaactttatcttttaaggtttagtgtcatcaatcattgtaggtaactcaatgcactaaatatcgatgtatttggtgctagtcatcttttattccagctgcatgacttagctgcttcatctttctatttcattttattttactctgcagttcttatttgatgcatgctgttcaagttcttggatgttttaattactttcaagccaatcttttttccccttatcttttcattataactgtagagatatccaggcaagcagtgtgcttcttgatgacaaatttgaagtgtgtcttggaagtttgagtgatgtatgcactcaacaaagtgagggaagcaggagtttcttctccaggatgttgagatcatcgaagtaagacttttatattttatcgtctcctcatttttatgcatgagtttagcatgggtacaactgttcttatgatcttaccaattgctctgaaaattgagtccatcatggcatattccttttaaaagaaacttgattttatgatcacctgaacggtgctaacttaagggtgcctttagcactaaaaagtactaagacaaaagcaataacttctttatgaagttaacactttaacctaagtttagttattgaactgaaggtaatgtactggattttgttaacaaaatatggcggcagtgttttttttttgggtttgagtatgtataaggggacacatattcatttgtaagtgtttctccttacatgaattcttgtcaaatgacttctaaaaaggaagttctcatcaagagttagtcttgtaaattaatggccagacccacacaaataaaagaagaaaccctaccacctgcagatcataaaatatggcaacccacttgttattttgttaacatggcaacatcacgtttgctatgaaactttagtctttgtttaaatctgtaaagaacatcggggccttgcttaaacactgatattcgtctctttcttgtggcaggtctcttgacaagaacgcatcaggtgtgtaaagcttctgcataacttttttatggatattttataatctctaccattatactatacagctatttgtgtaggaattctaatgcgcaaaataaagataacctaacattactgtatgtatctctcacctaacaggtccaccagctagctgctcgtatgatgtatactgctttggaaaggtgctactggagctaatcaccgggaattttggtgtgagcggctcaaatgacactggttcagaggagtggttggcaagaacactggattttattgacgcccatgacaaggagggtctttcaaacattgtagacccttcacttgtagtagatgaagaccacctagaagaggtatgggcagtctccattgttgcgaagacatgcctgaacccaaagccctccaggcgtccactggctcggtacatcctgaaagcattggagaacccgctgcgggtggtgagggaggaattacagtcgaattcatcactcacgagtacttcatctcgaagctcttggcattttgcttttcatggggactcgcgcaggagctcggagctcaggccaacattggggcagtcagccaggaagcagtcagtgaagtcacaaggaagtgacgaggatgaggacgaggaggaggattcattctccttcaagagggcttcaagggagattctccctgacccggtagagttggaaaaggatgcagttgtgtagaattcaccacagattagcaatacatgctactgagatttcatctcagtgtgtataattcatcctctgatgcgcatctcctgatgcctctaggtgaaaaaactgtgcatataggagttagacttgtttctctttttccttttcatttcagtgttgtgtaatctgtaactgagattttgagaataagtggagcacaagggtgcgcggtgcttgaaatgcaagcggccagaaattttcgtagacaaccattttgtcattctggactctggagtgtgaatcgaagcacaaattttatagtgtaagccaaaggatcagagagatgaatgaatcgatctgcgaaatgaaattatatgttgctgatccagtcactgccgcctgttacaagaacattctttctgactattttctggggtttctggtctctgctgcttggaagaataaaattgttggctgggttaaaaaaacacacaataatttag

SEQ ID NO: 28038 - DNA, 1735 bp, Oryza sativa
tatagaggaagcccggctaccaccacgccaacgcgctcatttcgttcattctagggtttacaactcacgacctccgccgccgccgccatgggacactccaacgtgtggaactcgcaccccaagaactacggccccggatccagggtttggtaatcctctctactctactcgcgatcccccgcgccgtgttttcattcagttcggtgacgaaccataggagtatttcttctatctgtgtgcgtagcatcgggtcagatttgtcagattttgtggcgtgaattcgcatgttgctagattttatactgtagtagtttatctcttgcttccggtagaaaggttcgtgcgccctttttcttggattgcttgacgagtgcttacggatttgtggtgtggatttgttgttgcagccgtgtttgcggcaacccgcatggcttgatccggaagtacgggctcatgtgctgcaggcagtgcttccgcagcaacgccaaggacattggcttcatcaaggtatactcttcatattttttttaggttgctagttgcttcctgtaatatgcaggctcaagttagcagttttactttttgatggtgaaattgtttggtgcaatagtgttgcatcccgtgtgcggtgttgtggtagttcctaacgacgtagcgataatgtcacaaactgtgccgcgttgttcctcttccacgttttatttcctgcttgacagcttgtgtattgtgttatccgttgtcgcctcatgttcccattctcattttgtcagttctgttctggtcgagctgatatgaataattacagatcataagatggccagttagaattggaattgatgcacacactgcttttgtttctgagattatcttttgcagatgccaatactataacaatattagttaattttgaaaacctgtcttatttgttatcttcaccacttatccaacatagtatgagtatgtgccatgtgccccatgtgagctcattagctatcacttgtagctgccttctaaatgtcaacacttcaaacgtattgcaaacatctctctgtagttcaacgaataataggaggatctattgctaatcaatagactacaactatcatctttcatatgggttcccttcttttatgtttttcctttttgatatgttgcttccaattaaagcagggtagtttccttttgttaaaaaaaagttgctaaccacaattcaaaggctacctcttgcttaaaatattaatgcacccgatttcatgctagaattgtggagatgttagaattttccacatcgtctcatcttattgttatggaatacttgaatgaatgtggttatttacttattttatcgtgcagatgtaatgcacccgattttatgccagaattgtgatgttagaattttctacattgttttatcttattgttctggaatacttgaatgaataagcggttatttagttatttttttgtgcagatgtttgtgttatctagctttttgctgttattttaatccctggacctctcaaagtgcatcttattcatttgcagtaccgttgaaagttgggagctcaagtggaatgggagcttagatcgggaaaatttttatggaagtgtaaaagccttgtcgagtattatcccttttgatacaattgtcgtcttatgatatgtaacagattattgatatttgaaagtgagttatggtctgatggacaatacatgttctggtattaattctcat

SEQ ID NO: 28039 - DNA, 2494 bp, Oryza sativa
atcttatatgctttattattagattgttttgatagttcaggctgacaatttggccgggtacaataggcaacggccattcggccaacggtgcaaaaatgccaggtggcactgcacaaagatttcaactcgacatatgggacaatatggagatatttcacagctggatagagtatttcgtctaatcttactgtgttttctacaacaaacagtaaattgatgggtttagaggtgattttttaactttcgtgaaagtatagggtataaaatggaacctgcgaaggagcaacaaatcttcaattgagcgtctgaacctataaacaataaactaataagatatattagtataaagaataatattgatactataatttactctttttcccggactatataatgtactctacgatacatgtttttttagataaagtttattctacacgttgtccaaacaatattcttgtatttccattaatgccatggtagagtattagacgagccgagctccaagcctcacatagcattgctcgagccgagctcgagcctaacaaccctcaagagttcaatactaggatagggcgataggctccagagccccgactcggctttgagcctattcaggttggctcgctcgagctcggctcgttcaccgccctttggtcccaaattcccctacgccgctcaccgccaccctctccatctcactagctccggcggcgagcatgccctagcttcgtctccatcgcaatcgcagcctcctcgagcaggtttggatccagaggcgacgccgccggcctccatcgcatcgcggttcgaatcgaaggaatttcattcttctttttctctagtagctcttcttccccctcgctcagcttggattgaacatccattcagaattcgattgttgtttgtttcaatccaattaatccatccagtttcctgtcgatttcatgcgtgatgcagtactaatcgaagcaatttgtttccaggatcaagaaaaattgggggttcagctgagctctatgccccaagtgaggcctgcctctgccgagaagccgactcggcaatgggcggcatggacacgccaagaggaacagagctttttcaatgcgctgcgcctggaaggaaaagtaagacgcatcgatgttatgatgctacgctgtttcttgcaatctgatcaatgtgtgcgctgatcgatagatgcaacaataacttttcctttgtgtcagaattttgagaagatcacgctccgtgtccagagcaaaaacaaggatcaggtacaccattttcggccaagaggtgtaagatgttcatatgatatttaacattctgtattgatacgttaggacgttgaagcagtggtagatacacattagatcataaatttagtatttttttatgatatttgtcgttctttatttaaccaattaggaaatttgaatgaaaggaagattcaagttaggctgtaaattttagttctacatgcaatgtgctaaataactttcactatgatgggatgccaattagaattgaataaatctattttgctttgagaaaaaaaaatcagaagtaactgtcatgggcaaatctcattttcaaccatggtcgttgttgttgcttgacatagcaccagcatcctgtagcatatacctacattcttgctgattttcgtggttcaactggagaaggctgcagggtggatggattacaacatccctccttttagattcccatccagattgtgtactttcacttggagccgatttatcttcctcacttgcaattgatccctcttctttactaaagctgatttcatctttttttcaagtttctattgatatacttgcagccgatctgttatgggaaactcaaacttcagaacatgatgttttttttttcgggaatacgccagaggcgaattttttccattaagagaaataaaggttatttacatttaaagaaagagcagcaggggacagggactggaaagcattacaaaatcaaaggcctaattctcgcagcacattttggctaccatgattctctcggaagagtagggcggggattgctgaattcgcttgacgccaaagcgttgcctcttgagccatttccctcgccacatctgtccatgccctaaaactttggttgaagactctggcattccgctccttccagatcgtccaagccacaagtgttgctaccgtatcgaaactccggcattgagacttgagactctcggattttcaaccggctgctacacagccactggttgaaagaagtttcgttcatcggtaggcactccgggtgacctattgctctcaatgccaaaacatgatgtttagaattggcactaagttttattcaggctttagatgtatctcgatattatccccctattttgtccatctttggccataaagcacactcctcagcagcttaccacctaagattctgcacctggaggctggaacatttagagaggaattttcctgcactg

SEQ ID NO: 28040 - DNA, 489 bp, Oryza sativa
ggaaaggcatcccctctaaccgatgtttttgcatttggtgcctttctcctcgaagttacatgtggacgaagacctgttgagcaagccatgcaagacaaccaactcatgttggtcgattgggtgcttgagcattggcagaaaggatcacttacaaaggtaattgatgcaaggctccatggcaactacaacattgatgaggcaatcctagtgttgaagttagggttgttgtgttcacatccattgcccggtgcaaggcctagcatgcgacaggttgtgcagtatcttgaaggtgacatgcccttccctgagctaacgccaacacatctaagctttagcatgctagctcttatgcaaaatgaaggctttgactcttttgtcatgtcaacatcgcttccatcagagacgatgatgaccattggcacgatgagtggcctctctggaggaagatagtacagtagcacctacttgttagtttttttatcctacgaa

SEQ ID NO: 28041 - DNA, 676 bp, Oryza sativa
aagccgacgggaccgacatcgccacaaagttgtggtcgtcgtaatcgtcgtggcacaggaaacgccggagtgcccacgtccatgtgccccggcgacagttggtcaaggacgtcgcagccgccgccgtcgagccattgcaccacgcgccgcatgcctgggcgccccgcggcaagccggtgcgtgcacagcagcgcgagcttcagcatcgcctcggcctcgccggcggcgaagccgccgccgagcctcgcgtccaccgcgccggcgatctccccggaccgccacgagcgcagcacccagtccacaagcacgagccgctcgccgccgacggccgcgcgcggctgcacggggcgccgcccgcacacgacctccagcacgaacgcgccgaacgcgaacacgtcgctgcttgtggtggcctggccggtgcgcgtcagctccgggtcgaggtaacccatggtgccgacgatggtggtggtgctcggctcggcgccatggtcgtacaacctcgctacgccgaagtcgccgagccgcccgttcatgttagaatcgagtagcacattgctcgccttggtgtcacggtgaatcaccacctactcccactcctcgtgaaggtagagcaaaccggatgcggcgcctttgattatgttgatcctctgtgcccaatttaggataggtttac

SEQ ID NO: 28042 - DNA, 605 bp, Oryza sativa
tgggctatccccacaaccaaggttcgtttacatcgtattttttaaaaataaaagactgaaaagcctcactgcaattcatagcggatggcccaacagaagtatatgaaaatagccaatctgagctatactattttactactaaaacccttacgttttcataattatgctcaagttcttacacttgtattccatatagcaccttaacatttttcaaatttattaactatagttagatactttatttgataccccatagattgataggtaattacgtttgaatctctcaaaggtaattgtgtaaatcatcatgtggttactctcgtaggatcacaactactattcatcctccttggaacattgaaaaattggattacgccaaatagggaatcaacccatacaccaaaaaatatggattatatgtcgaggacgacaagggttacgccaagcagggaatcaacccatacactaccagttgctgtctacgctatcaagatgatagtttacgctgcaaaaggtcaaattccaaggcttatacgcctacgcggccatctcaaggtgccctatatggtacacgcccacgtgtggatctcgggtgtaaacacatc

SEQ ID NO: 28043 - DNA, 629 bp, Oryza sativa
  unsure (1)..(629): unsure at all n locations
nnnnnnnnnnnnnnnnnnnnnnnnnnnnnnnnnnnnnnnatcaatttcaggggaatctacgaactataccagctggacgccctcgacgtttctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcaatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgttttatatgtaatgcatcccacgcacattgcagattccactgggtgcttttactcttcgacctggaggcctgcaccgtcaacgtatatgactcaatggataaaaaaagagctacggttgacaatgttcgaacttatagacaggtccggcataagttcttttgttatttag

SEQ ID NO: 28044 - DNA, 1791 bp, Oryza sativa
tttgttttgtcatactaattcgccatgtcatgtgttaaacgtaccgttcgtcttccgttactatagctatagctatgccagtccatactttactaacgtgttatctcatatgccatatacttgtcacgtactattctctccgtcccataataaagtaacccgaataggacacttcacagtacacggacccggacatgatactataaagtgtcccatccgatactaagttgctatattatgggaggagggagtagttgataaatcttttcacttctgcgaccaacagtttgttagcaacactttgtgtatctttgtcatacttttagtactaagagggtgtttagatccagggtgtaaagtttttgcgtgtcacatcggatatatggacacacatttaaatattaaacgtagtctaataacaaaacaaattatataatccgcttgtaaactgcgagacgaatttattaagcctaactaatctgtcattagcaaatgtttactgcaacaccacattatcaaatcacgacgcaattaggtttaaaagattcgtctcgcaatttacacacaaactgtgtaattggtttttttcgtccgcatttaatgctccatgcatgtgtccaagtgttcgatatgatatggtgaaaaaattttaggtgggatttaaacagggcctaacttgtgttgtgatgaaatggtgagaaaacctgttgctcaaacggattcgaactcaggctagcacgttgctcctagcagctccctaccagctgagctaggtgctgttctcacctcttgaaatcttgatatacgtccaacgacgacatggaaaaaccgcatcaaatccaaggcggcatcgagtcaccatcatccatccacggatcgatcgttaattttgttcgggagcgcggactcattcctcaccagtcagcagcagcagcacggagccgtttcacgttggtgagtcaggcgccggagctgtagacatcttggatcgcggcgaccgatcgacagcgcgagcgagctgtcgatcgcgcgcactgtgcgctccacgagcggagcccggaatgtctcggggatccaatgcccaacctcacgtactactagtagtacctccaagtcgaaggtcaggtcgtcatagagatgcccatgccgcccatgcgatctcatgtgcaagaactgtagagattagtggtactggcaattaaaagattaaagtaaaatgaagggcacgcacgggtgggtgcaggacttgcagcaggtggctaatctagctggagcacgaaaaagcgacgatcgatcttgactgcatatgcgctgcgagccttttaaaatgggggaaaatagagcatagagcatggaaaggaatcaaaggatggatgacccggcccggttttttttgtttttgtttttttgaaaactgatgacctgtccagttccatacgttatcctaatcgcctcgtcatacaaatactggagtagaagtatattattattattccctccaaatgccacgattaaatctaatctaaaccctcgttgtcatccagccatgcgcacccacggcaacttgcacgggggacccgcgcgtcagcggcgcgatgtgagccgtgagcgtgacctgcgcctgtgattagtgtgtgttttctctcgttggagtccaggctggggacagctcacggctgggctcctccgggattattccggctcgcttccacctagtacgagttacccgagtcatcggtagtgagaaatctccgcgccgcgattggatggccgatggatggtcgggtcgcg

SEQ ID NO: 28045 - DNA, 1304 bp, Oryza sativa
  unsure (1)..(1304): unsure at all n locations
nnnnnnnnnnnnnnnnnnnnnnnnnnnnnnnnnnnnnncaagtacgatacaaaaagtgggcagatacttccatcaaacaactaacccacaacatggggcacactatgtatgtctacatatcagaatatatgccgttctgtacttcaaaacaagagaaaatatatcccatatttgggaagaaaatccatcatgcaaaggtttcatacaaatgctatgctccaggctagatctaagaaacatagcagactaaccaagaggagaacaaacaaattacagcagaataagatcacaacagaagaaacttaattttgttacctgtgaactatgagttaaacattcaaggcttacacctcctgatactggtgtaaaattgtgaaccatggcatacacagcaagaaaactctgtacaccaaacttatatatcaacgtcacccccagagctggctgaatcaccatcactgccgtcactatcactgctgctgcttccactaccactcccacttccactgctactactgctgctgctgctcccgctagagctagaggtttcctgctcatcctgctgcccttctgcattgacttgagctcgcagggcctcggctgcattgagtccctcatcagcctcatcactgacatctacatcagcaatttcatcatctatgtcaagctggtttggtatgttgatgtcaaaaccacgaacagaagctccttgtccagaggacatgttattcggtgagccattgtcatcatcaccaagtatgtctaggttctcctcttgatcatttggatcaggcgaaaatgaaaatggatttgtggtaacaggttggtatgtagtgctcctgttattgtttcttagacctgcaactggcaaactagaaaatgagaacaaacgataaatcctatccaagaaaacatttcacgtaatttggcaacattgacaatctttaacaacccttttagaaaacgcaaacatctttttcatcactacctctatttttagatattttaggtattaatcatgcttctataatcgaggagaacaatgttcaagtatgcttcgatctgtatgctactttttcatcgtggaaatatactacaaattgtagtaatggtggcagtatggtacagaggggggaaatcactacatgcgcctctgagttgtaggaaatggcatgtatttggtgaaactaaatatatttttttgcagaacagggtcaaaaacgggcaattagaaaaggttaaactgttttttgcattgtggccatatctttcctccagcaccatgaaatttgacaagatgatat

SEQ ID NO: 28046 - DNA, 474 bp, Oryza sativa
aatccaaatttaacatggatttggtccacattgactcccaggccatctgctcacaggccacacggtctcatccacacagggaaatgcacgaatcatggcgcaaatcctacggatagaaaaacgacaaatattgggggtgaaaatctgttgacaaagatctagcaaaatcgcaagggaaaagtagatacgtacttttttgtagtactagtaacacaaagacaagcaatacaagacgtataatcttagaacgcgatcacgtggatctgggatacttgctccctggggctatacatgaatgcatacaactatacaatagcagtactcggctctgtcgatctctggctctctctgcgttccaagggaaacgacgccttcgcaggtacggcaaaatcacgacctcaggtacggcgcatcacgtgcacgacgcgatgatcctgtgcgatcctactggtgtacagccggcacaccgtttat

SEQ ID NO: 28047 - DNA, 624 bp, Oryza sativa
  unsure (1)..(624): unsure at all n locations
aacatgtcctgtctgtgtgatctgataattcaacatcatttttaacctgtcaggaaaggtacaaacggtggagtgacctacaaaggctttcttgttgccacagcaggtggcctaatcataggtctgacttttgtttttgttggactgttgactgtggagtgctcatttgacgtggctcttcgacagcttctagtaatacccatctctgctactgctggtttgcttggcagtctgattgattcagtgttgggtgccacactccagttcagtggatactgcagtgttcgaaaaaaggtaatgttttctgtgacatttaggtttgaatcatacttgaatcaaatgcatgtcagagccatgcttttccatacatcgtgagatcatgatttcattttagaggtacttccacttatagctcaaagatttgatccacaactttgtttctatgattgaggtataaaattacataggacttgtaaatttctgtgtgaaatttgtcttaatatgtcttatgtatccccattaaaaacaatttttcatattctacccttatagctctctatcatttgtgagccgttgtagtgaaattnnnnnnnnnnnnnnnnnnnnnnnnnnnnnnnnnnnnnn

SEQ ID NO: 28048 - DNA, 1183 bp, Oryza sativa
  unsure (1)..(1183): unsure at all n locations
ctcaggcacaagcacttgcatctacatatagacatcctatagattggatcatagactcaggagcatcaaagcatgtcacaggattgcataatactttcacatcatacaccccttatatccactctgaaactatccaaatcgctgatggtacatccaagcctattcatggtatagggtcggtagagtgcacatcatcaatgaacttgtcttctgttctgcatgttccttcctttccagttaaccttctctcagttagctcggctattgatcaactcaagtgcattgttgtatttgatgagaattcttgtctgttccaggagaagtggactgggaggaggattgggactggagtcaggcgtgatgggttgtggtacatcaatcatgaggaactgggactagctgcggtggttggagatgttgagaaggagatcagtttgcttcactgtcagttaggacatccatcttttgagattttgagtaagttgtatccagacctctttagtagagtggataagcatagattggtgtgtgatgcttgtgagcttggcaaacatactcgctctacatatgttggcattggtcttcgtaactgtgagctcttcatattaatacattctgatgtttggggaccatgcccagttacttctgtgagtggtttcaagtggtttgtcacctttattgattgtcacactcgtatgacttggatttatatgcttaaacacaaaagtgaggtccttcgttgcttccaagactttcataaattagtgacaactcagtttgatgcaaaagttaagattattcggactgataatggaacagaatatatcaataatgaatttgtgtcatatgtctcagatgaggggattattcaccagactacttgtcctggcacccctcctcaaaatggtgtagctgagagaaagaatcggcatttgctagaagtggcaagatctctgatgttccagatgaatgtaccaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28049 - DNA, 744 bp, Oryza sativa
agcttaagacgagcacacgtactattaaagcgagaggtgcatctaaagcgagcatgcacggggtgagcatgattgacacgagcgtgtgagtctgattgctgtggcatgctggtattttttacgatcacagataaatctgcaggtgtacggataccgctgtagtatttcacctagggttattcaaagggtatcgtatttatatttttgcagggaagatgatggtgtaaagataaagtttatacatcattaatcaagctataattaattcaccatagtgtaaacaggggttagaataataaggataattggatagtgtgacacacaccaatctaaaatgtgactcccacctttcagatgaacaagtaagaattagtgtaatccgctaaggttattggactgtaaccgtagtattgatcgactagcctaatcaagtgaatcatataaatgaagtatatcctaatcataaaacacaaaactaccaaagcagtatatgaactatgaacacaagaatataaagaaggtaattctattaattcaactatagttttacaagaacagtaaagtactaaagtcatactggaatctccgagaaaaccatagaaccgaagattactctaagcctatttccactaatattgtagagaatacaatgcagatagagaaaatttctccttgagtatgtgctgtgaagtaaggaactctcctctatttatagcttctaatgacagttgcttagatcggttt

SEQ ID NO: 28050 - DNA, 663 bp, Oryza sativa
aattggaaacttttctggtgttcagaagctgcttcttgatcggaattcattctctggtgtcgttccacctgagattgggcgactgcagaaactctccaaggctgaccttagcagcaatgcgcttgagggaggtgtaccaccggagattgggaaatgccggttgctcacttacttggacttgagccggaacaacatctctgggaagatacctccggccatctctggaatgaggatactcaactatctcaacctgtcccggaaccatcttgatggagagatacctccatccattgcaacaatgcagagcttgaccgcggttgacttctcatataacaacttgtctgggcttgtgccaggaactggtcaattcagctacttcaatgccacatcttttgttggtaacccaggcttgtgtggaccgtacctcggaccatgccgccctggtgttgctggcaccgaccatggtggtcatggtcatggcgggctatccaatggtgtcaaactgctcattgtcctaggcttgttggcctgctccattgcatttgctgtcggggcgattctgaaggctcggtcgttgaagaaagccagtgaggcacgtgtgtggaaactcacagcattccagcgcctcgacttcacctgtgatgatgtgcttgactgcttgaa

SEQ ID NO: 28051 - DNA, 331 bp, Oryza sativa
ggattaccttgtagttctacgactaccgtcttcacgttcttctgcctcaattgtgattgcctgagctgggcatatctggtcatttgtaatgccaagtgagcaaaagagattgtttaacagaacgcataaaacgcaacaataactacccttaatcagcatgagaatcatcaagccttcaagttaaacatgcattgctttacataagtaaagctgattaccttaagctttacaagttgtttctctaacattccaaacaaaccaatacattgcattaggccttgttcggtttggatgggattgacgaggattggaggggattgagggggaataa

SEQ ID NO: 28052 - DNA, 637 bp, Oryza sativa
  unsure (1)..(637): unsure at all n locations
nnnnnnnnnnnnnnnnnnnnnnnnnnnnnnnnnnnnnnnnnnnnnnnnnnnnnnnntcgtctcactttgctgcactttgtttggcggcgattccgacgccgatctcccagatccgctcctgtcgggggaaacgcccgcggatcaacgggctacccaccatggtggaaaaaccgaacctgggaggctgggactgatcagtgagctttcaccggttcactgcttggaccgccggttcatcggttggaccacgatttatggctaattattttttatcataattaacgcttaaactgctaaacagaatagttattcagtcctcgccaacaaatttttcttacacagttggttaggtggaaagtacaaggcatgcagctcatcaagtctgaggtttaactccccatttgctcaaggttttttttgcatatttgttttaatagttttaagacaattcaccagaaaaccagctggttcgatggttttttttcatatttgttttaatagttttaagacaattcaccagaaaaacagttgattcgatggtttttttcaatatttgtttaatactattaagacaattcaacataaaaccagcttggttgaagggttttttttcatatttgttttaatagtattaagg

SEQ ID NO: 28053 - DNA, 793 bp, Oryza sativa
atatatagttttttttttaggttatttttaaatgatctacatatttgtgttcatttattaagtctatttgttatttgtgcattggagtaaatggacattggtatatgcatctatgcacacaagtatttataacccacatgcaatatcttgatttgctattggctagaaaatagtggggatggtgcatgcattgagtttgttgctagagtaaatatagtatgagagagttattagtttttcttggtcttggtgtacctatgaaatatgcatatcaatttaaaatggagagagtaataattagctgtagctcttctgagtaaaggtcgggatactctattccattattaaaaaataacgtagctctgtttaatttagatcattaaatgatttgattatatatatataggactaaattaaatattttaataaataaatttaacaaatatctaaaataagtggtctaaacaaataccacagagaaaatcttttttttatagaaacgtgtttttaattaagagtggagcaaataatccggtaataagttgaaaataacatggccaaattttcttcgaaaaaatgtatggttgggttgactgactggttgactcggactctcgtagtcgcagggctgggctccataaccactgggtgtctgggcctcatgccgagaaaatgggccgtgtaagatagggccatcgccctgctctggttgtcttttcttttttaaatataaaaagtctgggctttggtttcacgtcgtcatcggacagataaataaccgatagctctctac

SEQ ID NO: 28054 - DNA, 1628 bp, Oryza sativa
tcccccggacagaaaaaatatattactttcattgatataggatgaaaagaaaataagggaaggtctggaaatataaattttgcactgaaaaatagaagtgaatttgaaaaatagattttcagtccactggcaaacagatttttgtccatacttacctaattgacaagatataagattagcaattcaaccatgtttgcagtttgctatacgtgcacatgcaccatttacacgtgccgacaaaattggatcgatttcactactagagaatgtgaagctcccgtgtgctgcagagtgttaccgtgtgtttcccgtaaacacacggtaacttaccgagtgtaccactatgaactcggtaacccaggaaaaaataccgggtgctaggtttagcacacggtaactttaaacttaccgtgtgtagcgcgtaagaacacggtaacctccatggtgcacgtgctcatattctgctatgttccattggccagaagtggaaattcgttcgcacctaacggagttaaaagttcccgtgtttatttttctgctagacgctcgggaagggctagaagctacaaagtagtacagagatggtccacatgtcggttgctattgaaaaaattaatgcagttcaagggtaataaaacatttgaacattgtatttcgaacataattcatacggcgggtttttaaatataaatatttgtaaatataattcatacggtcaattttttaaaaaactattttataaaaaaactttaaaaagctatctttcaagtttacaataataatacacaattaattaggcacactttctcccaattatctccgatcctttctcaaccaccatggctacccctccctctccctttcattcatacaaccgaatccgggcctcattaagctcagggattattgcatctggtggttattcatgccaaatatttaactatttgccacttttacaagcggtaattaaagatttgtcgctagacccatatgtcataggcacatgagagcccacatgtcatagattgtgggtggcaaattcttaatgatcacaccttaaaagtggaaaaaagttaaatgccctgattacttccgacatatttctatactatttcttactttgggaccctgtgataaaaggtgtaaggactataaggaccgtacgcagattatgcaagattgactcaatgtcacaagctcgataatagaggcaaggctttagaaatacaaggccaaccgatcacactactacaaaagtgatttttctgtacgagccccatgattttttgcaaacggaccacaactagtggcgtttgcaaaaatcgagcgcctttttcgcagacggctgcttaagacgcccgcatggaaaaacgacctcatttttgcatacggctcacttaagtgcccgcatggaaaaatcgatttttccatacgggcgtcttaagtagccgcttgcaaaattttttttgaaaactttgaaactaatgtatctcactcatatgaactccaaattggatgattctttttcctaaatgtttctaaaatcatgctctatcatgttattgtgttcttaccggtattatttcagtaaatgatttcagctgaaaaagtcatcaataacaaagttg

SEQ ID NO: 28055 - DNA, 2633 bp, Oryza sativa
ggctcggcaacggcggtggcctcccttcaccaacctcccatgcgcggtgctcccttcctcgacgtacggcagcgggcacggcgacgacgacggcgggcacggtgacgacgacgacggatctggacggcgggcatgcagcggtcacggcgacggcggcggcggcggcggatgtggacggcagcggcgccctttgctctcctctccaccgagcgtcgccgccaaccctagatccgcctgcagctcctccgctcctccacccaccaccgcggtatcttccctcatctggccatccactccggtgatgtcgagcgcgtggtgtcgcaagaacgttgcctcgtttggtgagaggggatagtgcagcgagccgcctccaatcccttctgtcccactgctactcgctgtcgcagagaggagatttgtccgaccgggtttcatgttaagctgtggctttatttcccaccatcctcagtcccatcctatttctctttcttgttcgagcaatcgaatctgatttaaggatctgattttctcttgctaattttcaggagtcaaccgtctatttgctgtcccgtgcaccaacacgaacattgacccgatttcattctgacacagtagtagtaagtatcacgaattgtgcattttattctaaaatgtactagatttatatagcgtttgtcacacattgactagaatggatctgtttagttaatttgtctgctgtgctgctgattttaaaagtttagtgtatagagttaataaaaacgtgtgtgagctgatagtttgcaggagtgataaaattcccatgtgagcaactttgttgtttttatatcagtgcagtgtttagtaggaggaaatgaattaaaggacaattcaggggttgggttggttgggtcagtgaagaaatcagcaaaactgcagtccacaagatacaatgaattatgcttacaaggtgtttgtgttaatgactgcaagttgacacttcacagcatgtcctttgcattttaactacaaaaggtcgtgttctatgcatgctaactcgtgctcatcactagttgatagatttgtgcagttatttttccctgattattatgttatctcactatatgatgcaaaaatttaaagctcatgttatctcatgatgtgatatgctctttatacaatctcttagtagttctccaaagtgcctcaccaatttgtgactgacattttttcccaataaaatgctatgctgactatcgcattatatatctcatttttgaaacacaatagtatgagtacttgcttttgattttgtatcgtagtcattcactcaatatgtatgctgccttgttgtaaaaacagggtagtatgaattaaatactgaagcctagaaattcactcccatagtacaactgtaaatttgtaactgattgaattgcagtaattgctttggtactaataggtagtgtaaattggtattggtaactgactgaaacaatactcacttctcatatcctgtccatgacatctactgttcatgctggctgtttatcttttcatgtgcagattctagtattccactcgggtgtttcctgcaataagctgagtaagtaattttagacttcagtgagcagctgtagattaatttatcattatcacattctaatagtttattaataggattcatgtcgataaacaagtttacatttccttgcctttctatcatttgaaattgtttttagttaaagtaaacggtatgcccatggaactttatcttgtgctagattatttttctttcagcactgctcagtaagctttcatatttaccaattatcggaaacatctgtcaaatctagaatttcatatccattctgtttctaccaatcgcacagtggttttacacatgtgttgctatcttgtctccttaccagtatctaacaattgcaaggatctacactcaagtattaactcaaggcgacaaacagcagccacccatcatcttgactgattcgatattgaattattgatctatggaagaatttgttgctttggtctgctgatagatatattaagatgaaatatatgtagctgcttcatctgttgagatgtcacatgactgtctgaatttgtagattaggcaagctagcttgtcttaaagctttgatatttctttaattaacatgtgtatgttgaaacctaaatttatttggtgaattatgtagtttcaccttatatggatgtgagctgtggtgtatgtagcatgtgtttcttttctgatgaaataagtgacaataaaaaagaaattaaatggaaatcagaaataaaaaagaattatatccactgtacaaacccagtaacgattgcttcccgtgtgtttattttactatatcacacggtaacacactggagcataccgagagttttagtcagagcacggtaacacacttgatgatactccctccgtcccataatataagggattttgagtttttggttgtaatgtttgaccacttgtcttatttaaatttttttgaaattattatttattttatttgtgacttactttattatctacagtactttaaacacaacttttcgttttttatatttgcaaaaaaaaaaaatgaataagacgagtagtcaaacgttgtaag

SEQ ID NO: 28056 - DNA, 1786 bp, Oryza sativa
tttgtgacttactttattatctacagtactttaaacacaacttttcgttttttatatttgcaaaaaaaaaaaatgaataagacgagtagtcaaacgttgtaagcaaaaactcaaaatcccttatattgtgggacggagggagcaccgagttttttttttgcacccgggaacctactgttcatttgacggtgaactccgttacgttaaaatttgccacgtggtagggataggtgttcccgtgagtttcaggacacccggtatggtcactagtgttaccgtgcgctttttgcatacccccacgggaactgagcacggcaaagtggtgaagccgccgtgtgttcgttaccgtgtggtggcacacggtaactctgttcccgggcgtttttggcttgttaccgtgtgtttttgacacacggcagcttcccagcctctttgtaagatatcgaaactaattattggatgaaataggatggtttccttcaggaaacagccccaatacttttgagtctttagaatccaatctgttgttatactatactccatcttttgtgtcgacctactatatatatctatcctatagctagctaatgagaattaattaagtttcagaaggaggtgtcaaattaaaagtgatagaaatgataagctgtcttaatttgcatttgaatgcttgtgtgcgacgcaaacacgtctctgcaggccatcgctagctattcgatcgcatgcacgcatcgatcctgcatgccgtatattgatgtacatattgatgcacatatatacatgcatgcagatcgaataatcgatggagaattctagatgacaagaataaaaatcaacggtgcaagaaactgaatcatgtatcagaaattagatgtaatcacaaagtcattgttcagaaattatgattccgtagtacaaatccttatacaagtatcggaaagtgcaagtgatctgaacttacccttctttaattgacttgtgaagaatgaacagcaccaagcagagcagccgacagagaagtggacagcacgagccaggtcacgtcgccgccggggtacccgcgtcacgtggaggatctccgccgcccgggtcgtctttgggcgaggaggatagtcgcctcctcgtcgcgggtaggatagccgtagccgggatcgtctcgccactgcgtagggttggctcgtcaccgcgtaaaatcgggcggcgtggcggctgaggaggaggaggaggagacaactgcggcatcagagggagagaggggaagagatccacggcggtgatggcgtcaggggagagaggagaaggtggcggcgacgattagggtttgctcggagagaggttgggggaaggaggggcgacaggtgggagactgggagtcgagtcgggagtcgtgagccgagagggagagcgattgggggaaggagaacgcgtctggaggaaaagcggcgtatactgaggtggaaggtggagacgatcatgagtgttagatctcagcgagataatctggaccgttccatgatgaatgaaggaatgaaagatgagtgaaaccatttgttgaactataaagtagatatagaggaggtatagtgttgctcatgagttggcgcaacctgccctgagaacgaaacaatgtgtggtttggcgattccaagcttctctgtgtgtatctgagctcctacctggcgaatgtaatctttctgaggagtaatatattttcccttttcctcgcgaaaaaagtcacatgaaagcattttaaaatattaggccgtgtttagtttgtgtgcaattt

SEQ ID NO: 28057 - DNA, 712 bp, Oryza sativa
  unsure (1)..(712): unsure at all n locations
nnnnnnnnnnnnnnnnnnnnnnnnnnnnnnnnnnnnnnnnnnnnnnnnnnnnnnnnnnnttcttgattttttgttgggatgatgctgcttgctctgttgcttcgatgtgtaatcatgtgtctctctgcaggtggctgtgaagtgcaggccactgacagacagcgagcagcggcgttcgcggcatatcatacaagtcattgatgataaggtgcaggctctagtttagtagtaaaatgcgtaatttgttgtgcagttgttcagttggaattctgccagattgtgattgtaatgtgttgcctgtatgttttttgccccccagaatgtcgttgtgctggaccctgatctgtccaaggactaccttgaactcatccaaaacaggaccaaggagagaagatacagcttcgatcatgtgtatgcgcccgggtgctccaatgcggtatgcaggctcagatagaatgtgatgctctaaactggaactgctttgtctgttaccaaatgggctcatatgctgattacagcaagtgcttggaactgcaccacagtttggaaattcctgaattgttcataactagcatgttaggaaatgatgcccctaaaggccaaaccccaacctacttctttggatcattaactgctaaatttaggaggttctcgtgccttgtacagttgaaacaatactggtggtacccacaaaaagccaacacgaagtatt

SEQ ID NO: 28058 - DNA, 399 bp, Oryza sativa
acccaaacaacgcgtcatatgtataatgcacacaccgtatttactgattaattccttccacacttgaggaaaaccaaaacgtcacaacaaaacttcaatcttcaatcacaatactactacattgcatagtaaagaagcttttggtacacggctaatgttgttagcctgtaaagcgtgtcgttggagacgtggcagtggaagccgacgggaacgacatcgccacgaagtcgtcgtcgtcgtcatcgtcgtggcacaggaacgccggagtggccacgtccatgtgccccggcgacagttggtccaggacgtcgccgccgccgccgtcgagccactgcaccacgcgccgcatgcctgggcgcgccgcgggcagccggtgcgtgcacagcagcgcgagcttca

SEQ ID NO: 28059 - DNA, 136 bp, Oryza sativa
ctacaattgtcccacttcccggaacattggtggctaggggatcgattcgaggagggcatggtggaactcgtggtggatttggaggagaccgtggtggttttgggggaaatcgtgggggtagaggaggtgatcgtgg

SEQ ID NO: 28060 - DNA, 896 bp, Oryza sativa
  unsure (1)..(896): unsure at all n locations
tcctttagcgggcgatgaaccgaacggatgccgtttcccttcctgcgggagactgagctgtctgaggttgaaaaacgaacatttccactgtctctataaggatgaagctatgaacacaaatacctatcttaaacaatgaaacttaaaaaataacctgtcttggattgaacaatgatgctatgaacacaacatagaaaacaacctatcttgaactgaacgatgtagctatgagcacaaaatagaagaaaaaaaaagagagagaaattgctttcgttgagagtcgaactcaagacctcccgcttactaaacgnnnnnnnnnnnnnnnnnnnnnnncaaagctctttgttgcttgtctttcgtagctcaaaatctctgagtttctttcgagtttatttacttctcttgattgtatagacgtcaattgcttaatgtgtgctacgcacaagcatcttggttgctcatttgcttcagagctcaattgcttcatgcttgtcaacaacaggttgaagcttgaggcatgaagcagttgagttctatcccatttccataagagaatgatagagaagatgcttatgaaatgggaaatgatagagcagtatccatgttggaatgaatttacgcagagaagaataaatacagaagcatcggtcctgcattgtctagatgcaagcatttactaacaaaaggtgcattctgaaccacatattttgttcaaaatgccatctgagtcgacaacagtacaatgatatcgaaaaaaacatggtaatgcacctttaccctggcacaaaataacaaatgatggaccaaggtacaaaagcatggtaccaggtatttaggttatgatacaaagtttgcttatttatcagctagttgagtaaaacagggaaatgctgaat

SEQ ID NO: 28061 - DNA, 3376 bp, Oryza sativa
  unsure (1)..(3376): unsure at all n locations
nnnnnnnnnnnnnnnnnnnnnnnnnnnnnnnnnnnnnnnnnnnnnnnnnnnnnnnnnagctcctccccatatgttacacaaacccaaaagcttcattttagagttcgtttcaggtgacaccgtacggccttcgacattgcttttgcaaagcggcatgagcgggggagtacgccttccctcccaaaataagtcgattaaaattcatttatatatcttatttattttttttataattagtatttttattattgttagatgataaattttatgtatgaattatttttaatttttttataatttttttaaaaaataaaattaacggtcaaatatagtaaacagaaacaagtactccagtcaggggtagatcatcggctcaaccgctcccgctgaagcagtggatcggtcaagcaagctgcggcaaaaagagaagagaaaaagaaaaggaaaaagtttcctttgccctgatgagttgagtgagaacatgaaggagcaggcagcagctggatgtcagtggtggtggagtggagtacgggcgatccgtctcgctgccgctggcagtagtggctctgctgctgctgctgctgctgctacgagtggtgccagtgtggaccgtggcgtatgagtagtactagtgctacgagtggtggatggtttgttgggattggcgactagggccatgcacatttcccgttggttgtctgctgccatggaactgtggctgggtccggctccggtggggaaaaaaggaatccaacgcaaccacctcccctgtgcccacaccaccagcacagctacagctctctcctttttcttcatcatgttttctcactaatttttcctagtatttgaacacacgctggcgcgcagtatgcatttcgcagccggtgtggctttctgatccgttaattaagccggttgcccatgcttgtctcggatcgctcatcgtccctccatgcgagacgtccggtgattgctaatctagagctggatggacagctacggccagatggatggatatggggtctcgtccagtccagcgtggtgctgttgtgttcgatttgatcgattgatcgcggagaaaacgatgcgtgcggcggacaaggcggcgggcgatgcgcgggctgaaatggctgccacgacgactgagcgcgagaaattagtaagaaaatttgttcaaacaggtgttctcattatctgaaaaaacaaacaggtgttctcatccgcttcagaaacacatccaaatcatgccagctcaagctttcctggctgtgatttgtactgtacaattgtcaattgtagctaacgaatgaggaaagcttgtgtgtattagctagacaagtagacaggtatccatgaggaaaaagaaaaggcagcagacgattagaggatttcccacagagattggtctactagagtttacaagtaaatcacatgttagtaactaacaagacctggctcgttagttttccatccgcactgttctttttcaactaaatggatgagcaaattaacgagactcgcttttcaaatttctaaacaatattatttttataaaaactttatggacatgattattttaagaaataaattcatttttttaaaccaaagccatgctaagttgaagttatattaagaaaaatagaaagtatttacaatatcaccaaagaaagtgaaagagagaaacaagggaaactagggaagaaaacataaaagaaacacacactaaatgaaacctaagcggatattctcgtgatgttttttttctccacacatgctctatagcttgatttcattttgtattttggcgaatagttgcgacatgattttctcttgattttggaacaccttcatgtttcgttcacaccatattttccataccaccaataagtggattgacttgagtgctttagccttgtatttttcctccttgagatgttcttctgatccaccatttcaacaatacttcattttcatcatgtgggtggtctatttcgctgcagttcagtctactcatgaccctatctcagatctgacacacaaaagtgtcaatctttaaaaagatgttaggcggtttctaggtttctgtagcatagttgacagaaacagttgtttggtcattgtctgatctgtagcatgtccgttgtccgaatcctattctgcagtagacgttcaactttagttaaatcatttttaactttatattagttataattcattcgtttgtgaccttcaataaacgttcgcgcgtttcatattgcagcgtcggatcacccgtggctttcgatcgagcctggctagctagctagcaatgttaatttgctcttaattggcacacacacataaatgcttaatttgcaagttgcatggttcctaaaactcgtatagacactactagaaaaactcttttcccagtcggccgaatcatattttcacagacggacaagccatccgcctgcacctcaacgcctgcaaaaatagttgattttcgcaggcgcgcgccaggtccgcctgcgaaaatagcttcgagcgctaaaaaaaaattgggcagtcacccctgtttctggcggtagcttcccgttctcaattcagttcacaccccttccccatccaatccatccaattcatccagttcatccaaaaaaaaacacgaaatcaatttatccacagttcattcaaaatcactgaatcaattctaaaagaaagcgaaataaaaacattcaacaaatcacggcggctgcccagctttggtccgccaccgccgaacagcgggggcccgcggtggtctgcgccgccgccgcacggccacggaccgctgtcgtcaacgcgggcggctgggaaccgccgccgccgcctcaactgccctcgccgccgtggccgtgccgccgcctcgaccctcctcactgccaccacccgccgccgtgctccccccgcccccctctggccagatccgacggccaccgctctccccccgccccctccggccagatctgggagggaggcgccgggagcgcgccgccgccgccctccgccgtcgggaggggaggggagaggagaggtgaggtggggataggaggagaggtgaatgagagaggtgaagggataagcttaccggccgtgagtggtgaaggtgtggagacttagaaaaaatctcctcctatcccaagtctatttatattcaagtctattttcgcaggcggaccatttaagcggcgcctgtgaaaatcaatttcaccttgattttcgtaggtggacatcaaatttcacttcgatttatatttttgtaggcggtcatttagctctaagggtcatgtccgcctgtaaaaataagactcccacgttggaaaaaatgctttttctagtagtaatctagcctata

SEQ ID NO: 28062 - DNA, 1095 bp, Oryza sativa
ctttttctagtagtaatctagcctatatatatcacgggctgtacaactgtacagtatataggtcggtcctagtgtgctgtaacttgtaattgatgtatgccgtacgtgttatgtacgtactacctacgcgttgttaatgctactagtagtgctgtacggaaccgtagagcatgtttgtgtatgcttacgtgctgtgcgtccattcgataggttgatattgttttggcactatataatacttggattagtactataccgtacaatacttttacgcgttcacgaaaaatgttcagcactacacaaaattattagctgggagttagtgttagtaagtacaagtagtagtctacttatgtttggaatagtcctaattataacttttgtgatggtctaaattacctccaaactaaaaaaaaacttgaaatccaacacgctcaacttttcaaaccagaaaaataatccgaccactgctttcaatggatttagcaatccaatcaacataagaataacataggatcgacatgtcatatgcctcacctctctggctctctctatttctctcacggtgaccgagctaccctcttgaaggaggcaggtggtgacaccagtgacggagctcgagttctccacagggagagcgctagaggcagcaaccggcttaagctctatttagagagaatgatggagtttgagctatccttatttcttccctctctagatcggccatagcttcgcgaccgacaattcacaatggtgatggacaccatagcttgtccaaccattgtctcctcaagcttgaataggtggaaaagaggcaaaatggacacgaagctcgaggctctcctactccccaagcttagccacatgagctcaactagggaatgatgtggcggcaactgcgcacgatgagcacctcgagccaagcacttaactccatagttgaggatggttactctctccctccccctcctctctctctcttcatttgtaattacatccaactggaattgatgtgtgggtaggatggttaattcgaactgcgagtgttgtaactcggatattctggttatgtgtagactaagtcagagatgttta

SEQ ID NO: 28063 - DNA, 2567 bp, Oryza sativa
ttttgagattggcacgggtattaagaaagtaggtgagaatgattgaaaaaggtgtgtgattagttgaaaagagaaagtaggtgaaaaagaatagttgtgattggttgagaggagaaggtaggtagaaaaatagcttcattttaggataaagtactgtggtagaaatagctatattttgggacggaggtagtactcaacaagcatcacggtgtatatgccgtgtatatatccttatcgcgttgacgatcgacgaggatttgatgtgagcattgggcagttacgaaaacaaagaaaatatatatctcttgctgtggttgtgtgggttctacggtcatacagatcgcatgtgtttgctggcaaagcgccaagtggcaacacacgcaggcagaaaggcataacggtggagactggagagctgcaagcgccgagtgcgttggctgcatcgatcgatccgcggaggaaacgctaccggcgtgtcgctctactaccagtacttctcactgatcagctggagaaacggaaagcacgtgctgtagcgacttggctgctttgtccagatttgttttcctagaatatatcatatccatctaaaatatcttatatttaagataaatggagtataagttatgaatagataatagatatgggcatctttacccataattttttttttgtaaattagccttttattaggtggagagaggatggagggcctgttcactttgatgcccaaaaaaaccttaccgaattttggcacttatatttgccaaatttttggcaccttgttaaaattttgacaggatttcttatataattactaaaatttagcagcaagttaaatgtagccattattttgcaactttaccaaaaatttggtaaggttaaaaatgacatcaaggtgaacaggcccggagtaatggaagaagagagattctcattttttttttattctcttgtggcttaccataataagttttagtgcctaatcttgttgggcccctatcctgctatacaaacccatgttctatgggccgagctgaagctccatggccacattttctatgggggtattcttgttcagttcttcagttactactaccggagtattggcaatggcatattggaggcacaaaataatgaggtttaaaggtgctgtttggtttaatacttcaacttgccacacctctttagctttgtgtttggttcagtgccatagttatggcaagcaacactttcttactacctccgtcccaaaataagtgcagctgtggatatccgtgcccaacgtttaaccgtccgtcttatttaaaaaatttgtgaaaaaattaaaaatatttagtcacacataaagtactattcatgttttatcatctgatagcaataaaaatactaatcataaaaaattttcaaataagacaaacgatgaaacgttgaacgtgaatagtgcaaaactgcacttattttaggacggagggagtactattttatcctatatgtcatagactcaattctttgcctaattttgtcaaagggtggcttacaatttataggccacaaaaagtgtggcaagccccaaaccacacttgcctaacattgtctaaagtgagttatggcaatgttagttaagaaccaaacagccattttctatgtatacaacgtactaacggagtattggcatattggagtagcagttgcactgttgcaggatgcagccacatggccctagtgctgcacgcctgcaccaccacatcacaggcatacagtagtacaagccgctgccttgacgatttgaccgaaccaagaacaccatcactacgagctctgcgcagtcagcttttcgagatttgatgattcgttcggcccgatccgttgctatcctgatcagattctgaactccttttctctctgcgcccatctactgttggtactgaactttgctactgttgctttcacgctgtgtgacttctgtgctttattgtttgctcatgcgacatatactctctcccttccaaaataagtacagttttagcactatttatgttcaacatttgaccgttcgtcttatttaaaaaaagattatgattagtattttcattgttattagatgataaaatatgaatagtactttatttgtgactaatttttttaatattatttataaatttttcaaataagacgggtgattaaagcgctaaacacgaatctttatgtctgcacttattttgagagggaggcagtatgtctctcgtactctcgtactctcgtactcacttgcttgcttctcgcttggcgttcatggtgtcgtgcaaaccctgtgtgctcggtcatgatactgtggcacttgccgctgagaaaataaccagagatgcagtggtggagtagagtggagtaattcattggggcgtgaaagcgtcgtcagaaattcatcggggcttgcagatgcagcagtgtttgtagcgagcaagaggaagaagatacgacggtctcttctactgctactctagcttcttccttgcaagttgcatctacagttccaggaggagataaaagatttatttttttccttt

SEQ ID NO: 28064 - DNA, 2621 bp, Oryza sativa
actgaaaatggcagacggaatgctctccggtgacagcatgagattatttcggccggtttgatcttcaggacaactcgctgcatctttcaagctgatataatctgtttatcatgttaccctgcttgttactataaagccgtgtatccatctaggcaatctttttaagcgatgctcatgttattttccagtaacttcttttttattttcctgtagcaatagcttccggtaacaatttctcaacatttcccaactatgcaatctgttgatcaagcaaagaagtacatccagctttgacagcgactgaaccgtgaaaattcataagcataaataagcatcaattttcggaacaggtttcatcccataaagagcaagagcacagaaatggcgtaggaagattataataacaaagcttgttgtgatgatgacagcattttctgaaacagaacacatgcatatgatcactgctgtgaatgaagaaaacaggtaacaactaacaacacagttaaatcctgattatcaacacaagagttttgtcattcttatttctttgttgcaagaaaaataggtttcactgaaaacaagaatcactggaacaaccagagaatttttcttaagcattcactgggcttctgatggtgcgctgttcagtacttaatggtgcttgttctcaaataggccatcgggtcctgcatggaagagttgtatggtgtgagaatttgaaagcaacacagtaactcgaaacaaatacagaatacgaaacggaagtactcactcgatagtaatgctcaagtattctaccaatatatagttccaatgtggatttcaggtttatcatgccctaattcactgggatgttcatggcatctgttacatgcaactttgagctttgtatagcttcctatacaaaaataacaaactattctatactctgctgtacgataatcataggtggaaggcataagactagtctaaaatctgattgaatttaaggtcatattgtcataactaccattgttgttcatgacatatgttgcatgcaactcttaaacatttgtaccaaaaaaagaagattacaacacccatgctaattatatgaatttcgaatcccagaaatgagttctgaaagtcgtcatgcagaaaaatggaatacaacttaaaattaccatcccagatctcaaaggtttctagagtgattaggtatagtacaactataagtttgtgtagcaaaatgtacaccaagaactggatgcaatattgcaagcacaatgtacgatcaaattccatctcaatgtgcggtaagtatctggtgaaagtcccaatgtttgcagactaggcattgaagtgttcctcagacattggtgttgccctaagtatcttaggaaatgtgatcgaatctccaaacatgaaattataatattcttgcgcagacaaaaaaaaaatccttgcagacatatctatgccaatcgtaaatgatattcggcgagttatcacagtcaaactagtcaactaaatcggtagtttcatcagaaaacgatgaacaatcaccaagattataaacgaccagaactaaaggaatgggtatttcggcaaaatgaaataccgtaacatgcaactatcacaatccgcatacaagtacatacaccagccatttgacttcagtcagaatattaatcgcgataaatctcaatagaacatcgcaacaagtactcaaatagatagggttaagccatagctgaacaaacttaccccatgggaactccttgttacggatgtgcagataggggtacgcctgaaacaatcacagattccacgaatcagattcatacaatagctaatccagaatcccggataaatcaaggacgagatctgaccggcggctcgtcgaagtgggggtggcccttggagaggttgtacgccgccagcagggtgcaggtgacgatcccggcgtaggtgatcttctcccacttggccgtctcatctgcgagggggagggggatagggagatcgaaacgcgaatcagaagccaatcatgggtcaacgagaaaaccacacaaaacggggaagaggagacgggaggtgggacgactcacgggcgtcgtcgtgggcggaggaggacatgcggcgcctcgccgcgggggcggcggtcgccttggcgcgcgccgccagcgagcggaggccggatctcgccgccgccgatgccatgggggaaggtgggtggtggcgccgctggttttgggggaaacgggtggagagatcgagattagataggaaactgacctccggtttcttctttatttttgctggtggtcttcgtgggctttgcggtttgtgggcttcaattgttgggccgttgagttgaaatcacagatactacatcggtcccaaaatgttgctaccatcgtaaaacaacgaatttgtgggtcatgtagcaatattttaggacagaggaagtaggaaatttcaaccactgtcattgtttttttcttcaacttcaaactctaacctgtactcgttttctgttagcacgatttttaaatatttaaaatatacgaattttttaatatataaaaaatgttttcttaagaaaaattaaataaatttgatcttcaagtttataatag

SEQ ID NO: 28065 - DNA, 388 bp, Oryza sativa
cccctcccatggcaccggctgcctactgccgtggatggagatgctactaggcgctggtccatgctttaaagaagaggagaagcgagagaaaaagagagagaagaggaagggggaaggggttggctcgaatcttcacaaggggttctctcgggaagcgagcagacgccagcccagccctggtctctctgactccgagcgcttcacatgcctttggctcggacgaggcggccatgcccaatgagtccatgaccaccaccaccacagcaccactccctcgacagatgagttgctgtgctagctcagccatccccaccatgctttgtctatccattaatcgcagcagcaggtggccataaagtgtttcgcgggggggggggggggggggggg

SEQ ID NO: 28066 - DNA, 600 bp, Oryza sativa
caacgccattcaccagtggaccagcagctatggagtcagaagagttcgtgtgaggaccaaagctgatgacatccatttcatctgcctgaaggtgacggagatctccgccgtcgtcgtcttcgtcgccgggaaggccatcgtcggcaatgtaaccgtcgccgtcgtcgtcttcttcttcttcttcttcaccggtctcgacgtctccctcaccgcctcgatcaccatcgcccacctgatcagacgtgacgccccgttccatttcggcctcggtggcaacattgctccggccaccgatgctccgacgaacgccatcaccatcagacgcgtcgccggcgaagacaatgaagcccttcctgcccagccggcgccgcgtcacctcaccgtccatggcagcgccgccgccctccacggccactgcacgttgccggttgcgtgtgagctggtacaccagccagacactgacggcgactagcaggacgacctggaggatgtgctttggcctaagaagcttctttgatctgtggcatctgctggatggctgcctcaacatagtgaatcagtctcagtttgtgtgtgtggtggtagacttgttagtgttca

SEQ ID NO: 28067 - DNA, 548 bp, Oryza sativa
ttgcgaaaattaatccgtcaccatccatacgttgtcgttctcgaagggagtttgctcagcatgtggcgtcactgcttagccgtgatgaacatcaagtgcattccggaccaggcttcggccggctatgtgttattagtagatgctgtcacgggaacaacaaaccagtttaagctggtacaaaagccacctacttttctctaactttccttaattatttcaaactaaatgggcttgaagaaaacgatgatgtggtagctttgtctctcaaatttttcagcgctcatccaattgaagcggtagttaaattaatatcgtaatttccgattacattctttctaacttggctagctttatgtaattaattttcatagtggtggttgaacacacgttattgcaaactgatttagattcgttagtacatcttttccaacgaattgacttcaaagtctgcacatatgcatgcatcctgatctttacatatacatgtgttatatagacttgtttagtccaaaagtgtagtccatgctaacgttacattgggtccaaga

SEQ ID NO: 28068 - DNA, 574 bp, Oryza sativa
gtcccagctcccggccactggattcgagcagctcaccgagctcacacaccttgacctctcggacaccaacatcgccggcaaggtgccggctggcattgggcgcctcgtgagcctggtctacctcgacctctccacgagcttcgtcatcgtgtcttacgatgacgaaaacagcatcacacagtacgctgtagactccattgggcagctctcagcaccaaacatggagaccttgctcacaaacctcactaacctggaggagctccatatgggaatggtggatatgtccaataatggcgaattgtggtgtgaccacatagccaagtacacacctaagcttcaagttcttagtttaccttactgctcactgtcaggtcccgtatgcgcatcatttgctgccatgcgatcgctcaccacgatcgagcttcattacaatttattgtcaggttcagtgccagagttcttggctggcttttccaacctcactgttcttcagctatccacaaacaagtttcaaggatggtttcctcccatcatcttccagcacaagaagttgagaacaattgatctttctaag

SEQ ID NO: 28069 - DNA, 519 bp, Oryza sativa
atttaggtagatgcttcgctgattaataggacaacattaggtggtttttataactttagactttgggaatattcatatctcttggatactatggaatggttggcttatggtggaattggacatacccctttcttcctctttcaaaacccctaaaacctgttgtccggtggggtttgggtgcatgccagttgtgggaagtagcaccccggccaatataaggattaagctcgggcctctgttgcaaagcactaccgtacttccacatgtctagtgggtaaggcttcgtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctccctacctgtctcggggtttccggccgtaggtggggttgggttggtactcttgtctatggttaggatgggt

SEQ ID NO: 28070 - DNA, 258 bp, Oryza sativa
ggtgcggctgacgcgtggggcccacggcgccggccggtgcgagcccgggtgcgcccggtccaccgtggaccgtgaggctgtcgcatgggccccactcccgtggacccggtccgcgcgccccctcccctcggctgacgcaacaaaccctttttaaattaaaatttaaatgaagaaattcgcaaatattcatttaaagtgcatataaacttcaaatggccataacttggcgatttgaactcggaattggaccgttcaagt

SEQ ID NO: 28071 - DNA, 603 bp, Oryza sativa
catctttgtcgatttgcgccgtaaatcgtccaccgcccctacaagagtgcgacatctctttgtaggtttgtcctgaaaaccttccgttttgcccacgagacgggtagttatctagaatcggctccgttagccagtttagttatcaaaacctatcttggtttagcttttgctagattgagatggttggtgactctagtatcaacgcaaggcgtttacgtgctgcgatcgtgcttgtcaacttgtcacaaaaagttgccaagatgatttttggcgactccactagggaaatctgctcaacgtcatctcaacttcgatatcgccatgacaaagcctccatcaaccaaggcggaggtggaaccggtcaatgtgataccagtcgcattggaggagcttgatgagggagcacgcaaagctttagatgaacatctcaaggcatatactcaagatctactaatgaaggcgtgcgctaggacccgccaaggtgtgattttcaagccgggatcattgcctaaacatactttcgacatggtaagtgctgaagaggtatcacaatctatccaacaacaaattgcgcataccatagattcatctatggttacttta

SEQ ID NO: 28072 - DNA, 881 bp, Oryza sativa
agtgatcatgaactaacaaaaataagccttttgtttgctctaatttaatgccgactcctcgtaaagatcggcaaagtaaggttaagtatagttttgacgtggccaaatgtgatatgatttttttttatcttttgcaagaaaaacaaattagattacctaaaggccatgtcataccctctcaagtagaattgaagcgtcaagcttattgtaaatggcatgattctcactctcattctactaatgattgcaatgtgtttcgacgacaggtttaatcggccatagatgaagggcgattgaaatttaccgatggttccaagatgaagcttgatcatgatcctttcccggtgaatacaattaatttcaacaataagaaggtgttgattggtcaaggagtggtcattggagagcctaggccaaagatgatggtgccaaagaatccggaggttggtgtttggaaggagaataggagcgaagtttcaagttctaaagctcctaagaggactaaggtgaccttcgatatgcttttgaataagtatgagaagcaaggtggtgagaaagctcgcaacaaaaggaaaagaccaagatcacctcctagggagcgatttggtcattcaccaagacagtcggaatcacctacatatcatcgttctcaaaacatgtcatgggggccttatccaatgctgccgtcgggttatccttttccttactacatgccatggggggcaacaccatcaatgttcaatcatatgcctccaatgcaatacaaccggggccagctcgttagcgtttatctttaccaaacaatggccagttttatgctaagaaccgggccaatgaggagaaaagggaaggaaagcgtgtcaaagtgcatagactactgt

SEQ ID NO: 28073 - DNA, 1414 bp, Oryza sativa
ctgtacaggtgaattgtttggataagctacgagaaatacatgagaattggatgagaggtcgattgaaataacattttccaagatattagaccccatgcatgctaactttttttgaaaaaaaacatgtattaatctaatccactccaaaagaatttcacaggattttgaagtcatcaatcatttgttgaaagggcaaaaaaatagaaaaaaaatcctatagaattgttccttataacaaatcctttgatgaaaagggagccaagcgtataaagaacgtagagagtgttcttccttcgatattaattacaaggaagagtatacatggcatccctccaatgttcttatgatattaattatttcataggagttttaaatgattttccttgtgtcattcctttatgaaagggccatgcagaaataattttctatagatttcgattcttcaaagtttctttcactttttctttggactggttccaaaggagtgcttactactataaaatacatgaaacacaaaatttccatccggttgaccgacgtaaacggaagttttgtgacgccagaaacaaatggcctctcactatcattgtttgattctgatgactcccttatcattgtctgactctcactgaaaagaacatgataagtgatgatgcgctctcctgtggcccgatcttctggtgaggggataactatcgctttgatcaagtacgacgtttgcgatgtggctaccaaccagaacaagtccaaaacgccgtgcaatcgctacaccacaaacgatgtcgtgccaactgtgacacgcggttgatgatccctgtaaagcaaacaagagaacattgcaagaacaagataaaatgcaatctaaatattgcgaataggtaattaagcacaaagaaatagttgtgattgaagtggtagatctaatcgacctggcaaatcaacgcacaaactattgagggatctgaatttatagtcaccgactaatcgagcgaggactatagacaagttgaatagcacttggcaaacttatacctaaacaaatcccaattgttctagtgggtgtacatagacatttatagagaaaaatagatttagggttaagtgctaattcgtggaggtggagggagacacttctgagatgagtctagtctattacaaggcccaagttcgatttcagcaatatcatgtcttgttttgatgatttccattgactcaagatgaatttggatatgagaccagatgcgtttgaaaggtaatgagataaactatccatcaagtccaagatcacccgaatcagagttggcatgaaaacgctaaatctgtttaaagtcaatgctgtctccggagaccgaactggattccaaaactcattgtactttaatatcttgtagatcctccattcatctgatgcatt

SEQ ID NO: 28074 - DNA, 1170 bp, Oryza sativa
actgttaatttgcaattcattagaaaatgcttccacggattgtgtacatttgttccaagcaagtgtcaggacccaaaggacttgccagtgtggattggtctttttgttgtgctgattatggaatccaaatctcgtgaaatccataggcgtcattgccatgcaatccttgaggtgatcacaccggagttgggtagagactatgtcaatagttttatcaagaactggagttcaattagtgctcaagtgatggggtccttgacgaatttaacacaccatccacatgactgtggcattgatgtattggttacattggatgatctgattcaggtattttattaccttcatgttgatgcttggaatggaggattgtttgagcatgacagtctcgcaccccctgcgagagagatgaaatggtctccagttgaccccggcgtgggtgatgcaaacataagattacctcaggagccagcattacatggacgtggacacaagcgtatttctgtgccatcggcaaatatgtgttcaaagagagcatgtagtctcttaggagatgggcttgtagaacccccttcagcacaagatttttttgttcgatatgtgcaagtgggagatcaagtaagatctccgttttctctcatcattcgacaggcatgcatgcatcatggatggtgtattgaaatgataggtgtttttctatcgctcattttgcagatgcagaaacaagaatgtgatcacttggtttctcatctagtctcatttggcatcacgtgtaaagaacgccatacgaacacctgcaccaacttccctagtaaagtttggccagcttgaagacattcgacgtgagaacaatgaacaagcgaacagggaagaggcagaggattaagggaaaagagaaaaaaagggagagggggggggggggggtcaggaaggagcagtagcagggttgttgatccttatgctcagaagcttctcaccgaattggcagcatcaggcactaattctcaagggttactttggtggatgggctcatcaaacataaggtcaaagtatgcgttgttgaaaattctgcattgcagactgagtctaatcacagcttatcattctctatgcttttgtgggatgttctggggttcaggctaccttgaagttgcgaatctgctatgcgacatt

SEQ ID NO: 28075 - DNA, 1333 bp, Oryza sativa
cagtagctcatgcattggggaagtggcatacaaattgcaggcttcctggagattcatttatccaccctgtctttcatgtctctcagctcaagcagtttgtgccagctcatgttccgatctttttcaattgccctctccatttcaacagcacattagagaactggaaccatctgcaattctgaattgctgtcttgttaaaaagggtaacactgttcacactcaagtgttggtgcaatggggagaaatgccatcggcttgtgctacttggaagattaccatgatatgtaagcttgttttttgtcatcgcctcaagggggtggcaatgtcacaccacagggtgtgttacaggtggaagaatcaaggcctggagctagaggtagaagacgatgggaaggtgggaaatggaaatgcatatcctgaagaaggcatcgtctagtgatgtgaatgtcatgtgtatgctgtgcggggacagtttttgtgaggatattgatctgtttaaatagacagttacagtaactaatgaaacgttgtcgggataatgaaaagaattcatccccactgttctggcggctcgacggtgaatcctttgactgcaagcagggcgtaacaatcttggccataccttcagttctgttgttgtccctacaccaatgtctgctaagtcaccatcacttggaatcccttcacctccagttggaattttcgctcaggtaatctgttatgctcttttgtacatagtcattgatgctgtttcttgtttacgtatagcatgaaaaataagatgttatttttcaaatactttgaagtattaatatatttctgttccatgttaagttcttatttacatctaagcaatctttgcaaattattaactaaaaatgcatggaaaaaattgtggcacctgattcatatggaagatgctagtcactaacttataaggtaataatcatgtgtaattgcatatgtggaacctgaggtgatggggaaattattagagggtaaaaatgtatgtgagtttgtaaatattttatttctcatgcttggagaaaatttagcttttaacacttctagttatgaactttttcaatatgtcaactttgtatttcttgtttgattcttcccttctttctgtgagtttctcatttttcatgagaatgttcctttttgaaggcctaaatacctcattgtttgactaactttaagggaaaggctcctgcattacatgttgatactgctcaaagaaatccagcaaggtgcttttgtggaaatatttgatcagttgtaaaacctcccagatctaaccagcttgaggatctaaatggtagatcccatc

SEQ ID NO: 28076 - DNA, 172 bp, Oryza sativa
cagtggcggcgtagtacttgtcgactccaaggttgacgacttcggcgacggacaagttggcgcggtcgcgcggaggtgcgcaacgacaacgtccttgagcggatggttgaaggcgttggcaaccgcgaagatcttgaagcggtggtcgacggcggctgccatgggggatctg

SEQ ID NO: 28077 - DNA, 1001 bp, Oryza sativa
ttgctcctaagcattatcaacaaggcatgtcaaatgggactgatatgcaaacctatcaatgagcctgatggaggcggattaccaattagtcaatatactcgtgatactataatcctgatgagggcttcacataatgaactttttttttgccttaaagctttgttgaatattttgctcagcccactggcctcaaactgaattttcataagtcaaagtgtaatacctcgtaatgtactagaagtaaaaggtggaacaactagctggtacttttgggcgtgtagtaggaactattccatttacatatctatacccttaccttgtactacaaggtcaaggggattaaaatcatctaacctatttctctctaacctgtgttactgacatatgggccctctacccagtagacctttatgtcagtgacttaaagtctgagggaagtaagtcaaaggatcatcttcccaaggtcatgggtagtggatcatgctcatttgacagacagcatggagagaaggctcataacaagtgttattttcttgaattatggaggaagaacaaccttagtattttctttagggacaagctgacgctactggctgaggatttatatgtaaagaaccttggggtacaaccagttttacataaaagcccagtgaagatgggtaagttacatataggcccagaattatgcaaagaaggatttaacaagaaataggaaaagcaaccaggccgtcgatgcacacaatgacggtgaaagcagggatatcatggcaagttgtagaagatcatgccttggcacgaacccaaacagggcctcacaaggggggttgaggcctcagcaagaaaagaaaaaaaccagccatatcttgtatgtctaccaccggagtcaacgaggaagatcgatgcagaagcagatccatggccagcacaacctgttcctggggagatttggcgcactcccatagaaggcatcgaagtaatacctaatagtgatgagctactgt

SEQ ID NO: 28078 - DNA, 469 bp, Oryza sativa
cgcactcgtggccgtgtgaccttcactccagccgcaccacagccacgacttgccactgtcagggatgagtaccccacgcaccgtgaccgagactacttcatgggggtatgtcaaacttctactcacttctggcaattgtttctactcaggtccttcaattattttcctactgacatgctatcttatgtcttgaataggccgacgcggcacgagctgtgaacgccgatattacctcgataacagtgaggttggacgccgggctacacttgagtgatgctgagcagaggattaccttcgaccggatgcaggagaagatacgcgctgtcatccgcgtcttctcttgtcgcagcgccatggacgcggtacctccacctggtccagtaccaccacgtccacgcgcccctagtaccggagttgtgcgacctacaactggttcttcgcacggtactgctctgcccagaggttagtt

SEQ ID NO: 28079 - DNA, 287 bp, Oryza sativa
caggtatcattcattcgttacaagttcaattaactatactgaacacatcaaaagctaacagatttctactccatcataacatcttacgcagacataccgtaaattgtgcaactacattgagtgggttgatacagagaacccacaaaacgacggaacacgtccatatgcacgtagtgaatcaagatcggactacctcaggcggaaggatgagcatgaacgtcggattgctgcagaagctttagaatggcaggtaaaccccctaggactccccacatggcgggaacatc

SEQ ID NO: 28080 - DNA, 621 bp, Oryza sativa
agttttacagtgatcgataaagatagttgctgaccagaatctcttcacagttgaggattcttttgggttatcaggaatagcgtaaagcctgctgataactcggacatttccatccacaacagggacaacctatattagcaagaagttgtgttatcaacttatcatgtgaggatgtaaaggatcatagccatggtgatttcaataggatataaattatgtggaacacaacctcattgaaggctatggaagcaatggctcctgctgtgtaatccccaatgccacgaacttcacggagtgctgatgctgtgcgagggaactcgcctttttcaacaatttgctttgctccctactttgcaacaaaaagcaaaatcttactgagctacaaagagattcaactaaaatacatgcccaaaataatgcattgctccctaccaacaatttctattagttgcccaacactgtgtacatagatgcagaggtacttattcattcatttcatctttcaaggaaaaacattgcatgcacataacagtgcttcagcaagaaagattgaaacgaactgtgtgctgcataaacgataaaagtaaaacattttaacatcattaagtattgagtaaagtc

SEQ ID NO: 28081 - DNA, 1193 bp, Oryza sativa
cccaaactagccaaatcttcaccagatgaactgataacttcacatgagattggcagcgaaaacaatgcagcaaacatcacaaactagtagcaataatcccctcctttatcagacacaaaacggattccaaataaaatctctcctatagacaaaacatcaaacggttcgtgggcgctgtcaaaagctgaaaaattcttccgcagaacgcactgaacaagtgaaccccatcccaatccccgtcgtttcgacagtgaattcgtgatcaatcaactcactactcacctcgagaagaaatcgagccctccggtaatacccgagccccgcccacatctcgttcacctcctgcaacaatcggcggcaaccacaaatcaagaactcgattaccactctcccacacacagcatcaaactttacatttccttttccagcgatggtggaggagagataatttctcttgtctcacctcctgcgtggcagcggcgaggctgtccacggtgggccagcgggccatccaccgggagtagtagtcgaccaccacgggcacccgcgtatgctgcagcatcacctccgacacccacaccgcgtacgccctcttctcctcgccgcgcccgctcccgctcccgctccccgccggctccgcggcgcgccgccatggcaggtcgcgccggttggcgtcgtaccaccgcagcagctccgcgcgcaccgccgcggcggccgtggtgagccccactgctgccctgcacccggacggcggcgccaggtcctcgatgtccgcggaggcggaggcggtggcggcggcggcggcggcgcgaggtctccgcgtcgtggggcggcggttcttggccgccttggggttcttggccatggatgcgaaagggcggattttttatttttgaattttttgaattgacgagcttggcgccagcgagaaaaaaaaaacttatcgaggaaagaaatgaaataagtatttcgggagggcctacttacgatgggtgtttgcaagttttttttttttcgaaatataggcttcgtttagttagggaaaagttttaggtttggttgtcacatcggatatacggatatacatttatacatttgaagtattaaacgtagtctaataatcaaaccaattatagatatcgctagaaaattgcgagacgaatttattaagcctaattaatctatcattagtg

SEQ ID NO: 28082 - DNA, 595 bp, Oryza sativa
gatgtgagatacataccagggatggcgagaaatctcatctctctcagcacacttgatgcagaaggatacaaatactccggtttaggtggagttgtaaaggtatcgaaaggttctcttgtttacatgattagtgatatgaattctgcaaacttatatgtccttagaggaagtacattacatggttctgttaccgctgctgctgtttctaaagatgaacctagtaagactaacctgtggcacatgcgtcttggacatatgagtgaacttggtatggcagaattgatgaaaaggaacctgctggatggctacactcagggtaacatgaagttctgtgagcactgtgtttttggtaagcacaagagggtaaaattcaatacctcagttcatcgcaccaaaggtatacttgattatgtacatgctgatttgtgggggccttctcgtaagccctctcttggtggtgctcgttatatgcttaccattattgatgattactctacaaaagtgtggccttatttcctgaaacataaagatgatacatttgctacttttaaggagtggaaagttatgatagaaaggcatgatagactactgtaca

SEQ ID NO: 28083 - DNA, 362 bp, Oryza sativa
agtaatgctcaaagtagatgaagaagaacccgacggctagagatgaccaatgcggacgacgaggatgtcgatgcatgaacggcgatgaagacgacgagaggggtgacgctgtgacccgaaggggcgacacaggtgcggcccgatgtcgatatagcggcgagaactccaccggtagtgaggccacgctgaggagggcgcctctccgtgttccaacaaccagtggaggtggaccacgggcggcggcactgcagcccaagggggcaacgcagcggcaacccgaagattgatggcgtagacgcatgctcgataacgattggttacagaagtcgttgtagccgggcacctgaacgggtgatcaagcc

SEQ ID NO: 28084 - DNA, 677 bp, Oryza sativa
tgcaagtagctcatcaaaaaaggaaacatgggacataacaggcaatcgaagatgcagacttcttcaattgagtagatttgtgttatctttttcatcagaaagtaactgcatttctatcttattatgctttgtgaaatatgtttaaatttgtcatacattcatgtgttattctcatactaaaccaattttgtcatgcatttattttttttaattctcttaacccaataatttcatagacctttgaattagctatcaactatggtatagtacgtggaccattgatggatattacatttcaggtagctgatgtaacgcatgctctacaacagcctgctggaaaaaaggtatatttaccaattgcaatgcacttctgctggtttaggcaagattcctagtttaatggccgactttggtgctactcaaatcctatattgaccaacaaaggaatcaacattatggggatgtccatattttaacaactatctatagcttatatctgatgtaaatttgcatgcaactcgtgttcatagttttttgaacaccatgttaccgtcccttcctcaaatatctatgtatttgtgcaagtagacggttgtcaaattgtgcatatttggttctcttttgtaagcttgatggtggaggtgttgcaagtgggggcttacgagaactaataccat

SEQ ID NO: 28085 - DNA, 641 bp, Oryza sativa
gtactgtgcggggggccgctgcaaaaggcggcgaggaccctgtttttttgcaggcggccccattgccgcccttacggagggcggtttggtactgtgctggttgccgccagctttaagagcagcccccaggtgtttagttcggtgcatttagaaaatttagtaaatcatcacttctaaaattgtgaaacaagaaaaaacattattagaattgaattgtacgttgtttcggcggtttggagcccaacaaggggtgtttttacaccgaaatatttaattgttactgtaaaaactacataaatcattgtttcaaagtcaaaggaggaatagtttcaaactacataaatctaactattttgcaattaaaattttaagaaataggtattttacataaacctgatttttagcacttaaaattaggtaaagtatcgttttgaaacgaacaaagtacgtgcattttgacaaaattttaataatttaatttttcatataaattggagggctatgagggggtttgttacctataaattgtaagttacgcataattctcgtgtatgttgaaccatgcacacaattgaaggtggaagttataaaaatataagcaggtacatataaattataaggatacaatgatgagctactgt

SEQ ID NO: 28086 - DNA, 86 bp, Oryza sativa
aacggcggcgaattcacagcggctgaattcgcgtcgtactgcgctgatgagggcattcagcgccactacaccacgccgtacagccc

SEQ ID NO: 28087 - DNA, 1314 bp, Oryza sativa
ctttatgcctcctttatgctttattcagtttggatgccctctaggacagcatcccattcaaagttcagattttagactaggagggtgcagcaataggctagcagccagctatggctatatatatatgtatccaacctccctcgggtaggtatggcttttgtgtttagtgaatgaagaaaaccacaaaatcgccccatctcgagtgccatcctcttctcaatgagagtaaccattgaaattctaacagcactacgatttacaagctcaatttacagttccctgatccccattcaagtgcaaaccttatctgtaaatggctgtattttgaacttccatatgataccgttttcccatacagctttttcagaattagaagctttatattgatctgaaaacttccaaattgcatagactttgaacatcatttccttgatcacaggcagctcactggtgaactggtcgacccttctaggccaggagacttcaaccaagcaattatggaactaggagcaacactctgcagaaagacgaagcccggttgctcccagtgccctgtctccaaccactgccaagcactcacactttccaaccaaagtgcttccgtaaaagttacagactacccacgagtggttccaaaagccaagccacggtctgattttgctgctgtttgtgttgttcaaatcaatgataatctctttctattgatcaagaggccagaagagggcctgctcgctgggctctgggagttcccatctgttcttgtgagcgaagagaagactgatgtgctgaataggagaaaagagatggacaaatatttgaagcaggtccttagcatagatgttaaaaggagatccagtgtgatcctcagggaagatgttggccaacatgttcacattttctctcacattcgcctgacgatgtttgttgagctgatgattttgaacctcaaaggtaatcatttgttgtccatactagcagttattcatttttgtttagatacactctattattcattcaggcaaaattgcctaatttcttcactgtagatgatggggataaattatgcatggagggacaagataacagcaaactgagattcattgacgaaaatgcagtcgactcaataggattgatatcagggatccggaaggtacgcacaaattcaatgtggtaaaaatatttcctcagagtttggttaaaattgtaagatgaatgctcacttcaggtgtacaacatggtcaaggccttcaaggagaagaggccgaaagagcagagccaagtaccatcgaggaaaaggagtagacggctgaatgc

SEQ ID NO: 28088 - DNA, 398 bp, Oryza sativa
acttgaaactggccgattccgatcaaatgtcgattcagcacgaaaattaataaaaaggaaaagaaacaaagaagaggcgactcgatgcagttaaacctattcgattcgaatccgatggaaggcggcggcagcgattgccggcggccagcctccgacgatcacgaggggacggcggttgccagtctccctagctccaggaagaggaaggcggctaaggatttagaggaggaggaggaggatttgcagccggaggaggaggcgcgtccgccggcgccgccggcgaagggtcggtcgtgtctgccggcggcgtgccatgaggacggcatcatcccggcatttgtgatcccgggcagcaagcatcgcgacgggtccatctacaggacggatgcgcactactg

SEQ ID NO: 28089 - DNA, 736 bp, Oryza sativa
ccattaccctaatccctaaaattccctcccctacctcaatcaagcaattcagatccgtctatgggctaaatggttccctgaagtatcagcaaagttctgacaaacagactgtctgtagtggctccatccaccgttgcctcaacacaaactgcttttattccaggcaggttcatacttgaaggatgtgttattctacatgaggtgatgcatgaactaaggagaaataaacaaagaggcgtgattctgaaactagattttgagaaggcttatgacagagtgagatggggattcgtttatggggtgtttgacagtgattctgaaactagattttgagaaggcttgacagagtgagatggggattcgttatggggtgttggacagagcattttcatgaaaaatggattcactgggtgaaaagctgtatagaaggtggaaaagtctgtatcaacataaatgggtagagatctaatttttttcagcacttacagaggcctcaggcaggaggatcctatctctccgctgctcttcaattatgtgagtgatgcgttgatccagctatttgatgcagccaaaagcgccaatatcctaacagggctggtcccacacctcttccctgggggattgactcacctacaaatgcagatgatacagtgatttttatcccataccttgctgtgaccaagttccttctttactgctttgaggacatgtctggtctaaagattaactatgataa

SEQ ID NO: 28090 - DNA, 746 bp, Oryza sativa
gtttctttcatgatcgatttgttgttgttgagatggatcggaagcggtataagcaaatgtcgcgccgttgcgggaattccccgatcatctttgcgtgcattgggatcgacccgccgctgcccgtcgtcgtttggtcgccggcggccgccaccggcgccgcggcgcgcagccggggagggagcaccaatggcgggcgaggcggcatcaagggcgggaaggcgtgggttatttgttcttgggcgtcagccgatagctcccggcccagcccagcccagctgacgaggaatctaaggttgcgcatggccgcaggggcatggcagtggcgcgcgggcggcgagcgagagagagcaccacacggtggcgctgagggcggcggcggcggcgcgagcgcaaccagcgggaagccgggaaggcggcggttgacggagaccatcgccattggactcactggagcagcaggggaacagaggaaggaagccatgtgtggtggcattttgattctgggcgaagcttgatgagtttgggggccaagcttgggaccatggctctgggtgatctaccacctttctcgcggggccttctacctcgcgcggattcctcgtgttcaagtttcaaatccagaggtgacctccagtgttgatgcccagaagatgtttgatgaaatgccaagaaacaaggagctaaccacagcaagtgttgttcgcgtcaccgtgagccatgtgctctgtccagtgaccacagatgat

SEQ ID NO: 28091 - DNA, 602 bp, Oryza sativa
actatcagatgtacagtagtctatcacctgtagtggaacagatttctaatttccctttatcgcaagctaaaaatttagattgtgttgatattgataattcttgtaatgagaaagagttgtgcaatgcttcacttatatacatgccacaacttgtgaaagaacatgttacttctatttctaaatatttggtttccactcaaaataaatgtgtctttgctattgctgaagaccaagaagagctgaaattattgttttctttatgtactttaggttatatcgtatttgatgtcctttcttggaacaattatcatgtcattggtaaatataataatagaggagattatatggtgcatcgtgtgtatatatgttcagatatgagtactcttttaaatatgtgaaaatgtgagaaattaaatggatcatacaacattgatgctattgggataaattcacctaaccttgttttgaagatcgacaacaatattcaagaaggggagtgttgtgcaccattagattcaatggtcaagtctcgctatcattttaggacttgttcattaagtgaggtgagttggttttccctttatataaattggatttatgag

SEQ ID NO: 28092 - DNA, 596 bp, Oryza sativa
acagtagtctatcagccactacagtagccgtgccggcccggcacggcccagcaccttcttgggccgtgcttgggccgtggccttggcacgtgggccggcacggcacgggccgctacaggagtcgtgcctaacgggccgtgccctagtgggccgtgcggtcggcgtgccgtgccgtgctgggccgggccgcccgtttggcctgctatacccctgcggcggcagggagagaggagaggaggcagtggcgagagtggaggcaagagggagtaataagttcactttatgtcccttatcattccgtcaaatttaatttgcatccctcaaccgcaatacaacaaatcttaacctccaacttgcaaaaacagtgcaaaagagatcctaatacactagggaggctagttttggttaacgtggtgcctacgtggcatgtggcccacatggcattgacatccatggacaaaaaaaaaacgggccacacttcatggacaagctgtcccagcaaaaaaaaaacacatgatctagcacaaactgcttgagctgcgagacatgaaaaacatggtgaatcaatgaatctttaggaaacctgcagtttgtat

SEQ ID NO: 28093 - DNA, 759 bp, Oryza sativa
acagtagttatgcatggtcttttgaagtcttaagacaacaggtatttcacaaattttaagaaaaaacatgataaaaaatagataattttgtatgggtgctagtcgtgcaattgcgcgggccacccggctagcaaataaaataaattctaaacatagaaaaaataattataagagttaaatagaaatatgatttataagtaaaagaatatcagaatgaaaaatatggaattttaaaaaaaaagttcatctagaacacagcgataacatataacaataaagaggggagaaacaacaagcctatgaaggaatagagtgttggcggctgatgggacatctaagaactattaacaaaaccccgaatagtatcccaatgatgattaaaagaagggacgttagacagactgttaaacagcacgatcacggcggttggcgggacttctaaaaagtaaaaaagtaaacccaatgataaccatgttcgatttttaaaatctccatgacaacaaagagtgaagcagcgggcgagccatagaggagtacaacggtgacggagcgtggggctcctcaccaggagaccgcgcaggcccccctttgccggttcggccggggacgctaagtgaagttctaagctctcaatctgtggaatgttcgctaaagtggaaacgcgcaagacacgggcgatgtatacaggttcgggccgcttagaagcgtaataccctactcctgtgttctggtggatctgtgtatgaaggagctacaacg

SEQ ID NO: 28094 - DNA, 585 bp, Oryza sativa
acagtagcccatcatatcgctggaaaaaaaatgcaatgtttgatgaggtgtgtgcgagagtggtaatgaagttgtggatttgtggttgccgccgattgttgcaggaggtgaacgagatgtgggcggggctcgggtattaccggagggctcgatttctgctcgaggtgagtagcgagttgattgatcacgaattcatggtcgaaacgacggggattgggatgaggttcacttgttcagtgcgttctgtggagcgcccatgaaccgtttgatgttttgtccaaaggagagattttatttggaacccgttttgtgtctgacagaggaggggattattgctactagttcgtgatgtctgctgcattgttttcgctggcaatctcatgtgaagttatcagttcatctggtgaagatttggctagtttgggtggaagaactgacaagaacattagcagaaatgttttttccttgaaagatgaaatgaatgaataagtgcctatgcatctatgtgcatggtgctgagcaactaatagaaatgttgctacggagcaaagcattattctgggcatgcatttttggttcaatttc

SEQ ID NO: 28095 - DNA, 662 bp, Oryza sativa
agtagtccatcatataattaggttttgcaactataaaacatgtgcaagcgctagcttggaaaagacaggaaggctgcgctgttgacatgcggaccccacatgtcaacctaagggaccacagtagaccgagtacacagagacggcccacgggtcgacggaagcggaccccgtgtgccaaccgaggcgagtggccgacaaacggactccactagacaccacgcgggctgcacacgtggaaaccacgcggctaccgagcgggcacacaaacacggtcaccacacgcacccacgaacgattaccgacaccggtacacgggcaccggggtcgacaaccgcacaacgggcacgggcgacaccgaaaggacgaggacggggcagcgaaaggagagagatccttaccaccacgcgatgaggcgtgggaacgacaacaacgaacgggcgcggtggagacagctcggggacgacggaggcgaacggcgagggaacgacttcggcggcgatccttggacgaaggcgagacgcggctggcacaaggcttgatgacgcggagccgaggacgaagacgacgacggggctgctgcacacttgacgaaacgcgggcggcgaacgcgatcggcttgacggagggacgaaccctcgacgaggaggaaggaggaagacgac

SEQ ID NO: 28096 - DNA, 751 bp, Oryza sativa
  unsure (1)..(751): unsure at all n locations
nnnnnnnnnnnnnnnnnnnnnnnnnnnnnnnnnnnnnnnnnnnnnnnnnnnnnnnncaaatcacgttgctttcagtagttatggctagatagggagagagggcgagaaagctagttggcggggatatgatgttactcgttttactgacttgtaatttcgctctcaattgagtacaagatcgcgcaggagcagcaacataagccaataacaaacggagcctacggatatggagaccgcgaagtcatccatcccctgttgacagttcttcttgcttgagtacaagatcgggcaggagcagcaacataagccaataacaaacggagcctacggatatggagaccgcgaagtcatccatcccctgttgacagttcttcttgcttgagtacaagatcgggcaggagcagcaacataagccaataacaaacggagcctacggatatggagactgcgaagtcatccatcccctgttgatagttcttcagttttaccgaaacaacctaattttattttacaaaagatgcaaaaaaaaataccgatgtcaaccggtggaaaggtaacaccgttttgtcgctacatggaaaggcgaggagccccatgtcgacaacccacctggtgaggattagagcagatacaatagaggctataagccagttgcaaacatattttaagaagataaatgatgagagagaagagcagcgggctatagatctgtagccagctgtagcacggactccaagacgcaatgtgtgta

SEQ ID NO: 28097 - DNA, 2305 bp, Oryza sativa
aaacaaacgctgctcgcatactatcataaacaacacagtatgccgataaacttcagatatcaaagcaaaactgagaacagttcagggcaattgatcagaagcatacctgtatacacggcagtcatcagaagctttactgtaaccaagagattgtgtgagctttttgtacagggacaccacaatttacacgacatacatgtaacatcttagtacagctcttactatatatcttacacagcagaatgcgtccctcttgactgcaaagaacagcaagtccgcagctgttggatttcccacaaacagcttcacttggacaatgcaaaccctcctctacagcgagatgcatccttggtagtacttcactagccaatatagcaagcgacgagagcaatgaacggcgcccagaattcacagttctacatgatggatgggattgagtcattcttatctgccatgaagaatgacaggtttcgaaacgcatccaggctattcaccatcatgcgattccaactattctgactgtctcctaagagtaagtcctcagcttggtatctcacggatggtatctctaagtccagtggtccaagtgaatcagcctatccaaagagaagacatagtaagttatgatctgtgttgatagattatactagaaactaaaacaggcagggataggatatctgtctagtacccaatataagtcagctagagattgatcctttaacccagaatcacttttacttcgaggtggagaattggcacaaagtgcctcatatctttggcatcatccatacaaggattatcagcaacctttgctcctgctaagtcctgcaaacatgaaataaatcatagattaacaacattgatgtataaaaagtcgttttattctacaagagaccaagagatggaaacaaacctgaagaaagcctgaaaacccttgtgaggtgaaaggaagaacaccactatcactaccaggacagctgctagctgaagtgtttgaactttcttgcttcctagatgctgccaagttaaaactgaactcatcacaggtttcttcagcaccccagatggtcgaatgggatgcaagggctggctgctctactgttttatgacgagaagcgtgaagagcaacagcagcatcaaatgaatcatagctgcagggattctcaagaaacaatgtgtttttggcaatagctgtccctggacaatctgtattagtacctatggatgcttctgttagtaagtatccaacactgatatcagtaagggtatctgcccactctccttcagatattatagcacaatccatccccagattagcctgaagtataacagaagcaattagaagatagcagattaatgttcacttgacaaaaatatggatggaactgaagttggacctctaaaacttggtttgtggaatctttttcttgcttctgcctgctaaaccatgaggcgggaaaatcactgtgctgctcttgccccttagcgctcttgcctgtactaaatgtcatagcaagaaataatgccggccgatcttttgaattacaaagggtgttcctcaggagcacaactattaagaaaagtaccatccttctgcacacaagcgtctgaaggaggtttggcatgaatgtcttcaggcatcatgcaattcttaaaatgagttgaagatattccacttcttctttctagctcagcaagggagaaccaaccatgccttattggcgacaacagtaagcacttgttacggctttcaacaaatggtcttatcacaatattatagtttgttacccaggaattcatccataccttaatcgaaaaacaggcgggctattcacagaaagaaaaacatcagccaccacaactgtatctcttgtggtccatctctgataggtagctaaatcttctcggtgagcacaatatggaaaaagcaaaagctctccagacgcaatgtttgagctgccccacttgcggttaagatgttctagtacagaagatatttttttcctagcgctaactgtgagttccagatgtggattatgttcatcctgttgaaaaaagataggactatcaatatctcaaacaccatcgaaaattcataaggtaaatagtgctagtaaggttatttgcactccacattccattagtcccatttatcctgagaaattttatcaaccacagtgatttgagtgtccgagccaatagtaaatcagtaatagctggtgtgctaacacagctgctgcaggaaacacatgattcataatttcatattgcagcttggtggcaacaaacaggcatatttaccttt

SEQ ID NO: 28098 - DNA, 702 bp, Oryza sativa
aaaaggacaatatggtagtcaggttcttcgtggaaagcttgcgttggttgaccttgcgggcaggtaatacactaatacctactcctttttggattgtttttctcatttcaccctgctaagaaagtaagctataaagcaacgcttatattataacagtgagagggcctctgaaacaaacaactttgggcaaaagcttagagatggagccaacattaaccgttcacttctagcgctagcgaactgcatcaatgcccttggcaagcaaaacaagaaaggtcttgcatatgttccatatcgaaacaggtatttccattttcaggtgtatcattctggaatccatcgttttaaaaatcttagttatatgacaatggtactctgcagcaaattaacacgaatcctgaaggatgggctctctggtaactctcgtactgttatggttgctacgatatcaccagctgatgatcagtatcatcacaccaccaatacactcaagtatgctgatcgtgcaaaggagataaaaacacatgtccatgtaaggggccatttcttttagtctgcataacaaattacaagatgctgtgtctatgtagtcatcactattctcacccatgcaaaatatttaattggttctgaatcataaatgtgaaaaaaccagttcttatgttgtttgttgtcctgtacagaaaaacattggacatcttg

SEQ ID NO: 28099 - DNA, 648 bp, Oryza sativa
attccctcccaattacctgcccctaaccaggtattgaaaaggagggagttcattcctcaattccccatcctcatcccaccaaaattcccatgtcccccaaccaaacaaaacagttaatagcctcatccctttaaactcccaatccctcctagaaactccctccaaccaaacagactgcaagggaaagaaactgaaaagtgatttcaggcatcaatcatcactgccgatgtgcagaccaggtgctagtacaatactaccacaataagctagcagtcgaacgggatggaatgagtaggttaccacggcggtggtgtccatgtggctgacatcggcggtgacaccgggcgtgttgacgacatcatagaggtggagcacagagacgagcgggttcaacttcatgagcagcgacagcggctgcccgatccctcccgccgcgcccagcacggccaccttgaaccccggcgcgccgcccttggccctgcatggcgccggcctcaccccctcctccatctgcacacacacacgcacagatgggtcatcccctcacatcacgcaacgagagagcgagagatgaactgtttcgcggcgcacctgggggcgcggcgacgggctgaggtgggcggcgacccgggcgatgcggtgggaggc

SEQ ID NO: 28100 - DNA, 2334 bp, Oryza sativa
  unsure (1)..(2334): unsure at all n locations
nnnnnnnnnnnnnnnnnnnnnnnnnnnnnnnnnnnnnnnnnnctagcgaactgcatcaatgcccttggcaagcaaaacaagaaaggtcttgcatatgttccatatcgaaacaggtatttccattttcaggtgtatcattctggaatccatcgttttaaaaatcttagttatatgacaatggtactctgcagcaaattaacacgaatcctgaaggatgggctctctggtaactctcgtactgttatggttgctacgatatcaccagctgatgatcagtatcatcacaccaccaatacactcaagtatgctgatcgtgcaaaggagataaaaacacatgtccatgtaaggggccatttcttttagtctgcataacaaattacaagatgctgtgtctatgtagtcatcactattctcacccatgcaaaatatttaattggttctgaatcataaatgtgaaaaaaccagttcttatgttgtttgttgtcctgtacagaaaaacattggacatcttgacacccatgttgaagactacaaaaggatgattgacaatctccaggtttgccttactgaaaaaacacaaatgaactttctacaattctatcagcactccatcacattaaaatatgttccattatgactttgtaggttgaggtttctcagttgaagaaggaattagctgagaaggagcatcagttaagtgtaaaacctactgaaaaagctgcagacaatgagctatcttggctaaatatcttgagccaggaaactggcgagaatgttcaagaacgcattaatctgcagaaagcactgtttgaacttgaagaaaccaataagcgcaatcgaatggagctccagcatcttgatgatgcaattgcaagacaacaggttgattactcacctattcagtttgttgacaactcaaaaaactactcttttacacactggcagcttacaagcctcttccaatcagaactctagttaatacctgtagtgcaacatcaataagggaaatactggttgtcatctttgagatagcataactaagaattgtattgtggcatcgcagactgttgcagctctctaaaccacatatgttgttacaatagtatctcagaaattttctttgcagtgtacagaactctgatgaatttgtgttcaggtgaaagataaggattcggctgttctgcaagcattaacatcacggagacaagttattcttgacaacatacgcgacaatgatgaagctggtgctggctacagaaaggtatttgtaatataaattcggattgtcctttgtttttggtttcctcaaaacaaacttatatggcaaacactatgtaggatattgaactgaatgagagtcgcaaacgtcaactccaagatatgatcgaggaagccaccagtaacaatggcaacagaacctacctccacattctcagtcagtacagacttcttgtgagtaaccaccacattttagtatgttttcctcataatagttgatactccacaatctgcttatggataatgtgtgttttaggggatgactaatgccgagcttcaaattgagatggctatgagggatcaagtaatatataaccagagggaatctctaaggagtctgtggaacattatttatggaacagggctaaaccagaaacagatttctaaactagctgcgaagcaaggcttaactatagaaggctgtcctttgcctgtgtcaagtcctgatgttactaccccaccttccttttcaccccatggaaggctatcaccattcatgtcatttcctagcccgcaatcacagccttattccccgtctgcttgctttgtccaacatggtttcagcaccatgtcttatctcagaaatcaacatgagacgcctacagtatgtaggcaggagcacctcagttcttactacatgatgtctgagtgctcgccttttgatggtgatggaaaacagaagacaaatggaaggtcaatgccatacttttctaccccgggaaaaccaaaagaaatgtataacttttctcctggaactgaaagcgagagaactccctgcagtaaggaataccccacctcatattctcgcaatggagattcgcttgtacaaataaaggtaaacagtcttcccttatacacaaaaacaatgattggaaatctgtaatgcacgtggtcccaagtagacatggtttttcatgtagtaagagaacctaaaatgaaaaaggaagtaacatcaacttaaataagcatagcattccaaatgtgttactagcgcaccaattaaggtaaaaagaacaatgttatctcaaacaacagaatatttcagaagtgaaattg

SEQ ID NO: 28101 - DNA, 1276 bp, Oryza sativa
atagatatggccatatggcagtttgacaactttgacccatgattattctttgttttgttttctttatcataaatttagtatgtttttttattgaattaacctcatatttaggctgagtttcagatgttgtttggcttctacaaatactctattaccgtgatcatgttttttaaattgttaaatggtatattttttaaaaaataacttttatatgaaagtttatttagaaaattaaatgaactatttttaattactaagactcaattaatcatgtactagtgacttatctcgttttatgtatcgtcatttagctaactcagtttgggtttatttatctgttgttcgatggagcgagtataaattaatggtagaaaattttgtatacataaaaaatggtatgtgttctatatatgataaggaaacaaaactacttgaagttcattctaatgaccctgatttttgaagcatttggtgaaataggcggtgatcggttgtgctggctataattgtgcagcacagccgtagcaaagggaagggctgcagcagctgccatagctagtggctgcaacagataaccgagcacgctcgtagtttcttgataaatatttttttctaaaaaaaattggccgctctaacaatcttccaaaatagaatgcacctagttttaaatgcttaggtgcacaaattctacaattcctgcaaattgtttattgtggattcttactatccgaagcatgtcctacgatacatatatagctgccaagagatataataatttgataaaaaaaaactaaatatcacctctcaatcctttacttcaaaataaatcccaaagtaaattactgatttactgctagctaatataaaatgaaatatccatacctgaaggagaaaactttagaaaaccagttatttcatagttaaaggtataaaacaaaccactggtattatgatgtatggcaatataacctcaagttacatggtctcaatgtttcataaaacctcacttttattcaaatcttgataaattctagcatatatattaaaaattaaaagtaataaagaattaaactgtcaatcttaatcaacaacttaataattaaaaattacatataaattctatgttttagaattttaagtaaattcgatctcaaaatacataagggtagtattatgtaaaactttataaaaccatcatacctgaattatgtgtcatatatcataatacatatgatttctctaactttgaccataatacatgtaattttaatgaatg

SEQ ID NO: 28102 - DNA, 3400 bp, Oryza sativa
cataatacatatgatttctctaactttgaccataatacatgtaattttaatgaatgtactcactctggaaattacacgcaaaatcaggattcagatacaccgcgcatgcgcgcaccaaacggataccgatgaaaaagacggggtgacgaatgcaatgcgatggcagcatggaagtggcgcgagccagcaaaaacttcaaagaaaaagaggaggaaaaaaaaaaagcaaagcttcagagcaacggcgagacaccggcagccgagctgctttgcagaatgcggcatcaggcttccactttcgtagtagggcaagcagatcgacagcgacgcctgcacaaaaactgcagcaaccaaaaatcatcacccagcagcagcatagcacggtacaattgagggccggatcctaacctccggcgaatgccaattccatgaaatttcagtcgaatttgttgtttcaaatttaatttgtaaaaaaacagtcaaaatgtcccactgaatctgcttctgtcccgactcaaaattctaaatttttgttgttttcgatcggttttcgtctaaaatgctacctagtacagtactccctccgttcgaccgttccgcaatagttatagttctaaattgtttagcaaaaactatggtttaataaaaacgtctatagtgcctcctattaaatgatatggggtttggaatgagaggatagctgagggcagaatgaattaaattttgaattggatgtaattgatgtgacaaaagttactctaaagtgatagtaagtttttggtaacaaattttgaactctaaaacgataactgttttgagacggagggagtataatccaacttctttttttctgatttctatttttgccaaatcagatgcagcaaacaaacagtgcgtgataatggcactgacgcagagcagctcattgggcttcaagcccggacataaccatcattacgccgcaataatcacgctaaattccaacgcggaaacagcacaagcagatcactctccgtgcacggcaacaacaacaccagcagcaacactcccaagctgaagaagagcagcagtaataactgattagaggacaaaaacgtgcgagagattgatcattgatggccaccgtccaatccacaaaacaatatctcgccggtcgccggcgccggcgagatcggtcggctacggagtactgtagtagagtacagtacagccgctgctgctgcttcttcgcaagctgccggctgggccgcattcatcactcgccgcagaaaaagtcgcggccacggccggcgaatttacaggcttcaacaataattttgacccttcaggatggcgcaacagtgtgtgattcagatactgctgtttcctactgcgagtacatgctgtgtatctgcttgtagtgtgtacttctccagctacggggatttcggaggattgttactggctattactccatctgtcctaaaatatgttaacttagaactaaatatgttgtaacataatactccaacgaatatagataggaggttgtccagatttattatacttcgtattagatatatattttagaacaaagaaagtactaattagtactcaccctatcataaaatatagaaatctagtatcaaaacactagtactatgatctggagttctggacataccagtatgctcaattcaatactacatttttattttttaagacgaaagaaatacatgtactactataggttgcaggcttgcagctgtgcattgaccaactgacaatttacatttaagcggctgcattcagagcaaatttataatccgcaacgataatcttgattggaaatatggagtatgtttgtatttgttttgttcaggcggagtattgtattattataaggctgcatttccagcagctttataacttcaccaacaatgttgacctgcaggaggaaaaggagtaaaatcgcaatagtaccgtgagctgctgtccgcaattcatcaatttttttcagagccgcagttaattttgcaggccttggtgtacatatcggcgtttgcaagaactggccggagagcttgaccactgcaccctgaaaactaaaaagtccatcttttttttcttatctaaaagaatccatctttaccaaccgcaattacagtttttgtgtactgattttgattgcaatttcagaacttgatcaaagtgagggcccatgagagtaatttactcgttgctctttgtccagtttttcttttgcagattttttttcagaagtactccagtgctactactgctttactcgagcaggtaggcagagggcaggcagcgagcgtatcattgcttttctactgctggctttcgttctttctctgacaccgtggggcccattcctgcctggcactagatgagaggagaggagaggacagtcaaattctcgagcttgcccattccctcgcagcatcgcaatcgcagcggcagaaaccatctctccatttcctcgcgtaattccaagattgccagcttacttcgctgttctattcctcggggtgtgtttggataatgggttaagagagatgggattgggaaatggaaatgaatggatggataggatgaaatgaaatgagaagaatggatggctaaaattgaaacttaccttttgaggggtgggaaatcatatcccaaacccattatccaaacatggccttagagtttcgccattggcgatgactaggcggagaggagaccaagacccgcggtaaaaaaaaaaagcactccctttttattactgcacatatttactgtggtaacatccactgatccagagttaacaagaggatgctaatggctccttttgaacataggattttttataaaaaaaacaaaatgtgaaaaactatagaaatgattgtttggatggaatgaaaaaaaaaggtaagaattagatgagagaatagacataagagatttttttaaaaggttggacttcattttaaaactcctttaaaaccttcaaatccctatattgcgagccaatctgaaggaattttataggatttttgaatagctatgtttttaaatccaaatgctatgtttttaaatccaaatgaccatacagagtttctttttctatataattgaatccatttaaaatttcttcccaaaggtagcctaagaattggagtgatgcatagcttaatctgatgacgagggatgcgcgtatttcagtcgtcagtctaccaagtttctgcaactgcaacacagagaacaccaagaccaacaaccaccacttctgtagaataaccttttctgtctctcattttaatcaatggctaatgaactgtaagagcaggtacaatagcaggctattagccagctataaatatattttaataagataaacgatgagagagaag

SEQ ID NO: 28103 - DNA, 740 bp, Oryza sativa
aaacaattagatctttgaagtgtggacatgaacttgcctctatcgaacgcagattcagtgacattcccccatgacattctcggtgacattgtgtcactgacatatgggtcggtgacattgagtcactgacatataagtcccatatgtcagtcactcaatgtcaccgagaatgtcacgagggaatgtcaccgaatcccaatccctatctttaagctgcatgtgttgagttctgaagtctaaactccggaatgatatattgatatctttaatcaccttcagataatcaaatgaactcaaaatcaaaatgtttgtgcgtttttatgggcctctgctttagtaaaagaaaggtccagccaaggccctttaccccacacagccatgtgaaggagtgccttgagatcggtgaaaagaaacaagagaggagattcagagattctccctgctactgtagtaggcgaccatgggtgaaaaatggccccaaagcatgcagcctctaggtggtgagtggtcacctccatcaaaaacctccatggattcttctgatcttctcctcctcctcatatggtcccttgttaattatctcaatctccaagtgttaatcatgtggtactagtgcttacccccactgaacttgtgtttgaaacccattgaatgaactgaaggttggggttgataaatggtactaatgcttgagccaaagttttcaacgtagtaatgatcaattatgtccttgattaggg

SEQ ID NO: 28104 - DNA, 383 bp, Oryza sativa
tttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatctatatacatatgcatttgcataacatat

SEQ ID NO: 28105 - DNA, 1672 bp, Oryza sativa
ggtttttgatctagccctagtggatccccccttatttgaaatttttttatgattagtatttttattgctattagatgataaaatatgaatagtactttatgtgtgactaaatgtttttaattttttcacaaatttttcaaataagacggacggtcaaacgttgaacgtgaatagtgtaaaactgcacttattttgggacggaggtagtagtagagaccgtacgtattcatggactactagtactttatatggcctggtttgtcaaccaccacgttaccgctgtcgtgtgatctagctgcaggggagataatactcagtggacaggtcataacttgtgtgcatggagtatacacgaaaagcttatatgtgtatagaatgtgttcctaatctatacccttatagtatatctattcttcacctccatcccatctagccagggccgtctccagtattttggggcctcggggtgaaatgcaaagtggggccctataatttaagaaatcatgtctaatataaataaaacatattttcactcaattatatagatgcaatatgtgttctaatattatgaatttacgatatatcatttactagatcacggtttaatcttacccgtccgagcctccgaggtcgagctgttgagggtcgagtcaatgatgacgagcgggcgaggaggaggaaggcaggagctaggatacgagacaaggtagcaaggcaaagccgtcaccgctgccgctcgaagcgttggaatcacatgcagcaagttgtatcgctgccgcctcgatcatcgtgcatgcatggaattgggaatgacgtctcgtcgtctcgtctcttaaatcggcgtcacgcggaattagatagctcagcaaccaacatcaggacgaaaataacgatcgcacaacatcgtattgagtattgaatttgggcgatgaatttgggcagggcctagcattgttgatctacccattgggctattgcctattagctgatgttgtattgtattgctatacttgaagtgggccttcatatttatatgggggcccaaaaaatcgggggccctgtgcgggtacctatatggcatatggccatcgacgggcctgcaatgttcgacgatattttgtacattttttttataaatgaaagaaatgaagtgtgtcaaagtattaatttcgggaatggtgacataataacgaaattggtgattaattatcactaataacacaacctggcgtacatggcgtatacgtatgaatattatgagacacttgccgtcggctgctctagtatatacgtactcacgacattttgatatagcgtgatcgatccaatttcatggttggctgatggaaggaaaaaggtgtgaatgttttcatgggaatggaagcatatgccactgtagcactgtcattagaggaagttaatcacatcatttgccggccgttaatctctcacgtcatatgcatggaaaccacgtacatgcttgcatggaaaccaaggaaatcaaaagggcaagatagctctatatgaaagtttctttctatgagcagtgcgtgagcgtataagtatacaaggaaaattgatccatatcacgtcagattggaaacgaaacagataatagcagcaagcacttgagatttcacatggaaatactactctccgtatcaccatagaa

SEQ ID NO: 28106 - DNA, 1817 bp, Oryza sativa
gcatgtaatattattggagttttaatataagattactttatttgtaattagacttagtatgtaattattgactatggaattggtgcgacaagtagcaattgactattgtagtcttaattatacttagcatatacgcacgaaacacttagcatatacatgactattgtagtcttagcatgtaatattagttgagttttaatataagattattttatttgtaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagacagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaacccgccgttggacagaagagggcacgcgggcaacgaggtgcagcgaagaagcttgagggttgacacatcataacggaagtgcaagaagatgaacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacatgggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgaactgacactcgccctgcagactctagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatgtccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacatgtcccgttgatgacatcactcagcggacacaatgtgagctg

SEQ ID NO: 28107 - DNA, 1416 bp, Oryza sativa
ccaagaacaaggacccgggatacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagcgaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttattgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccattgggtgcttttactcttcgacctggaggcctgcaccgtcaacgtatatgactcaatggataaaaaagagtctacgtttgacaaggttttcgaacttatagacaggtaccatcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattg

SEQ ID NO: 28108 - DNA, 1301 bp, Oryza sativa
ttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatatacatatatatatatgtatgcatatatatgtattgaaacatatatatgcatggtttatatatatatatatatatatatatatatatatatatatatatatataaaccatgcagcaacagggccatgaaaaaaaaaaaaggtcagctcgatctttagtcccggttggttggctcagccggccacgtggctgagccatctttagtcccggttggtgttaccaaccgggactaaagatcgatctttactcccggttatttcacccgggactaaagatagcgatctttagtcccggattggtactcccggtttagaaaccgggactaaaggggggttacgaaccgggactacaaagggtttctccaccagtgagaaaagactgcccaccaaaccaaaccaacagaccatggagttaaaaaataactcgcggaaaacgtgaagcaacgaaccctcgcccgcaggaccaaacaaagctgaatgtgaagttaaattttaactaatactatgttgagttatgcgctgcggtgatttcgtcgttgagttaaaattttacctatgttccggctatatgaatgagtcgtcattaacttaaattacgggttggtggttatgtagttaaaaatttactggtagacgatgatctatgatgaaaaataacacagttattttgtagattctttttttatggatgtgtgttgtttctcatgacaaggaatgtgagttaaattttaacttatcgtaaactggtatgagtagatgaaaaactttgagacattaggcggtggtggcgatgtgtgacgtaattcacactttattattagaattttattgttttgatgcacatctccccagaaaattatgtcgatggaaa

SEQ ID NO: 28109 - DNA, 2329 bp, Oryza sativa
ggctttgtgggataggtctatcggaaaggaaggttgtcactttgatgtagccgtatttgatgcattatccctcaaatcttaaaatgaaaaaggctataaatatcatagtagtgtttcattatatatttcagtaggttgccctatttctatggtatatcccctcccccattagtttgaccttttagaataaatgctgtcaaactttgctcattattatgttgggttctatcttggtgatgaaagcattattaataaattggttattgaaaataatactatgaaaggtatatatttaaccataaattattaagaattaatgattaaaaattgcatcttgaggcccgcagcccacacatgaaactatatccatagccgttatggtttgcctttcagctagtgcatgttttaacgttgattgttttcgcaccgcaggacaagaatgcttttgctgaaattctgaagaaaatatcgaagattcagaagactaatggccacaattatgtcgtccttagagatgacaagaagtgaagagcaaaactaaagtggtgctttcttaaaatgcaaccttttgctttgctgtgccttttggcataacatgtttgtaagataagtgtattggaagaattggccttgtaacctgatgtatttagggcctatttggattgttaccctaccaattttttggtagtgccaaaatgtaggcaagttttggcactaccaaatctttggtaaagtaagattgcattgatcatatttggtttgctaccaatatatagctaaaatgtaaaattgtagtgaagaatattctagatgataccaaatctaaattaggtattaccaatgaataggcttcgatccaaattaaacacaactactattcaaattaccaaaatattggtagggcatgtttttggtaacaatccaaataggcccttagatcttttttaacttaaggtcattgatcacttatcattgttgctgccgcgcttttagacatcctactggaaaccagctgtttctaaaactacaggaaatttttggtacaaaatactcgctacagcagcggggttggtaagtaaaactgtagatttaattaatgttgagtagatttcacttcggacgatctttattactaccactgtcccaaaataagggcagccgtggatatccgtgcctaatgtttgaccgtctgttttatttgaaaaatttatgaaaaaattgaaaatatttagtcacataaagtactattcatgttttatgatctaatagcaataaaaatactaaccataaaaaaatttcaaataaaacaaacgatcaaatgttaacgtgaatagtgtaaaactgtacttattttggaatggagggagtagtttcatcatggattaggattagacctatgtttccgctcaacaacaatcctttgcgcttcagaccggggatcatgacttagacaacctctagtcatccatgtcccttcagtctaaatctgcacgacctctcctactccctgatgatcttgttgatccttcacgaccaccaatccaatgctccaatgtcccaatctatctatctatctatctatctatctatctatctatctattatattattaaaacagctttgaaaggaggcaccatattctgctgtggagagctagaagattatcgacattaatcgaagaaaaaatagaagaattcaaccgacgttggatctatgatggacatagattataacggtggagattgatcacactactatagaaatctagatttcgaatatgttttggagtccgtatgacacagttttaaaagaaattaaaggttagtactaatctgattccatgcgtggcttgggactaatgagactcggatttgacttcaagacccctccgacttgctgcttccataaaaagaaaaaaacaaggctgtagaaactatactaggtaattataaaaatggttttcaataataattccaaataaatttaaaaaatcatgaaaattcagaataaagaaggagtactatttagatatatctaaaaatcggaattaaaaaagaaaaataaaaggtgagttcaactagaaatacaatttaaaaataactgaaattcgaaattaaaaataagcactattcaaagaagagtccttataagaacccaatacgagattaattaatattcagaaaaaaaataaaatccaaaattattaaaaaaaggaaaagaagagttcgagtagaaattcaatttaaaaataaccaaaaattcggaattaaaattaagcaatattgaaataatagtccatataaaaacccaatacgagattattaagatt

SEQ ID NO: 28110 - DNA, 1941 bp, Oryza sativa
  unsure (1)..(1941): unsure at all n locations
atcgattcctgcagcgttttttaactgcaattcggaattaaatattatgtaatattgaaataagagtacatataagaatccaatagtagattaattaaatttttgaataaaaaaaataaaataaaatctaaaattagacaaattaaaaagagagtacaagtaggaatacaaatttgaaacaactgaaatttaaaataaaaaataataaaaatattaaaagaacacaatacgatatcagttaaaattcgaaacaaaagataaaataaattctgaaatttgaaaaagaaagataagatttcaactaggaatacaatttataaataactaaaattggtgataaaaaataaagactattgaaagaaaaagactatctaaaacatacgacgagattaattaagtaataggcctataaaggcgtagagtggtggcggttgaagggacatctaagaactattaataaatcaccaaatgacaattaaaaggaaggatgacgggcaggtcatgaagcaaccggtcaaggcggttggcaagacttctagaaagtaaaaataaaaaaaaaccctaatgataatcatatttgatttttaaaatctgaacgacaataaaaatgagaggcagcgggcgggtcgtacaggagtacaatggcggcgggcagagccgccgatggttgatgggacttctagaaagtaaaaaaataaattcaaacgatagttatgttcgatttttacaatcccaataacaataaagagtaggcggccggcgggttgtagaggagtacagtggcaacgtttgacgagatttctaaaaattataaaaacctgaaacccaaagacaataagttctaaaaattataaggtccgatttttaaggtttgtgcttctaaaagtaaaaaaaaaaacccaatgataattatgtttgattttaaaatctcaatgacaataaagaagggcggcagcgggcgagccgtagaggagtacaatgacaaagtcgctaatgttttggcagaacttttataaagtaaaaaatgaacataaacgataattatgttcgatttttaaaatactaatgataataaagagaagagccagtggacggccgtagaaggagtataatgacaacgtttgacaggatttctataaagtatactccctccatttccaaaatataaggcacaaccaccttaacctaaagaccaagaaatagttattatcatcttgtagtntagattatcctaataaatgtaatgcatgcatccaatagagttagagaatgtgagagtgaaggattttaaaaagtagtaatttaatggagaatatgtcatagttaatggcatgcatgcatgcatgccttatattatggaacatctaaaaaaagtggttgtgccttatattatataatggagggagtaaatgataaagatgaagcctaaccggacaataaacttctaaaattattagattcaatttttaaaggttataaggagaatgaatagaaacagatcgagcaagcaaataaagaaggatatgacagaaataaggggtagcaattggtgtgactttcaaaatataaaattagagagattaggatgataaggcatggtctttcaaaatcttaagacaacgagataactatttaataaattttaagtaaaatcatattaaaaaattatataatttacatgggtgctagtcgcgcaattgcgtgggccacccagctagttcacgttatccaatcaattgacggcccaagcatgtgccaccaaatcaccgataactgaggaaaatgggagccctcgcgccatggccgtgcgtggctgcgtcgctcgtcttcgtttcccaccgccccacgaggccatgacactcctatttcttctttcaaccagctacgcctttgtgcatgggtggatacggaattgctagaaaacttcagtatgttttttga

SEQ ID NO: 28111 - DNA, 3797 bp, Oryza sativa
aaaaccagagtaggaaatcggatgaaccagggtgctgaaccaaattggaccatccattcatgaataaacaactcagccaaaccggatcagatagagagaataacacatgaggattggaggcatcagatccacgacaaatggaacaataattaggtgctcaaataccatgattatctgcagttttttaacaagcacataaacatgccactacttgaacccaaattgtgtccgtatcattttcgatcttcttcaatttgggtatacaataactgatgggtgtacactttaaacttgtagtaaaggaacagaacaaagacatgccattgaggataccaataactcagtaaaatatatcagtttgatcgtgtgtagggatcacggtatgttttagtagcaattgaaaagtccataacacacctggtcagtgaattgaagaggattgaagtggcatttacacaaatcgctggtcagtgcgcggaggcgtaatagcatcgacaccgagccgttgtcgaggggtcaatcggtgccgacggcagcggcgatccagtttgcagcttttaggctgggtgagtgcgagggaaggcgagggccagtcgtccacagcgggttcaggcggggcaatggtgaggcagagcgcagtgggcggctatgccgaggggaagcgcggttaccggttaaggaaaggcggagctagcgtagacgggagaggggaagcgacggcggtaggagcgtggttgccggcaaggaaggcgatgggtcaatccacagcggcgatggcaacgtggagcgccgttaccgattaaaggggaggtggaggcggagtgcgtgcgcgagcgtgagcgctaggggtgggaccgaaggaggattgcctgtttccttcggagaatccaaaactcaatcccatgcgttaattcgagtggatcggacgggtagatcaagttgctctattagggcaagtattatgagccccttatcactaattccaagatgccatatagaatcatatgatgatatggagcagaggagaagagagagaggagcagccacccctcatacaagggacaacctccacaccaatttcaagaaataagagagaaagagagaagttgattggtagtaaatgtattgggtttagtgtaaggagatgcaatctattgtatgtattacctctaaattaatatgtagatgatttagacaaaattagatgtgaccactacctctatcatgaaacttgcccttatagtatagataaaagaaactttaatgttacgtggccattagagaagtgtcaactttgggatgttggcatgagaatcttcagtagattaactcctataagtttaagtttaagcaactccataaaacttaatacacatcttgaaccaatatgaactgcaatacaacagaaatcaccaagttacaaaatctaaacaaattacaggaacaggctctaggttcttgctagtaagtggaaacaaagaacgatcacaatattccaccacatttgtcacccgggacaataatcaaactgattgattattctcctggagtcctgggcgacaaatggacacacacatatcacaaatgacacgttaccaaagtgaagtgattattcagatttcatccactagacagagaacatatagtcacatgttcccagcaaacacaaaaagacacaaggtgtcactgtacagaaccaaggacgaaggtgtccataaaacacctagacatgcttacattgtcattaattaacaagccaagatatatcaggcacacgaggcaacacaacacctactaggactgacatatatagcttcataggcaaaggtagttagtcatccaaaactcggtaaaatcaccaagcatagctctcacaaccaccataatcaaatactatagggtcattcatcattggggcaacagttctgccgtcaataagcaaaacaaaagccaatttgttaatgacataggcaaacggaaacatcacaagatgagcaacgagtcaccgatataaattcatgccatagtcatatggtcagcaaagttaggccaaatccccataattacacatcataaaccaaaatgcaggacatgcgtgttcacattatttcgcttacaagaggtgatatagtcactctatgttatgtcaggaagcaaaaccgagcttttaaataatactactcaaatatgcaccttcatgaagaaacattaagaaaatacacaatacaaatttaccacccaacatcctatagcaatgttaggactacagtttatgcagtacgcagaacggcatgagaataaattaagcaaactgttattatttactcgttctatcccaaaatataataaattgtagcactcaaaatttgtcccaaatataacaacttctctacctatattctcttctcaaccgatcaaaatcttccgccattcaaattattcatccactttctcgtcaaccagtcacaaccttcccccatttaattctaccaatctatctatctatctattatatactaaaagtccattaaacgtcctataaacactcctaagttgccatatggcgctctaataaattataaaaaatcttagaaattctgagaaaaaaaaaacatctagccctcgattttacttaatacggtggacccattatgctacaccactagattatacagatcaattttaaaaagacaaaaaaacccaaaacccatcccgtggatctccacctccaccccggcccctccatccaggcctcctcttcacacgtacgtacacgcctaagtatgtacattccccatctagcctacacctatattttctcctttccttccttccatattccggttttctagctagctagcaaaatttaatacaaaagaattcaataattagctagctatataattataaattcaaagaatatattagattttagtttaatacatactcaacgttaccatctcatcgattttagatgatgtttaacagagcttgtaatgtattatagatagatcctcatgtatgtggcaatgggcttatatacctttagggtaagaacataagtccgtttattttctttctgcacaaaccaattaaaaggttaatcatctctagatatgagcattaacatgccacgaacatatttgtcctgcatatatacacaatgattaactttaagattcatttagattttatgatataccaaggtatggaaaataggactaactaaacttgatcaagagtgtgaacacaacacatgacaattttcataggtgcaaccaccatatctcagtatctacagaagtttcgtaacatggggcacaatgatcaggagttaaacgtatactagatgcacacaaaaaaatattacaaatttatcttgaaagaatttattgagtcttttgaacacaaatatttttagggttgttttggaattgaaagtgcatctaggcccctaatgattttggtgattaataacaatgcgattagagacgactaacattttcgtttgagtagatgtgaggattgttagttctcggcgcaccatgtttccatgccaaactcgataatagctacaaatccaagcgatgcggcatatgagcaaagggtatattgtacattttaatttctttgtgtctttaagaaagccgtactattagggggggtgatgcattgatgatgagtgatgtgggtgctcaaaaatcaatttttcaaagtgtttcttctcattttctctgttctggaattttctggagttgtctgaaacaggttttcagaatttccaaaaatttacagaa

SEQ ID NO: 28112 - DNA, 9556 bp, Oryza sativa
accgcttatgtatattttcggacatgtccgaaagtaatttttggaatttctgaaaatatctagcaggcaattttggttctggatattttcggatttgttcgaaatgttttcggaatttccgaaaaacttagttggacttcactgtgtttgctgttctggagattttcggacttgtccgatgctaattttcagaatttccgaaaaatggaattattgcacataacgggcagatatgaagctgtggctatagatagcctcctctcaccaagtcaaggctgctgctctcattgaaaacttgtgcccttggcttactactcttgagatttacttttgagccttgcttgcttgattcccctctccacccgtgtttgattcggatttggtgtgtgtgagagttgtggtttcgagcttgtgtgagtgcttggtgttgtcttcgtgaagatttttgagcacttgcatcattcccgggagttctttgcatcatttattactcttggaggttaaggacttctagatggctaggtcactcttgagtcaccgatctacgtgtggttggccaagagaagtttgtgaaggtcggatctcacctccgaaagggaagagaaaccactagtggaaggaggagtgctttgtgcaatctcttaaggaaagggttagcgaagacccggctcctcaatagagagtagaatcccctcaaggattcgaatttcgggaacatctcatattgcatcaacgtcaatgatatccctttctccctcctctagctttgcttgtttgcgccgctataagtctattgttgtttgtgctagtatttcttttgtgtaggcagctagatctagcatttcatttcagttgcgcctgctatgttatttttggaatttccgaaaatcattttcggaatttccgaaaagtgttgcttccgcatttacttaagtttttgaattagcctattcatcccccctctaggcctaattgaccctttcaggaattatatttagctgtttgatcgtgtttgtagttatatttagctatttgatcgtgttcatttttgactacgtggagcctctctgcatgaaactctcatatgggttgtccggcccccacccaattcactaaacagtgagaacatatattagtcttagctgcttatacaaaagccatttttttttaaaaaataaaagtttatacataaggtggaacattgtgcaactatttatcatcccacaaaatataaaagataaaataagaccagtataaaataaaatagaaaattaattatatcaatagggagtaaagtgatctaatttagagagaacctattttacttagcttgaaacatccatctctataagcatagcattgtaagtgcttagatgcgtattcgggaaaaagaataactgcttagatgctaatggtgttccctttatcctatatagttaaggtttctccacaactttttttaatcaatactgatgaacaattttttttggtgagaaatcatacttttgaatcgtggcataattaatccagtttccacccttataaacatggcatacgatacatgcgtgcgcaacaatacgagctaacttcctagtttccttaatactagtgtccaactctaaaaatacttatattttggaatggaggtagtgaatattttggatctgctaagttcaaaaaagattatccgtttctcaattacagaccatgtaattgaagaataatattggaaatgatatgtcatatgtaggacagttcatcaaggaaccaagcagttaaaggaacaataaatgtcactgagcaaataaggcattaacaagcaaccagcaatcgaaaacaacatgatttttctatacgtacagtgtaaaaggcatggcaaataattacctttagtataaaaactagtgaatggatgacagatgcctactcccggggcttggggaagaatcttaaattgcagactccagattaaccatgaagacaccaatagctgttgccagaaataccacattatgttcctcagcaaagcccagaatattcattggtgccggtgtatcagtatcaggccttggttcgaaaggaaggagcctgtccagttcaatagttttctccagcacccatccagcagcagcactgtcactattgatcttatgcttccatagattgagactaaaatcccgcacagcaaggaagagaagcccaccatcctctgctggtgcaatctggtcacctccatcgccatgcatttctggtagcacatcgatctaggctggtatttgtgtatccaaatcaaactgaaggatgacggtcccaataacactttggaacaagcaataaaaaaaattcccaaccaggggtactagaacgagtcttgtgccccctaaaattaaacgcatttgagatgaccttgccccaattgccggtgtcggatgagtaaacgcaagtgaaaagccgcctccggtacttattgaagcctattaccaccacctcaaagggactggagtggcagccgccgtgcacatgcccatccacgcatcgcatcgcccagttggagacgtacgccggccggcgaccgaacggctcggggatatcaacggcgcgccggtcgccggtgacgggatcccacaccgtgatttgcaacaagctccggtcgtagataagggcgcggccgtggcggaatgcgaacatatggtaaaagtgaccaaaaaccggggggctgccaccgccgccaccggggagcgggagctgcagggagaaacgcgccgcggagatccggtccggcgggtccagcgtggggatgaagatgggatttctgtagctgaccttgaagaagccgaggaggggtggcttcccgtggtgggatcggaagcgccggaggaagacggcgtcggagacgacgcggcgccaccgcttgcagacgagggaggcgcgggggagggaggacggcttcgccgggaggcggaggaggatctcggagaggaggtcgtcgtcttccagtggctgcgcctgcgccggcgacggcgaggtggtgcggcgtcggtggctggtcatctccgcctcacacactactctagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcctgcagtgcactgtgcgcagtgttttttttttttaaaaaaagcaaaggaaatgtataaggaaaaaaaaattaaaaatggaaataaaatgtttaaaaaaaagtaatgatttactaatgttaaaaaatgaaaaaatggtatttaaaaaatagaaataaaagttttttaaaaaagtaatgatttgctaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacttaagccctaaaactctcttttgtaattgccaatcatcatcaacaaaatgaacaactacgctaagataatcctctctagctctactactccatatatctgaagtaacacaaacagagaaaatacatgtactaaacagttccttaagtgcagttgctttcttgtgataaacattctctaaatctctagttgatgtttgcctactcacagctttaaacctatggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaattaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccacgtggcggcttcccattcgaccgcgcgcccgccctgtcagtgcgccgctggcgctttcggcctgacgggccgcccgggccgtgccgtgccgcgggccgtgccgtgccggcctgctacagtagccgtgccgtgccgtgccggcccgcgggctcggccaacggcccaagcacggcacggctacacgggccgtgccggcacggcccgttactgtagcaggccgtgccgggccgtgcctgctacaggaacggccgtgccccgggccgcccgtttggcccggcccatttggccagctctacactactccctccatccaagattttggttggacgtgccatgtcctattacaataaatctggacactcatgttagattcgttataccaggatgttgtactaggatgtgttagagcatctccaacagcctctccaaatacctctgctagctactctagcaaaaattactcatccaaaagcctctccaactggatggccggctggccaaaacactccctcccttagccaaatttgaccagccaaagtgattggctaacggtgagccccacgggcattcctcctcccaaaacacgcaccgcgaggggagatggatcggggcgacgagcggcttcgccgcgcgctggcggcgttcggaggcgacggcagcggcatttggagtcgagggcgcgacggcgaaatggcgaggccatcggtggcgtcggggtcgacggggcggcttgacggcgcatgagtccttcttcggcgtcggccatcggcggcatgatgagggcgacggggtagctcgacggcgagccgacgagggaggaacgaggaaggccggcggggagcggatcccgtcgttgcctcatgcgcccatcctcgtcgtcgtctagcggcctggtgccggccatcgtcgcatgaaaatagcgtcgccgccgccggctccccatccacgtgccccctcgactcgaggcaccgcctcctcatccgctgggtgggttggagatgggagggagtggcagtgacggcattgctcgacggcgaggttgagggagatgaggcggccggtaagagcttggccagaggggcaccggtggacggagcccgagcatcggcggcgggcggatagggatggggcggcggcaacagaggggagagggaaggggattttgagagaagtggaggaagaagaaagtcgtagagactgacacgtgggctctattatcatagactcagcataagcatagagaggatgaattggaagcctgttggagtaaaagagagtttgactagctaaattagatggagagttggccaaatagatatttggagagtgacatttagagagactgttggagatgctctcacctccaaccaaaatcgcttatatttagggacggagattatagtggtgtaatactgcactcttctctaatgtttggttagttggatgacttatgatgtgagatcttgtttggtcgattgttcttcctctatccaaaagtttaatacctattttttttcatcaagactaatttgtaattaattcattcatcatgtgataaaatcgatgaacatgtaaccaataagtactaaaatgacttcttgggctctcctaaaaaatttaatataccatatagtgactacaaatataacttatacttttgaaaaaaccaatgaatgaaatagaacttagacttttggatggaggaagtacttacaaatgctgcatactgcctctattccaaataaatgaatcagtgtctagattcattgtactagaatgaaatagaacttagactttgctacatactccctccgtcctaaataaatgaatcagtgtcaagatttgttgtactaggatgtgtcacatctagaactaggttggttttttattggacggagggaataccagagatattctttgattgttcgtatcagatcatagtatggttacctcctcttttgtagggtgagattaccccagcaattatggtgtactattcaattgcagttctattacttttcaattagccaaattttgttaaaatctgttgcatatgtaatgggtgaaaatcagtatgaagaattatataaaacaatgaattgtgctgcaacgataaataattcgctgcttagtctgaactttatatacgctataacatgtgagagaaaatgaaaaaaaaacagagaaaacgatagaaaagaaaaaaaatgtgcatctcgtcgtcgtcgtcattgtggagattatgggtatcccatacccacacggcatggttatccgactagtcatagggatagcttatatttatggaatatgtaacaaatcatgacttgggtattccgtttccatgtatattatggaacgacctaaagttctggtttgataatagatttaggaaaccgataccgtattggttaaggtttctatcttgtaatcctggccccccatcctatataaggtgggcaggaggccctctagggggcatgagacaactagatcgtcagatctatactacacccggcggattcaaatccccaaacaggagtagggtattacctctcattaagagggcctgaacctgtctaaatcctttatctccgcatccatccacttttaggtctcgtgcgctacccccttttcatattgccgaaaatttgtttcaacagttggcgcgccaggtagggggcgctgagttttccgactagtcatagaaaaattttctttatacgatattttccttttcctctgcctcactagatcaactggttcgccgttgactagtgagtcgggggctacatatgttatatcagattttttaataattttttatagtatttatcttgattgcttgcgacataatctgtgtacaaaagtgcctatcgaattatggagttctatctttctatgctttccgtttggtttgtcgatggatagttgcctttgagccgattcctagcacccgggggcccgttggatggaccgagtaacgcaaggtgctaagtattattcggaataaatcaaaagcatagagataagataaatttattttctgctctttacaattgcaaaagtacccgagcagtaaattctgattcgtgaaactttgttctattaatgacgaactcatgtcactcatacgcatgtttgggaagtgcctaggccgactcccgatgcttgggg

SEQ ID NO: 28113 - DNA, 1327 bp, Oryza sativa
tcagtcagaacatcaccaccggctcgcccccgtcaccgccgagtggtgtcctcgcctatacggttgggtggtcacaccaccgttgttgggcgtcattgtcttcaccgaccggccgccttcgtccgccgccgactggtgtcctcgcctatacggttgggtggtcacaccaccgttgttgggcgttgttgtcttcaccgaccggccgcctcgtccgccgccgactggtgtcttcgcctgtacggttggttggttacaccgccgttgttgggcgaatacgtcttcaccgaccggccacctcgcgcgccgcacactggtgtttccgcctgcacggctggcctattatgccgccgttgttgggcgtctacgtcttcaccgaccggccgcctcgtccgccgccgactggtgtttctgcctgcacggctggcctgttatgccgccgttgttgggcgtccatgtcttcaccgaccggccgcctcgtccgccgccgacaggtgtttccgcctgcacggctggcctattatgccgccgttgttgggcgtctacgtcttcaccgaccggccgcctcgtccgccgccgactggtcttgccgcctgcacggctagcctattatgccgccgttgttgggcatctatgtcttcaccgaccagccgccacgtccgccgctgactggtgttttcgcttgcacggctagcctattatgccgccgttgttgggcatctacgtcttcaccaccggcttgccttcaccgccgccgactggtgtctccgcttgcacggctggcctattatgccgccgttgttgggcgtctacgtcttcaccgaccagccgcctcgtctgccgccgactgatgtctccgcctgcacggctggcctattatgccgccgttgttgggcgtctacatcttcaccgaccagccgcctcgtctgccgccgactgatgtctccgcctgcacggctggcctattatgtcgccgttgttgggcgtctacgtcttcacctgtcacgccctgaagttcccctttctagctttaaaatttgtaaaataaatcgtccgaagaaattgttcaatttaacctagagctaattcctcaaattaataaatgcaaataataatcggaatcggcatgtggaatttttcttggattctacatgtcaaaatatgctaacaggatttttagtggaattttcagagcattggaaataattttaaccaattaaaataagcaaagtgcaatatttaaatccctagaaatccttttccttttctttttccctttttccatcctttttccccctcttttcctcctttgggccgccggcccatctct

SEQ ID NO: 28114 - DNA, 7593 bp, Oryza sativa
gtcgtcaaggattgcctgtggaatggaatcgcccgctgcgggagtcaagtcttcaggcttagctcgcttttatctttttccgctgcatttgtaatcttttgtatttttgtaagatgtggatctgtatgtcaacaattgtcgtttgtgtaccctggctggtcctggacaggggtttaatacacattcagcttagagattctggttcgtgaatttctgggcgtgacatcactgaccggccgcctcgtctaccgccgactggtgtcctcgcctgcacggatggcctattatgccgctgtttttgggcgcctacgtcttcaccgccggcctgcctccgtcaccgccgactggtgtcctcgcctatacggttggttggtcacatcaccgttgttgggcgtctacgtcttcaccgatcggttgcctcgtcgccgccgactgatgttaccgcctgcacggctggcctattatgctgtcgttgttgggaaactacgtcttcaccgaccggctaccacgtcgccgccgactggtgtctccacctacacggatggcctattacgccaccgttggtgggcatcttcgctttcaccgtcaaccgcctacgtcgccaccgactggtgtcttcattgttattgctggatgactttgttcccacattggccacctctgccattaccaaggggaatattacaaagctaagtcatcattgattttctttatatgatattttcctcttcctctgcctcgctacatcaactggttcgccgttgactagtgagtcgggggctacagatgttatatcatattttttaataatttttcatagtatttatcttgattgcttgcgacataatctgagtacaaaagtgcctatcgagttatggagttctatcttcctatgctttccgtttggtttgtcgatggatagttgcctttgggccgattcctagcacccgggggctcgttggatggaccgagtaacacaaggtgctaagtattattcggaataaatcaaaagcacagagataagataaatatattttctgctctttacaattgcaaaagtacccgagcagtaaattttgattcgtgaaactttgttctattactgacgaactcatgtcactcacacgcatgtttgggaagtgtctaggctggctcccgatgcttggggcctatgactagtcggacagagtgtttaaacgtgctgagtcatctgctcggggaaatcaaaattgacaagaggagaaatatatatttataaatatttttaaatacttgaattttcctcgagtattatatttgtatcagatactactcatcctatatgtttgttctacaggatccagatccagatatgcataaaagggattcatggctttaagcttatctcctacgcttcaggaatggatcagccagaacattaccaccggctcgccgccgtcgccgccgactggtgtcctcgcctatacggttgggtggtcacaccaccgttgttgggcatcattgtcttcaccgaccggccgcctcgtccgccgccgactggtgtccttgcctatacggttgggtggtcacaccaccgttgttgggcgtcattgtcttcactgaccggccgcctcgtccgccgccagctagtgtcttcgcctatacggttggttggttacaccgccgatgttgggcatctacgtcttcaccgaccggccgccttgtccgccgccgactggtgtttccgtctggacggctggcctattatgccgccgatgttgggcgtctacgtcttcaccgaccggccgcctcgtccgtcgccgactgatgtttccgcctacacggcaggcctattatgccaccgattgtgggcgtctacgtcttcaccgaccggccacctcgtccgtcgccgactggtgtttccgcctgcacggcaggcctattatgccgccgatgctgggcgtctacgtcttcaccgaccggcttgccttcgccgccgtcgactggtgtctctgcctgcgcggctggcctattatgtcaccgttgttgggcgtctacgtcttcaccgaccggcttgccttcgccgccgccgactggtgtctctgcctgcacggctggcctattatgccgccgtttgttgggcgtctacgtcttcaccgtccggcttgccttcgctgccgccgactagtgtcttcgcctgcacggctggcctattgtgccaccgttgatgggcgtctacgctttcaccgagcggttgccttcgccgccgtcgactagtgtctccgcctgcacggctggtttattatgccgccattgtaggacgtctacgtcttgtccgaccggctacctcgtatgacgccaactggtactatcatcttcacggcaggccacgtcgtagccaccgcaaataggcgttatcaccttcaacgcaagctgtctacgtctgctgccgactggtttcttcactttcatggctagcctattatgccgccgctcaacctaccggagtatctatcttcacaactacacgtcttcgccaccggtttgcttctgttgacgccgactcgtgttcacttcatcacggctatgcaactttgccaccatggtggagcgacttcatcttcggcacctgtaaactttattgcctctactttgcaagctttgctacttcatcgatcacgacgtctacaagagcctcgacatctcggcatgcgtcaacaaatataatgctgtattattttactacaacaagtggtgttccaatattcaatatttctactcggacatcttctatgcgtatcttcactcaagcaatgactactcgacgacaagaagctacagttcctgactctatgttcagttgtttcccaactaaccaaagagtcgggggctacacaaatacaagactctcaaaattcgacaagctgaagcaatcaattaatccaggagtcattttcttcatctttgcttcggagcagacgttctacttcagcaacttcaattatttcatcgacaattttggcttctcagcgtgatgagggatatattttctctttctcagcgctgccataatctactccaaaattctcaagtatcaagttcaagatttaatctacatgtttaggagtatggagttatcaaccaatcaactcagattcgatgagttagacaacaacatctactttcctccaagtgaagcttctgtaatagctataacaccatgttctactgccatctttacaaatcaaggggtgtggcatcaatcttcgttatgcacacatcaagaaaattacttgagcttcgatgtcttctcaacagtttgatggattattgtcattgacatcatcaccagcacctatacttcatcggccagacgtctccgccgttactaatgggtgactacatcttcgtctccggttgcttctgtcattgccagcttgttatttcgccttcacggttgatctactacgcaaacgctgatgagcgtatttgtcattatcatcggctactacaccgctattgattggatcgccgacaacgtcatcttcatcaacatcctgtcaaagcttatttaacatagccaactctattgctattggtgggaacttcatcatcatattcgatcatctctgttgctgctaatcgtcattacggtcggttgtgtttgtagtcatcgactattttcttcatcttcatgattgatggatttcgccatcagcgttgatgcgcgtctacatcttcatcgtcgggttgctttcgtcgccaccgactgctttgtcgttgttgttgggcaccttcatcttcactaatagctgacttctctgttgccgactggtttcttcgcctccatggctatgcgacttcatcaccttttattggtgtcattgtttttactaccaccaacatcttcgtcagctttgatggatgatatcatattcatgttggtcatttcatctccatgctgactgcatcagttactatcaatggacaaatgtgactacaacagaaggataagttacatgcttaggggctcatcagcacaagcacgaggattatattttcaatttggacttcttccggatacattcaacatgaattcatgatcatgggtctattttctatgctcaaagactggactatttattattccccgtaagggttattaactaaatacttgcgtcagtcgggatttaattattatatctattttggagtataccataagggataatcacttagatcataagctattcagatgagctacacttggtctacattacccggaagatttattactcgggagcatgttacatgcgtcatcctttaaagggtgtcctaggcctaatatgtctgtagcccatattttcaggtgtggcctgtcacgttcttttagggacttaggcactttttgcttagaccaaagtgcgcgtgatcaagtgcccaataccttaaaatccttttataccgcagttactcaactttttaggagttggtacaatgcatcttaaaaggtgtcaaacagtaaagctatatagctatcccgctgacttttttatataagtcaaggtgctgtttgggttttcaagcaattgattggatataatatcgttgctttttgccacgtaagtgtgcatttttattgaccaatattatggcttaggctgattatatatcttggtcattttccaggcggttggtaaatcctttatgagtttatttactcggattttacaccacatatgccgtatatttccgggtatggtgaaaccatgtgtcttttagggatttaagcacatctgttaaagcagtgtgcgcatggcgtatgctcaatactttagaaatttctttattcacggcattcaaacttttttatagctgttttgctatgtgaattttcaatgatgtagtcaactttaggttgcacgcatcaatttttacaaagcagtcggtatatcacttggatcatgttattttggggattcacaccgcatatgctatatattaatatcaagtcacttggttgactatatttaaattattcatcagccctccacagtctttagatttggtaaaaagtactcgggagatcatggcgaagatgattgaagcactcggctttggagtaatctagttcgagagaagattatctttttgactgtgaaggtctcaggggctactgtggagattatgggtatcccatacccacacggcatggttatccgactagtcatagggatagcttatatctatggaatatgtaacagatcatgacttgggtattacgtttccatgtatattatggaacggcctaaagtcctggtttgataatagatttaggaaaccgataccgtattggttaaggtttctatcttataatcctgccccccatcctatataaggtgggcaggaggccctctagggggcatgagacaactagatcgtcagatctatactacacccggcggattcaaatccccaaacaggagtagggtatacctctcattgagagggcctgaacctgtctaaatcctttgtctccgcatccatccacttttaggtctcgtgcgctacccccttttcatattgccgaaaatttgtttcgacagtcatcccgccgcaccaatcgccaccgcaactcctttcctccactgcaccgattgccgccgcagctcctctcctcctccacaccggttgctgtcgtcctccacccgctacgccagtcatcatcatccacccgttgcgccagtcgttgttgtcctccacccacttcactggtcgctgccgcagccacctctcctcccctgctgctcgctaactccccccccccttcaccgccccgcctcttgccaccagatttggtggcacctagcctgtagcccccagacctggtggtcggtggcggaagaagtggcagaagaaggtgcaggacggcagcgattgaagaaggtggccaggtggcttgcggcggcaagccatgccctccgttgagctcgtcaccgtgccctcccttgagctcgtcgctaggccatcacctctggctttgctctgtggccaggaatgaggagaggggaaagggcgggacggtgaccccatcgcgcgccccgtgcacgcacgggtgcaacacgctgcatcaggcgggccaggacgagctacgaagctcgattcccgtgtttctgctcagcctagccaagaggccactttcgcatcgtctcattctggctcacgtgctggtgaaggctaccaaacaaacctagtggattcctcacggtcacgcttcaagacaacaaaggtaataacttcaaggtaaatggtcatcgcttaagagttttcctaaatatagttgaggggttatgataggaaatacacttagtggatttggtcctttctctaaagtccatcctaagcctattgcaccctgcctgagccggggtgctctggggcctagggtggtttggccgaaccaagcctggtgtcaccaacccccaaccttcactcatctcggcctgctggtgtcccccttgctatcactggtggatcataatcaccctgttttcaaacttttcatcagtctcctctgttcttttcttccacctccgagttcatctttctccccttctcaatttctcttccgaaatccccaaatccatggctgggaagtgtcacgcccagaaattcactagtaatttccgaactaatttgtgcataaaatcctcgtccaggaatcagccgaggtacacaaactgacaattttaatatacaaacccatcataataataacgttacatacttacaaaagaaaagaaaacaacagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaagaatggcataatataggctcatttgcaaaagcagcatttagcaaagatttaagataagtaaaacagtagagtaattaatcatcaattttaatcaacactgaacagcacacccatgctgctcaggcccaaccaaacctgaacaaccaaccccggtcgtacagatcaaacctccaaaccaggagtcaaattaattctcaccttattaacattgatgagtagtgtgaaactaatcacgaaaaacattgctcaactcgcccataaccgcggtggaggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaaact

SEQ ID NO: 28115 - DNA, 29445 bp, Oryza sativa
aggaaaaaaaggaggaaaaaggaaaaagaaaaagaagaaatgatttttcctgggattaaaattgcactttggtgatttttaattggttaaaattatttccaaggctctgaaacttccattaaaaatcttgttaatgcattggagcatggggaactcaagaaaaattccaccacaccgaattcaattattaattgcatttattaattagggaattagctctaggttaattaagataatttcttcggacaatttatttaaccaattttttttaaagcaagcaaaaggggaaacttccgggcgtgacaaacctaccccccttaaacggaatctcgaccccgagattcggaagagctggcgaagaggtgcgggtgggtggccttcaactcatcttctctttcccaagtggcctcttcctctgagtggtggctacactgaaccttgcagaatcttattactttgtttctggtccttctctcgctggtttcgaggatacgagtcggcttctccacatacgtcagatcttcctgaatttcgatgtgatccggacttgcctgttcctcaggaactctcaaacatttcttcaactgagagacgtggaacacgttgtggatgccaagcatgttggagggaagctcaagctggtaagcaacttcacctctacgttccaagatcctgtatggtcccacaaagcgtggtgccaactttcctttggtttggaaacgatgtactcccctaagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaattggcgttcccctgtctgatcccagaagagcggagtacgacaccttcgtccatacagtgcttcaaacggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacaatcttcttaggtacaccatgtaaacacataattcttgccagatagagttctgctaatttcttccctgagtaggtagtgtgcaccggaatgaagtaagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacattctggtactgccgggatgaatggaatattgagtttgatgagcctcggttagtatcaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccatcagtgtgggctgtgcctctagggcagccacgaatccgcgctcaactattccaaggttcaaatgttccaaatcacgttgaacctcacagcatagttcctctacccatgcgacgttgcagtaactcttcctgctcaaggcatctgctaccacattagccttgccgggatgatagtgtattcccatatcataatctttaattagctccaaccatcttcgctgtcggagattcagatcaggttgggtgaagatgtactttagacttttgtgatctgtatatacctcacaacggttactgatgagatagtgccgtcaaatctttaaagcatgaacgactgcggccaattccagatcgtgcgtcgggtagttgccttcatgaggacgcaactgccgtgaagcataagaaaccactttgccatcctgcatcaacacacatcctagcccctggcaagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagttggtgctcttttaacttttcaagtaccagccgaagatgctgctcatgttcttcctcggacttggagtagataagtatgtcatcgataaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaatgcacattctcttggttttgtctttcttctccacaaagataaccggagcaccccaaggcgacgtgctcgggcggatgtatcccttctgtaactgttcatcgacttgcttcttgacttccgccaactcgttggctcccattctgtaaggcctcttgtggatcggtgcagttccaggtaccaagtcaatccggaactcgatatccctctttggtggcattgttgtcagatcgtccggaaaaacctctggatactctctgactatgggaatatcctccagcttcttagtgattttctccactgctacctcttgttcttcaccagcagcctggtttaaactaatccctggcttccgcggcactagagactgggaggttaccacctctccttttgcattggttaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccactatggtggttcttgttgaagctacccgggtggtagggacagtgctgtcggataatcatggtggaaggtccaccgtgacgtcccatcgtgaaacgaggcttctgactcttcccctggggagtcctgaactgagctgccttcctcttacggtttattttgttaccgtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcgtagcgcgcgaggcggttgaactcatgcaaatactctataactgttctggttccttgttgcagggaacggaactctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctaacaatttggactgaggaggcggaggaccaaattgcaggttctgctgctgcagctgtgcttgctgctgcacctgctgcatcacctgatggtactgttgctgcatctgttgcatcatcattgtcatcatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaaagagggataggactgacatctaaagtagacaagggataggaaccaattcatgctcaaatccaaattaaacaaagcaaaagaagactcaaataagtaaccgagcatgatgatttttatgcatagaacatttttcatgaactcaaataaagacactaatgcaactaaacagtaaattaatgcatagactagttgcatggaaaatgatgcgcataacattgcccccatcggatatagacacgacctaatgcataacccccaataaattcccgactgactgtcgaataaactccaactaaaatttttctaaagccctagactgagctaattttttttaaaaaaaaatccgatctgaaagaacgaccaagatttttcccgcaaaccaaagaggcaaaactccaaattttcccaaaacaattccaggtgcaaaaaggcatatgcagatgaaaaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacactgtccaacgctacaccacgttgcaacaggcccaaccaaccacctgaactacagcagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacaacccaccattcaatgtattttaattaactaacaccattgcggtggcaccaatccaaagctatgctcatagtcaaagtctatgtaataatgtgatccccatgtgtgtgctaattgaactaagcatggctaagcatttcctaaaccaacatctagtcattttgatacccaagttatcaatggcataaggtaaacaataaatggctgagtattaggacccatcccacatgacattgtaaaaggatgcaacatttaatagaaatacgggatatttgtaaattgggtacaatatgatcaaacgtattgcatgacttgccttgctctcgcactgacgagacctcagcaacgtcttcgagaaaccgtggatcgacgaaacggccgaaacctaagcgacgaacaaagcacacaagcaaaacatgctataagactactgaaacaggaaacaaaactatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcgaggggagggggcggcgccgacaggcgggccccactggtcagcggcactaagggagggagagggggcggctggcaagcgggccccactggcagcggcacaaggggagagggagggggcgtcggcatgtgggccccactggtggcggctaaaagggaggggtggtccaccggctggtgggccccaccgggcagcggcacagggcgggagaggggcgtggctgttggcttggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacgggggagaggaaaggaaggaggaaaggggattcctcaccgaggcgatggcggcgaccggcgtgggaagagacgagcggcggccggcgcttccgacaacggcggacggggtcgagcacaacctgggaaaggcgatgaccgggttaggggaaggggaggatgaccacggccactagagcggccggccggagttgggtggaaatggagagctcaccggcgtgcgagagaagcggcgtttcggcgacgattggcggcaaccgagcggcggccgaggtagctctcgcggcggcgaagctaacggcggtggcgggttggcgcggcggcgaccctagcggcagtggcgcgcggccgaaggcgacggcaagcggcggcgctagcaacaagcggcgcgagctcggtaggaggcacgggaggggacgggaaatgggtgaaacgagagaggggactccgggaagggtttttatgggcgaaggaggggcggacgtggccggggatggcccctatttggccggcgatgtggggagtggagggagagtgagagaggtgggttcgaaatcgaatcccgccctctcgagcgcgcgcgcgggccgggagatgcgggggaagaggcggcgacgtgggggggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcctggagagagggggaaggagaacgggccggccaacaaggggaggccgagcgcgggcgacgggtggactgggccgacggcccaacaagaggaaaaaaaggaggaaaaaggaaaaagaaaaagaagaaatgatttttcctgggattaaaattgcactttggtgatttttaattggttaaaattatttccaaggctctgaaacttccattaaaaatcttgttaatgcattggagcatggggaactcaagaaaaattccaccatgccaaattcaattattaattgcatttattaattagggaattagctctaggttaattaagataatttcttcggacaatttatttaaccaattttttttaaagcaagcaaaaggggaaacttccgggcgtgacagtacagttgcacgctcatcactgaactacatcaatgacgggaatgcaaccatacctacacacaaaacaaacagcagcgttctaccctactaactattcttcaaagatagtttggcggcataggttctaaggtaggatccaaacttcattccatcttgaccacttggcacttcagatcgatcatcacattcatattcctcgatccactttacttaacctccataagtagacctcattggcgtcttcaagtttcaacaactagtttcagaactactcaagttgaacgagagaggagagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccagaaattcactagtaatttccgaactaatttgtgcataaaatcctcgtccaggaatcagccgaggtacacaaactgacaattttaatatacaaacccatcataataataacgttacatacttacaaaagaaaagaaaacaacagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatacaagtgcacaaggataccaaaggatggcataatataggctcatttgcaaaagcagcatttagcaaagatttaagataagtaaaacagtagagtaattaatcatcaattttaatcaacactgaacagcacacccatgctgctcaggcccaaccaaacctgaacaaccaaccccggtcgtacagatcaaacctccaaaccaggagtcaaattaattctcaccttattaacattgatgagtagtgtgaaactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaatacccttcgcacaacacaactcactacagtgcaccattcctggatgataatcacccccttataaaacaaggcatggactccccagcgacccccacggacttctcgccgcttcacagtctggcacactataatgaaccatgctatacaaaaggtaaagccgttgcccatgctggcttgtggttggcacggtaaatgtttcacaacagtagctcgcgaaccggtccttaattgtcatgagcacaaccatcaaaaccatatgctcacaacccaccttaaccaggttttaattatcaattaattaacatcacacgattaatcatcgtgagctaccattaaatataaccataattaaaataataatgtaacatagtttctaattaatccctttagttagctaatgtttctaagcatggctaagcaaacttacatatagcatttagctgaaccaatccaacatataaggttcatgctaatcaaattataacccataggaaaataagatcatcttcggccattaattaacggggaaaggttcaccacccgatgacattaaaaaataatgcatagttgaaataaaataatagctttaaacgggttcaacatgctcaaagggttgtttgggatctgtgtgacttgccttgagtttccgcaaacacttccgaaccttgctcaatgaaaacgctctccttcagaacgtcggaaactaaagcaaaagaataaaaatcaacaaaacagtacaaaaacaagcataaacagtacatgtggatatttttaacatgtagatcttgattttagaaaaatttagcaacttgaaccactcgaatcggatctacagttatttagttatgattttccgaagatttaatctattagaaaaacgggaaaaagaaaaaccgatgatgtcatgatgacatcatcaaaggtggccggctcggattggcgacctcgccggagctagggtggtcggccgggattttggagaacacctacgcgtagaggacgacgagacgaacccaacggtactcaccaaagcgtccaacgacgagagacggcggccgacgacgagcttgtgcggcggcggcggttcggtcgacggcggcgacgggtctccggcgaccggcgacagcggggagagggcggccgaggttcctcacctccgtgcgcacctaacggcggcgaggggaagcggcggcgacggcggaatcgacggcgcggcgcggctgggcgtcggccggcgacggcggcggcttgctcggcgtggcggcggcgctacggagcacgagagaactcgggagatggggcaaacgaaagaggaggactagggggtcctatttatagccttggattgaagagatcggactcctcccgcaagaaatcgatccgggaaaccaaaaactcggttttggagataaactcaaaaacgagttcgattcggataaaatactcaacggtttgctccgattcttgggggaaagaatagagcaggataagaggaatatttcccctcaactaattttgcaaacggagctccggatgtggcggatttaacggaggaagcggcggctgcacagggcacagcacgggcggctcggctctgtccatgcttgaagataaacagtgccagggaggtaaattagactttcggctgggcttctacttccaagcactgattaaaggaggtacgcaaaacagacttcaggaaagagaggaaaagggctgcaggctgagaggagactgggccgagagtgagaggacttttcctaattcggcccgaaaaggaaaaggtgaattttaattacttttccaattaaattaatcactgaaatgatctttgaattgttaaaaatacttccaatgctcaaataatttcaagaaaaatcctgaaaatacttggacactcaaagtacttaaaaaaattataatcagaccatttaatgattaatttaatatttaaataattgctgaactgctctttgtatgattaaaattaataattgagctccgaaaaatccgagaaaattccagagagtataattaaccatggagaatttaataaaaattaaatccatccatgctttatatttaggaaattttatttcccacatttaacttcacttgtaaattaatgaatataaattctgataataatttattaaataatttataaatcctgaaacgaaaatcagggtgtgacaggaaggtcttgatctccctctccgattccaactccactttccgcctcgagaggagatcgaacccaccaatctattggtcttaatgcttgaatattgcgaaccacagatactggaacccctagcgatcttgcctctggtcaagcgcgacaaggggtcgggtggtggccacgatgtttggtttggccgaacctggatctagccccctcggcaccctattcaaccgtgcactcgccttcactgaggaggatacaaaggggtccagctgaagcatctatgctcgcgttgttaattttgataattaatgataagcgctaattatggactaactattctatttgagttatgcattttgagttaggactacatgatgcatatgccatggatgatcaccaaggattaaaattaatggcgcaaagaaatggaaccaagacggtgaatctagcgttttattttaaattgatcgagacgttgagcgatcaaattttgctaggtttatttctaagcttggtcatactattaagagaggtaataacctaagcaaaaagatgatcaaaatgccacattagatcatatgtattgtcacttggttcgactacatatttcttttctccctctctgtggccggtctgaccatgtgccacatgccggtttgaccgtgcgtgactggccggtctgatcggaccagggccggtgtgaacgagcggtggctataccgaatggtgtggcctcggtctcgcaagaccgaggcgccagtgccgtcaccggtctaaccgagggccaccggccggtctggccggcatgtccaaccggtgtgactgtgctcagttcggtctgaccaggtggctgccgtgtcttttgtgtggccttggcctatcaagactaagccgatgagagccgatgttggtgtgaccgagctgaaggcattctgaccggcaggctgttgccagggcattaaatgcactgtaacgactacttttctatttgttatatttgtgggcggtctaactagccaccccatggcggtctgatcgataggcaacagaagttggggaatttgaccccaatggcttgtttttgtgggcggggatataatacccccccctagcagcaaggggactctcttggtacttgcttcatttgcatacatcccttgcatctcctcacacacatccttgagcttgtgttcatccttatgtggtgtttgagagtagtttgagcttagagtcaagtgcattgcttcattctagagctagtgtggcctttgatcatctccgagctaggtcatcgcttattactcttggaggtcgccgcctcctagacggcttgtggaggtgcttgcccgtctccaaggagattgtggagaaggctcggtgccggttgtgagtggtttggagttcactaccttcggagtgaaggaagaactaccctaatgatcgaggcttgagtagtccacttcgtgggtcggctcccaccttgcccaccccttgacgaaggggccttgcggtggcttcgtggttttgagtggttgtcacgcccagaaattcatgaaccagaatctctaagctgaatgtgtattaaacccctgtccaggaccagccagggtacacaaacgacaattgttgacatacagatccacgtcttacaaaaatacaaaagattacaaatgcagcggaaaaagataaaagcgagctaagcctgaagacttgactcctgcagcgggcgattccattccacaggcaatccttgacgacagcgataaaaccaacctcttcgagacatctccaactgagaagatcttcaactctggtgtgggggaaaagagagcaagactgagtactacccactgtactcagcaagtcataccggaaaaggaggtatgatgcaagatatatccaagggaggctaaaggtcctttcgcataaagccggcatttcaaagcagaagttgaaagcagtaaaacagttgtagtaattaacccatattaaccaatcactgtccaacgctacaccacgttgcaacaggcccaaaccaccacctgaactaaccagttccaaaagctaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaggaggccgtgacaggaccctttgcataaccccctctaaccgatcgcaccacaccttagggttcgcccccgtccccagcaggcaacgggcagcccccctttcgtgccgcagtgaatccggtagccgatcaaccggacaccccggccgacccaactccatcacgcccaccctcgcctgggtacgtcggctagagaaaagctacactacgagcccagccgttgcccatgctggcttgtggtaagtacggtaagttcttccagggcatcccgcgaaccggtccttaactgccatgagcacgactagcaaaaccatgcacccacagcccaccatgacgtgtattttaattaaccaacaccattacggtggcactaaaccaaagctatgccgataatcaagtctatgctttaatgagatccccctttgtgcactagttgaactaagcatggctaaggatctcctaaaccaacatctagtcattttaatacccaagttatcaatggcgtaagggaaacaacataaagctgagtaataggacccatcccacatgatattgtaaaacaatgcaatatttaatagaaatgcgggacaattgtaaattgggtacaatatgatcaattgtaatgtatgacttgccttgctctcgcactgatgagaccacagcaacgtcttcgaggaaccgcggatcgacgaaacagccgaaatctacgcgacaaacaaagcacacaagcaaaacatgctataagactactgaaacagagaacaaaaccatttttaatggattctacacatttttcttgatttactgagacttgaatggacataatcggaggtcggatgaattagttatgattttcagaagattctctgtgtttttactattaaagaaaagccttaatcaatttattgcgcaatattgccccagggctgacgtcagcaaggcgggggcggcgccgacatgcgggccccacgggtcagcggctcgagagtgagagggaggggcgccggcatgtgggccccactggcagtggcacaaagagagggagagggggcggctggcaggcgggccccaccggccgcggctccaaaaaaagggggggtggaggcggcctggctcggctcggcttcaagccggccggccggttatggcgagggcggcggcggcaagcggccaccgacggcggcggccggcgagaagacggcggcgcatcacggcgacgcgcacgcgaggagcggcggcgcgcgcgagaggaagagaaggggagggagttctcaccggggttcggccggcgtgggaggagacgatggcaaacgacgacggtgagcgaccggagggcgacggcgaacggcggccgagctccgggacaccctaagagaggaagtgagagaggttagagggggagagggtgtccacggcgagcgagagccatggccgacggcggcggctatggaagggctcaccggcacgcgacgaacggcgggctccgatggcggaattcgacggaggaggggtggacgaggtagccctcggcggtgcgaacccgaagacgacgacgacgcggctcggcggcggcgttagcggcggccggaggagtggaaaaggcggcggcggcgggtgtagcggcgcgggagcgatggagagctcgggagcggccgatggaaaaaggaaaaaggaggaggagaatgcggggatggtttatatgggctcgggaggggcggacgaggccgggaggcggccgaatttctcgccgacgtgggggagtggggagagagagttgggggggattcaaaccgaatcccgcccttacggggcgcgcgcggggcgggaaggcgtggggaagggggcggcgacgtgggcgcggcaacgcgggcgcggggcgcggagtggaggaggtggggcgccggcggttgccgaccggctggaggttggggaaggtgctgacaggtgggccccacctgtcagcgcccgagggagtgagggggaggcaacctggacttcgggagggggcgggagagatgggccggcggcccaaaggaggaaaagagggggaaaaaggatggaaaaagggaaaaagaaaaggaaaaggatttccagggatttaaatattgcactttgcttattttaattggttaaaattatttccaatgctctgaaaattccactaaaaatcctgttagcatattttgacatgtagaatccaagaaaaattccacatgccgattccgattattatttgcatttattaatttgaggaattagctctaggttaaattgaacaatttcttcggatgatttattttacaaattttaaagctagtggtgaatttggactcgcctcaacggggattagaaaaccagcaagtttccaaacctcgggtgaaaaattccttgtctcttgtctcatttacttattgcatttacttttttgcaatttacattcatagagacatacttgagcccttatcaccctagaaatgcaaaacataacttagttgcctacttagagttatccttcaccatgcctagcaacttgggttagttttgttagatgtaatttaattttatatcgcctatccacccctctagtcgacattgtgatcttacaccaaccccctaccaaagaccaacatcagacaatcggccataagaagtcgatcaacgtctggtttttctaggggaacgacgtgccaatgtcgtcctgtaggattggtgaatgtcttgccgctgcagcgttcaccgaatcggagaaagggaacagccgccagaacagtagggacgcctcgtcctactcaccagtcaccggaaagtcctccgcgaaagccccacattcgcttcacgggtgtgcaaacacccactagacgtgaaaaggtgttcatcccagcattgatacctagtgtgaagctgaagatggaggcctctcatgagtcacgactccccgctgattggacggcgtctttctccacctcccattaagggtgcgctcggttgtgccaaatatagtattgagttttatcagtacttcatgagtactgtatatagccagtaattaatgtggtggttggatgaatagtcagtaacggtggctagatggatattaacgccgcttgtgtcttccgtgacgtcggcgatggaggagtgctgcagccgatgcagcgagctgatggaggcatgtcgggaagcagttatcagtaatgagcttgctgctcatgtcggcgaccgctgggactacaggcgctggtgcatgtggtgctgaagtgagcaggatgcaagggaggcgagaccgaaacaattaacacaccatttagcaaatgaaacgttgattgaatgtaaaatgactgattaacaatacttgagtgcacataattattaataaaattgcgatgcacaattttgattacacgaacacgatagaagttactcgtacagggaacacacataattggctaacatgggaatgacaagaccaaagactactaatttaatcaggatggaaagtgatgtaagcctagttgttgtaaacttcatctgcaatggcgtcacgaacagctcgcatccccgctgcactgttcggtgcgtcgtaccagtcgcgtagtggtggagcctgtgggatgttggggtacctgttgtacaacggatgctatgtcaggaaatgtgggtccgcactgtcaagcctgtagttgtggagagcaaaagcacagtgtatgatcttcgtttgggtattctgcctagggaaaaatggcatctccctaagaatcctccactgactcttcataactccaaaagctctctccactgacgtacgcagagaagagtgcatatagttgaaggtttcttccctcccatgcggttgaccagcaaattccataaaatggtagcgtatgtgtgggtacggtggcaagaacccgcaccggcatgcgtatccagaatccacaagtagatatttacttgcacaattagatgaatcatttctaaatgtaaattaaagagggattaatttcaggagacatgtattaatggatgaaaaaaaaactaactacggtacttgccccatggaagccttggaaaaatgtagggatagttgcgtacagcttctgtgagcaccctctggtcgtggacagctccaggccatcccgcatcagcaaaaatgacacgatcgtcccatccagtcacaactaatacattccatgatgtgatttggtgacgattgcggtgtacattggctttttaaactgcaacacgaattgggatgtgggtcccgtcaactacacctgcggccccggcaaaaggaaggaaatttgcatcttgcataacacagttatgcactctgcgaaaattaggatttgcaggcttgttgatatcagcagccatggcataaactgcattaagcactctatggaagtacttgcacatggttgacccagaccaagccatcctataatttatgcaacctgcatgttagtcagcataacaaacaaataccacgtacaattaggcagaataataagatgattcacgatccagctaaattatttagagctacatcaaatcaaatgtgccgagaatgtttcatcctacacactcaacagaacaaaacagttacgttgctcgagacgaagtcgagcaaaattatttggacagacaacacgttcgaaaagctctagctcagacacactcatcgttcgaaaggatctagcagtaggtccgatcggcatgaggtcaaaacattgcataaccagatagatcataacttccaggtcccaaccccaataaagagcacccacataaccagttcccccgtaacccgcagcaccaccatcgccatcgtcaccataatcatcatggccatcaccagcaccatctcctccctcgtcatcgccatcgccatatgcttcaccatcaccagcatcatcatcatcatctccaacgccatctccttctccatcaccagtagcagcatcatctccaacagcattaatagctacagctccaagaacagcatcaccagtagcaccaaagaatccatcaacacagaaggcagtaatatgtacaaaaaaaggactgactgaagttgtgacaacagcaacattgatatatattggttaatgacactagcaaattaacatatttatttgtgaacaacactcaaaaataccaaatcatgtatggcaccataattataacctatttcattgaaatttgcagcaaactaacatgattgagtagttaacagcacttgaaaataaggatttatgtatggcaccatcattgtgaactatgtcattgcaaaatgcatcaaaataacatgaatgagtttgctaacaacacttcaaaagcaggaatcatgtacggcaccatgattataaactatgcaattgcacaatgcaacagaccatgcaatgagttcaagaaacaaaccggcaggagctgactggatgtaacctccaaatccaggggggaaggggctggtattgagccgtgtcttggtattgggattggatgaagtacaacctcccctccggagtgtggcagtcgtccaagaaaaactccctgaggaagccatctcgaaagaccctcagagccatgtggtaaataggatccctcgaggtgtaaccgtcagccttcagaagctccatgcaggccttggcactctttgcttgctttatctcttccattctggttctgctatcgtttgactgaaccccgaggtccgccaaacggttgagagcatcgctagcagaagagcccctggacctcttggagcttccgccagaggtggtacctctagtcagtgacctcttcccatgccgtggagtctgctcagatggttcttgtagggtgtgctcggtgaggtcctctatgtcgaggatctcggcctgctgaggcactgcgttgatgggtgttctgacaggaactccagagcggttcagggtacaaaccctacccctgaaaaccgcatggtgctcaggaatatacagaaggggaccattccggaatgcacgtgcgcctctcctcatctgcaaaggcataaagagaaaggaatgatttgtgaccgcagtaatatcaaagggccttatttgtgtacaaaacaactaacttatgactatgactatcttaacagcatgaatggccctgtgacttcaatgagggttctgtagtgaatgaatagcaagtaatgggttattgcttttaacctagtacggaaaattatatctttctttgctgcattgaactaaacacattaaatgagtattgttgatccaatattcagataacgtaatttgatccaatgggtaattgattttaacctagtaccaaaatagattgccttaacctagctttgtgacgttgataagcactatgtagtgaataaacagcagctagtacaacatcaactatttgtaacttaataggctaatcttacgctttatgactttaatgaactaaacaaattaaatagtaatgttcatccaatatgcagacaactaaatagcaaggaatgtgatattgcttttaacctagtaccaaaatagattgccttaactaacattaccatgaaaggctttgtgactttgatgagcattatgtagtgactgaacatcaaatattacaacttgaagtgcttgtacaattactcctaattaactaacataagcatgaatggatttatgactttaatgagtattatgaactgaatgaacatcacatattacaacttcaagtacttgtagaattactttgaatgatctaacatgcccattatttcaagtactacatagtatgaataaataacaaaacagtaccgcaatgaacatgttgtacataacaaattctggtttataggcttgaatttgttctggttgcaactaatctggtctctaatagcaaacatgttgtacaataccaaacaaatatggtctctaatgtgattcgtctagaagcatgagttagttctgattgcaacaaatttcattatgaacctaacatggcactggattcagaaaaagctcaaaactgaaataaatacatacatgatccatccgagtccaccactcagggctggctaggatattgccggtgaagggacagcaaccaagcccagtggccattgactcgagccagcaccaagtttggaactggcggcgacatgtatcccataaattgtttagctggtgccggttgaccaccttctgcaccttctggaacatcttcacctccaggttgatgtagccttgacggttggggcaggtgctggtgattgtgcgtgcctcaatctcttccatgcacgcctccggaaaagctttcatctcggcctcgttccatgttgtatgccccgcaaccatctatgaaccaaagtcatgcaagcaacaaaaggggaaaaaacatcacaaaaattttggctctaccttttataggtggtcggagtcgaggaggtcccaatccagtgttgaagcaacgttccccggggtgaggcagcgcaccaactggcagattgcttctgggtacttcaaggcgatgcggataacggcacgtgctacagcttgaacatcttcttcgagggtggcggtgtaggcagcgtcagaacgaagggaggtggaggaaccctcagaagattctagatctgaaggtacccttctccttctcaccaaagtgatgggtgacagaggtgagtggaggaggcgatgggtgggggatttgtcgacaatgagcttgcgcttcacggctaccgctgccattgccttatatagagctggatcgaccacccctcagctcctcctttcggcaatggcaatgcaagggcgccgaataccttttactatgccgcacgagattggacctgaccattctctgctcttgttgccaggattctagaatcggcgacctcgatgctttccctccactcgatgcagcgatgcccctgagcagagctcctttctcctcctccgatgcggcagaccaatgtgggaagtggatgcctacttgattaggccaagcagcctacgccatgcgcgtgctctgccaggcttggccggtctggccaccaaggcgacgatgcagttgacgaccgctctctgcgcttgctgcgaggattctggaatcgacgatcgccggtgtgcacaagaaagctagcaatgtcgagatatcctgtgtgcaaatggatgcggcggcgcttggaggaagaacaatggagggcagagtaagatctttcgggcaaaaggatgagctcgagcttggaactccaacaatgggggtggggtgctcagcaaggaactgtggccaaaacacagcacgcaacctatgaggggaaagtgatgcacaccgtaaaaaccactgggtaatacgatgcacgggaggatgacggaaagtggagatggtgacctaactctcgtcaggaccgtcacctctccatcgccagcccacgttattgacttcgccactcctatccgcgtggtgcacagtacactggatgactgactgcgcggctcagccctaccagcactaacgagcgcgccctaagaggttggcaggggactaatgagagtgatggggagaaatctccatgtgagcctacagtggctcgtttagcctacttttgtatagggtaaataaacaggatagaccccaatgtcaatcatagctaaataatcttgtgcaatacccatgtttctcttcttttgctttgtacataattatgtaaatactttttatattaatataccgcagtagaagcctctcctgctgtttcttctaaaaaatactacagcttatagggtggtatttacaattttccctattttgtttatttcaattcggtgaatagatttcaataatcaaaaaacatggataataattattttacgatgcatattattacattcactcatcagaatctctccctgaataagtatcgaaacaaaatcatagtgatttagcagaaaattacacatagggtgtatttacggtgaatcatttgactccgacaagcacaaaggaagaaaagaaaaatctcctaggtgctagcgccaaatactagggatgcaactgagcagacaagcgggattattatacctgtttatcccacttctagtttttttttcttctaaatttgtattattatgtgagaaatgaactagcaagcgggtttttatatgagagtgagattgcccacttacatccctaccatatacgcacgacagatggtagagtagtggccttaggttctattctagcccttttggtttaggcttataagccagtctataagtttatttggaaactaaaggtgccaattaagattaagatatttttgtggtttttttcaaaggtgtcattctaacaaggataatttagtgagaagaaattggaatgtgagtcaaagatattgtttttatatgtataatgagattattcaacattttttttattgccatattgcaaaatttgtttggagaatcctttggactgaaaccccccgatagtatatctaatatggttggaattggctaagtggtattgagtcaaaactaagaatctcgtatttgtcggagcatccgctcaatgttgtgctctgtggttgggtagaaatggtgtagtttttgataaatgtccaaataaatcttatatgcaaatgtaggtgtttttcagggcaacttactagctccggttttgggcacatgttcaaaagtgtgaagagaacaaggagctcatatattctacatatcgaaacttagaatttacggtaatgcagattttcactaactacggatggagattcacaaatagacttcaataattgtttactccttatgtgttggctttattatttaaattatttttggttgcctgagtgtttgctctctttgtaacaattggttgtagtttctttaaagcaaaggccggatttaattccattatcaaaaaaagtcaatccataagtaaaaaattctaaatataaacaaacaagcatcctttttgtttggtttatttaaagctaaaagccactcttatactattaagtcaaaagttagatcggagaagggttttttttttttttttttttttttttttttttttttttttttttgcttatatgagttggagatatgactccaccattaaacttagaactttaaatctgttggcttaataatcatataagctaaaaagctgacttaatagtctaagtcaataagtctaagcctaaacaaagaaagtcaccgggtaaaggcaggtcctgattgcatggagacgcaagagtgccgcgctcctctaatgtgatattagacttcattttaataatatgaaacatattccaatatttctattagatcctatttttaaaaaaaaacaaaaggccataagaaacaactccatttcaattgtaagcactctagtagttctactaaaaatagatttcatcttatatttttgttgtatgtacaccctacccctctatgagcatctccaaaaaaaactggtccggtatatcttgagattaacgaagtcatcatagatacctcattatcgatgggtacgtcacttatcaccgaaagaacaattaaccataaatatgagcacacatatcaaatctaggactgtaaattggatagatggttccaccacatgaaaaaattaataagttgagctaagctcaataatttttttaaccaactacaacagggcatgcctgtgctggtgatttttttttcattaacaaatgggggtgaaagtgtatgcaagaagtagagggaataaagaagggaaagcaagaatctggtaaagtccgaaagaaactggttttccagtctagactggcattcgaaacatttttcaacaatttagatccctcgtggttgactatacttttaccccacaaattttggaacttgatataaaatgtttcttacaaatgtttaacaactttgatgtggcaccaatttatcaaaaaatacaacctcatgcgtagtgaggataagctcaactggttagcctctggtggtgaaattctagacttgatacaaatgctgagcatttacagttatttatttttttagtattagacgatgtatctatcacctgcaagacccttttagtaatacatgatgttcctgtcaacaacgagacagctatgtgaagtgtatgtataaccgtctgtctttgtgtgaggtgtacgtacaggcgtttgtctttgtgtgaggtgtacgcataggtgcatcctgtgtggggtgtacgtacaggcgtgtactgtattagcctatatggtgttaaaaaaatccctcctcattatatcgggtatagattacttcttgaaacaagggggaaaaataaatggtttcaaagttgaggggttttgcttagtcatcactcatcagcgcaataaaatcttgaggggttttactaatacctctggtagtactgagaatcaaaaggtgttttccttaaaaaaaaaaagagaggtgtttcgaacaaatgtgatagttgaggtgttgatatggactttcctataaactttcagtgccaataaatcttcagtgcagataaagcaattttgccaaatgaaaggtatcaaaacataacaggcaattgctgcctttcatgaaaaaataacttctattgtcttcggggtattgtaccctctttggagagttcgatatccatgtctaccgtaaaatggtgctttctattaaacactctcataatcgatgttaaaccaccggcaaacaatcaatctctacggataattatgcactcataaactcataaatgattctaaactcatattataactgtataatcaccaaaaaaatatcgtcagcacatgtaacgagctgattagttctgcatacacaaaactgtacatcaccatagttaagccaaaggcggatcacacaaggcttcttttctgttgagctgtagtagtattgctagtagttcttgggtcactgtccacatatggtagacatcaaaatattattggggaattggcagtaagccaataaataattttataaatgaaactagtagcagtgaaagcaatcctcaatttatggaacacagaccagcacagataggcaaacaaaccaagaacgcaacgaaatatcttaaatgcttgtttggatcagtcctcagtgggagttgcagccaatcactttgatgagaggagattttcttcgacttgaaaccacaatccgaagggattggggcattcagcaatactcctttgcatccaaacaagccttagaatgaaactttttgcctgccagcagaaattttctagagagttcattatttagaactccagtattttacaaaatgaatcatctgatagtcaattccttgagcacaaaaaaaagggactgcagaagtcttgacaagtcctggtactttataagccccgatgttgatgtgattcctaaccattcaaatcaaacgggggatggattcaacaaccaacaaactcaacatcgaaataaccagttcgaaaacaatgtatgcaaacggcaaacctatcagagtacattgtgccaaaccatgtttttgttttttgggggataatggaaatcaatccagcctctacatcaacatgtatctacacagtgtcaaaccatgtcagtatcacctcaataaagcctttccagaagacataatgaccaggttgaccctcatactttagatcagcaatagcaatcctgcagaatagactacgcatggaaaaagtaacatgccaaagcaaaaaagagaaaagcatatccggacatgaaaagattaaagacaacataacatcagtgagttgtgggcacactccatgaacagtaggggtataccagattccagggggccaggagaagcactaccttctatgcttatccaaattccaaaaccaaaagcaagatgcttcacgatacaccatttcaaaaggtggacatcccctcctcagggtcacttaagtcctctccatagtactaaatccacataactatctgtctgtgattaaggtttcagagaaatataaaaaaaactgtgggcctgtgatagcacatgtgatcaattaggcaatgttgttgtcaattttgagttcaggtcggcattacctttttccctagggaactttatacagtagtgagtaaaagaatacataaaataggaacttgaaccaaaagagacatacattaagggacaaagttaaagctaccttttgcatctaggtaagagctaaacaaactcaccgaactttctttcgggacttgaaagggaacccaccaggtggagacggtgagaactccaatgggaggtgcggaggttctccctcgccagacagcattcggagtacctcctcacttgatggtcgacgagctggagacctttggatgcaaaggagtgcgactgtaatgcagagtaaaacctcatcacggttcacatcctgtagggctggatcaacaagatcaatcaagcggctcacgcgcgcaagatgtttcgcccacgatatgaggcttgccttctcaaactcagacatgggtgaggccgtcacttgcaacggccggcgtcctgagataagtaccagtagcaagacaccgtagctatagatatcgcatctctcagacaaaggaccaccaccaccgtattcaggagccacatagcacaccgtgccgcgcatgctcggtgtgctgctcaccgcgccactactcttgggaacgaattccccacttgcccaatcacgggtgcttcttgcaccattgacccaccagttaatactgccattgccgttgccattgccattgccagtgctgccattgcttctccgactccagctcttcatcatactccatttggatcgtccctttgcatccaagtcatcgtcaatatcccgctcccaccattgcaaccctgcctgctcgctctttgatttagcaagtgcacgtcgtttctgctttttcgcaagctcatcagcatattcttctcgccaccattctcgtgccctcctctttggcttcttcctgtctgcagctggattggtaatagctgcccctgcaatccagtcattcttggggcgctccttcttgatctctgatctaatccactccatcacataatcttttacaccattgctgcccccaccattatcctgcttccaccaccagtcactcccggtacctgatcccatggtacctccggtgcgtgaccctccaccgttgcagctgcggctattcataccactctcaacactggtccggtcaaacccggaagtggacgcagcttccgccggtgatgccgatgtgaagccatcgtcatcctccggtgatttggggttcccctcaccattcaccgtggtggtgaccgtgctctccgctatgacagaggcgtcatcatcacatcccccatcgacgtcacatccttccgcaatcgcgccgctctcaggcttgccgtccgcatctgcgtcggaattgatgcgggagagaccaaagtcggcgaggcgggcgcggagatccgtgtcgagcaggacgttgctgggcttgacgtcgccgtgcacgaccggcggcttaacgacggagtggaggtaatggagcgcggcggccacgtcgcgggcgacggcaaggcggcggggccactccgccacgagctccgggcagcgccgccccagcagcgcgtcctgcagcgacccgttgggcatgaggtcgtacaccagcatcatccgccgcggccgcccctcgccccgcgccgcggacgacatcgagtacgcgaacggcagcagtatggagtcccgccccttcccacccggcttggcggcggcgtcggggacaggaggggatcccggcgcggacgacgacgcgaggaggtgggacgcgacggcgatctcgttgtggaactcccgctccccctgcagcgaccccgcggcatccatcaccgctcgggcaaagggcgtcccgccccggtcgccgcggattgctcccgccgccgtcgtcgtcggcgggagcgcgccgcggaacacggggccgaaccccccctgcccgag

SEQ ID NO: 28116 - DNA, 3708 bp, Oryza sativa
ttgcctttttttgggacggagggagtaaacgttgttatatgttaggacggagagagtagcattttaaattttatgcacaattttagaaacgttaggagtatatttttgtcattttggttgctaagctcttcgtgtagaaccgttaaagaccagaagcggaattttttttggttgttttgttcgcgtgtcttggccgtacgcaagtcatcctgaaaattcttaaacccgggcgactggcgcggaggagcccgatcaggcgctccccctgcgactatgcgagcccctcccccacgcgctgcatgcaggccctccgcgtctttgctcctatctgtcattgcaacaaatcacccacatattttggaaaccctctattaaggtaatttggtttattttttgttcaaccaaaaatgtttcacctagtgtactcacaatgtttcactatgtatagatctaatattgcagtgaactgaaatattccattgcaacaaaaaaacccacatattttggaaaccccctattaagagaattcggttcattttttgttccaccgaaaaatgtttcacctagtgtacttataatatttcaccatgtatggatcaaatgttgcagtgaactgaaatattctttcactatttgctgaaacattgtttttatataaggtaaaacaatacccgatttaaacgagtgaaacattttcgatctactcagtaaaacaattccgatatacctggtgaaacatcgtgcaacatttaaaaataattcaataataatttttaaaaaaatcgtcggaatatatccatatgtgattttgttttgaagatttaattgcaacgaatgtaatggtaatcggatcatgatttggataagtaatttaagagaaaaatcagtttaaaagtagttttgcacgtaaatcggacgctgacatcagcatccagtttttctccaaatcgatcgggagcccgacctgtagactcgtccaagtcatcctattaaaaacaagtaaagttgagtatcgtaaatttgttgtactaaaaacactatcattgctattggtcaaaccgactcagtgccaacaactactacctctgtttgagattacaaatattttggctttggcgtaaaactacaattaaatttatatttaaatattagtttatctacaacaacaaattattttcattaaatttataattaaatatatttttatcgtgtatattgtgttgaatatgttattatttttttaataaactttggtcaaacttaaggctgtttgactttgagcaaaatcaaaatgacttataatctaaaacggagggattttcttaaaaaaaattgaatcgtgccattatatatatatatgggatgtgcttcgactagtttttttcataccgtattttcttataaaccaaaatatcgctcgctatttcttctctccacctcgatgacttgtgtgccctagcatcatcccttgcgtctctcctgttcgcctggatctggtggtgatgaggaccaatacgtaaacaagaaaccttcaagtagagcacaatatttcaacaatggcggtggtgaggactgtgaacccaaacacgtcggtggccccctccaacccttttctcacacgaccaactatgcgagacatcagtggaccacgatagttttgagaggcatctgcgacaggtcaacagcaacatccacaagatctagacgagtgagggtgttgtcatccgatactcaatcttgaccttcatcgaccgtcgagaatcgcctcgcctctctggtgacatgaggtgtgtgcgtcaccatcaatgctttcttcccactctcgatgagatccttgtcaaatccggcacatcctcatccgtgacgtttgcgaagcccgcaaggaaaagcttgacgacaccattgacatctcgtagttccttcttgccgtcaacgagctcgtgcaagggcttcaacccaaatgacacagcttccctagccttcatctccctcgctgatgaggtcactgcagcctcatcctctcaatgtccgcgctgcatagccatggcccatcgacgccgcctcctctagccactggtagccttgagaatagaggagccaaggagagaggtgaagagacggggaagagagaagtgaggggggatggaggacgaagatggaactgatcggtgagtcccatgtgcagattgtgtatttttgtccatccaaaaatacaatagagaaaaacgattcaaaacatgtgatacctacaaatgacgttatgcaattttgaaggtattgtaatcaattggttacatataggtgaatattagtgacattttttaatacaataaatttataatggcatgatcaaatttatcgaaaatatttgctaatgtcatttcgacataaaatggaaactccaatttacatttttttggactttctgatccgcttaaagatttgtgcactacggtattcttctctcgctctgacgagcttaattattgatattcgatgacgacagcggtggctctaaccagttaggtatcggggtttggggttggagagggtctgcaatagtccctccattctaaaatgacttaatatttgccttatcttgtttgtttcaaaataacttacctatcatcggcaagccaaacgagttttgttccttcaatacactttaccaatcttcaacttatttttcaccactactatttttctattaataagttttttttttccctccttcatctattttgttttgcacactcaagactaagaatgaagttatcttcagacagagagagtatagacgtaaggatagacttaaattatttgtctgacctacggagattcagcttctagcaccggccaaatcaaagctagccctcgctttaaagaaaaaaaaaaggagagtattggctggtggatgtcgaccacctcaatttgtgttttttttctgggacaccttaatttgtgttttgaaaccaatcttgggtgatttaactcggtcctactatgctaggactgattatacataccatgtgcagagttcaatattagaaacagataatcagatagtattggaccagagaaatctaaacgttgtaaaatgcctccgttaatctagcattaatgaagggatgtacttcgagtgttaatattactccatataataacaacattacaacactataaaattattttatttacaaaaagtagttattgagtgtgcgtgcgttgtactgtgtaattctaaaaaaaatcaccgcaagatttgaagggaatttgactatttgccacttttaaattaggcaattattcaaatactcttctaggtgtgcagttactttttttccctctaaagaggtggcctcttaactatttgccacttaattttaaccataaggcatgccaacgtggcaacctagggtgaaaaatggcatggggcccacccgtcagtttatccctccctttcatctctcccatgcacgtccatggcccccgtcgacaccggcaccaccccgctgctccatcgtgcccgcaccacgtcgatgtcggcatcgcctcgtaaccgaccaccgccggaaccgcctaacagctgacgccgagagccctgtcaccgcctagctggcattgcttcgcagccgagagctaagcaccgcagcaccactgttgttggaggaggaggacgaggagaggcaggagctaatggaggatgac

SEQ ID NO: 28117 - DNA, 1594 bp, Oryza sativa
  unsure (1)..(1594): unsure at all n locations
cagtgggcagttccggcggtggtcagccatgaggtggcgctggcatagacaaggtgcatatgtgatgaatcagggcggtgccagcgttgatgggagccacagacacacatgggagagatgaaggggaggagagactgacgggtgggtcccacgccgtttttcaccgtaggttgccacattgccatgccatgtaggcaaaagtgacgaatagttaagagaccacatcttaaagaagggaaagaaataattgcaaacctaaaaatgacatttggataattgccaaacctaaaaatggtaaatagttaaattccccaagatttgatggtggttggtgaagaaaaggaagtttaatttcattttactttgtaattttctaagaaacgcagtacaaatgtagacgcttataacgtgcacacactcatctctagaaatgcgcgcgcgcagacacactctatccctatagcatcttcggaagactagactagcatattttcagattaacaaatcgccacgccacgaacgtctcactgttaatgggtacatcgcttactattcatcaccatgagcgtctcgttatcgataggtacgtcacctaccgctgaaagaactatgacttgaacccatgtggattaattccaccacaataaatctaactggttgagctacgctcatttcacttgtaatttcatttttttagtgttagaaaaatgaaagtttcattttaatcataaattaatgaattgtacaaaatgtatattaagtttcagaattagaaatgggtattaaaaaaatagtggaattaaatagaagaatgctatgattggttaagaacacaacttacggttataattagttaacaagataatataggtgaataatgcttatacttagaaatttttaggatcatggaggtagttaatggtagggcatagcagatgcacgtgaaatctggtaggcctagtgcacggaactacgtgcaccgggagctaaggcaaagattaattaagtaaggttgctatacttaatcgcattgaaaggtgttgttatccaatttgatggttcccagctgcacgttgaagctaattatgacgctatcatgggttggaggattattaatttacgaatggccaatcttgaatagtagaacttttgggagcaacgtcgtacactcatcaactgtaattaaattatataatccgtagtagcagttgagtggaaaatgaggtacagcgggaaattttatatatcttttaaaccatttgaaataaaatttccaaaatatatttttaaaagaataacttttactcttgcaaatattggagaggctctaattaaaaaatggcatgacaatataattaaccttactaccttaataacgctgtcattgcatccttatcactgccatgtcacattcttttagcccccgtgcggtaacattatttgttatgctaagtatactgataaggtttatttttacaactatataattttttttaagaaaaacactctagagctgctatattcttatgtattccacttgactttatgtttttgacatggcaatcaaagtccaacaaagggcgggncgcaggaa

SEQ ID NO: 28118 - DNA, 745 bp, Oryza sativa
cccggcgtgatgaatgaagtcttcaagcagtcggattccttcagtcggatctgatgataccccgagtagcattccaaaaaactgagaagctcgcagccggcggtcgagtcgactacctggtcaatgcgaggcaacccaaaaggatctttagggcaagatttgttgaggtcagtataatcaacacacatgcgccattgccctgttttcttccgaactagaaccgggttagccagccagtcgggatgaaggacttctttgatgaagcctgctgctaacagcttggttaattcctccttgatcgcgtccttcctgtcttgtgcgaatcggcggagtcgttgtttgataggcttggcatcttctttgacgtgtaaggagtgctcaatcacctctctaggaataccgggcatatcagacggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtaaggataggactcctcggggaccaggcatct

SEQ ID NO: 28119 - DNA, 806 bp, Oryza sativa
tgtatcatggagaagacttcccagtaagctccatactgaggctgcaaaaccattcataataacctatataagtgaaaatagttaataaaataaatattttggtcaaaaatctatttacctcttccttaattcacgtgcaactgcaacattaggatcaaactgcaccctactgaagcatgtagtgtgcaggctatggtctgaaataaaaggtacaacaattatattacataattttgttgatcataagatcgatgaacataaaattaacaaggacacatcagcttaccttcttcacgctttgctctaagcattgttgctacaatgataggttgctcattagagcatctcgcccatttagttaaatggtcggtaagcattttatccttaataactaacatcacaggtttgaaactacataaaaataaacatgtcaaatgcaaatagtgataagaaattaaggtagaaacaaaaagacatgtaccccaaaaaaaaaaagtatgtgcatacctgccatcaattataagaatattcctatatgggatcctcttcttgtagccttccacaaagcctatagagcttacaaagatgaccattccaataacatctgcacatgtgaaaattgtgttaatagaacttctatttgtcacaaattaatatttgtttgggtggttagttgaactacttaccaacataaatgtcattatggtaagtaaactcgaaaacttgatcaagtggcataagcggagggagtaatggtaatatcttctcatgcatgtttgctatctcagtaatagtagtatcacgtg

SEQ ID NO: 28120 - DNA, 521 bp, Oryza sativa
  unsure (1)..(521): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccgggccccccctcgaggtcgacggtatcgataagcttgatatcgaattcctgcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28121 - DNA, 349 bp, Oryza sativa
ctcttgagtcttgaacaggggaatggagctaagcgggccagctcctgaacaacaagcacaaaaccatggtagcctcttaaaatgcaacatttctgatggcctaatagcatgatcacctgccgtggttctgcatggtacttatataaattatactacccaacaactgcaatacttggtgctcttcagataaactcggttcatcgtacagcaaaatgaggaagtaatttcctaggcaagaaaaagagcaagtcatgaacagtaccctatcaagggctttaacaaatagtgtcgactcatgcaacaccggctaataaatagttgttaaaattttctttattaaaataatcaa

SEQ ID NO: 28122 - DNA, 749 bp, Oryza sativa
caacctatccggacagtccaacaaggggtacaaggcttgcactcactgtatggatgaaacagaaagtacatatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagaataaaggtaccgtctggatactccacgaatatcaagcgaataataagcacgaaggagaagaagttcacaaacctaaagtctcatgactgtcacgtgttgatgacacaactgctaccagttgtaataaggggtaaccttccagacaatgtccgggcaa

SEQ ID NO: 28123 - DNA, 4136 bp, Oryza sativa
gatatgcaattttctcgctaacaagagatatatccaggtggttttttcgcacttatgtttgtttatccacagcgagaaagcaggatatttctcccgtcgtgaaggaagagcggaacattatcgatctaaaatcgttctctgcgtttggatggttcataaccgaattgagctcagattagtagcctcaccggcggctgtgttgcagataacgatgaaagctctagcatatggagaattccagttctaaggtttgctgcttattttccatcttttggattcttttcttgatcgtttctgttcctaattcgttttctttatattttgcatttgcagtcctgcagcaggtgcgaatgtatcaggtggtggtggctctcgtttatgttttcaccagaaacgatcaggctggacgataagaagtcatgttctgctcccagttctgccgttcgccatgttctgctacatctctaaacccaaatacaaacagaagcagaaactaccaaatctgccacatgttctggtcctcagaaatcagagagcagatcatgctctgctccaaagcagtgcatgtccatctctaaacccaaaaaaagaagtgatgttctgctcccagttctgtgccatgatctgctacatctctaaacccaaatacaaacacaagcagaaactacgatccatgttctgctacatccgcagaagaagcagaagaacttgtactgctccaattcacggattcgtccgacaaaaaactacaccacagactcgaggcatattctgctctcagttcacacgacagtcagcaactacgaaacaaaaagatggggcatagcggacaaagatgacaacagagaatttggataacacaataagctaaaatagctaaaaaaaacgaaggaaaacttcttatttttatttcactccaacgagcagaagttacagaaaactcaactcaaatattagtcgcgtttctctcatagaaaatatcatacaagactatagatagttcgtacgtctaatcaacgatcatgcagaaagcaagccattattccatatgatctgctcattaaacaactggctaaatgttctccttggttacatgttcgatcggaacaacttctgcggcgccgggggtgctccgcagcttctgaaattcatgttgcaagctgcgtgactatttctagaaatggatgtcaaatttctggagagagcgattcatcacttcactcctgtcaccagtagccatgcaatgcacagttgcacaaaaccattcctgaccaaagaacgcaacacatagtcagaaccaaacacacaaacaagaggaaaattataaagagcacatcaaccaattcgaatcttcgatatgtaccaatcagttgatgagttctgcacacactcgtgtccattcaaacagacctccgtgctcccgcaccgcccgcttgtgctgagcaaaagaattcgtcggcaaggatcagcctttcgccaccgccggcttctgctgcatgtcaccactcgccgagacgccgacgcggttccaccttcttccaccgtcggcttgtggtgctcgcctgaactcgccggcgaggacgcaccaacggctaccgccgccttctgcatgcgacatcatgtgtcgacgaggttccgccttctgtcgccgcggaaggcgatgcaacagaactcgccgacgagtttctgccctctacccccaaaagattctgctccatcaaatttctgcagaactgatctgcttctgctcacaaattcctcctcttctgacctacctcgccgccgttttaaatagatatcccggtaacaacctcaatactaacaacttccctaatcaaacggccttgcatgcgtgcagattagcaagccttgcatgcagaactttcaaatggccttgcatgcagaacatagcgccacgaagaccgcgcagtgaacatatttttgcaaaataagaaaaatcaatatttgattttctgccacagtgggttagtggataccttctctcctaacatgagtggggcgagacccacaacccgataggaggtggacaggtgttggatggctactataggaggtggacaggtgttggatggccataagctcgaaggtgcaataggcttggctcgagcctatgtcgagctcaagcttggacagacgagctcgctcgaagctcgttgacagccctactctagggttgcgagagagggagagaagggtcgcgcgtgtaagcggaagagagggtcaagggaggagctacggccgcgcgggtgtggagtgggaaagggagagaaggttggagcaatccaaggcgttggatctacgagaaacgatcttgacctatcaatgaggaacgaggagtgtagcactctgttcgtaatttaaataacaggatagatgtgatttgagggagactatattcctttttctgttgcaatgtacatgcacttaactagtgttcaaaaaattgggtgcatactgaaatgacccgatatggtccatactccatagcctaatgatggcccgatttgtgtgcattggctggaacttaattaggaatcgggcatataattgtttcctcaaaggccgatatagtcatctccaagttgtacatggaccggaccgataaaaaaaccgtgccggcccatgagcaaggaaacgtatagcaatgtgtaaatctccacggtgatataaacaaaattgtttcgtctgtgagtatttctttttcttttaatcgtttcctccatgaattgcttccatctatttgcgtgataaactcaaagtcccatcgtttcacttatgcttatacttataagctaaaatttaaatttaaaaacttaattttaaaattaaattagtggtgttcttctcataatttattttacatcatttggtttttaatcgctaagaatgcgtacacaaatgtttttcaataattttattttacacaagcgaatgtttttgccctaaaatataagtatagattaagtgaaacgatggggacaaaaatttgacggaaaaaatacaaattatgacgagtttacgacagataactccattagtttttttgtcgggtccatacacactcaaacatgcacctactatcaacctagctagtaaaacaaccttcagttggcttcattcgtttggattttacacgatgcccaaatgaccccatttttggccgatagctagttaagaaactcaggtatcgtaccacttgttccctcacatgccgatatatatggcattttcgaattgtaaataccagagcaaggcggcctatccgcctatgaggtaagagctcactattcgcacttcctccgatcaaatatttacatttacactagctaaaacccatgcattgcaacagatattacaaaagataaaagcaaaagaaaaattacaagtttctagcatatttagttgattatgcatataatgacatatccaaagcaaaagcattcacgtgtggggactttatgacctgacctcgcatgtcagcttgtgttgaaggcggactcgaccaccactagcttcatttaaagtagtatagatgtaaagtaaatttcacaaaattgtgagtattatagtcctagttatacaaaatcattgggtttaatttagcacgtgacacacaataactgtaggtattatagcatagccctaggtatcatggccatatagttttatataaccacatatttgaccaattatccttgatccacaattccataaagatgttattgtcataagtgcattaacggtctataaattattgagtaatgtgctacgttactgtacttacgcgataatgttactactgaatcatagtaattagttataattttcacagtaacgtaagtgatttgttcttacaaagtttgaacagagatatagaacaagcaaacaataacatttaatcacatagaatcaaatgatgaattgattaaaagagcttgcaatgaatcataaggttattggttcaactcttgatttttgccattttattttttagttttctctccaaagtgaattttctcagagggagagagggaataaaacaaagagaggcactgggaagaaaagagaacaaggcaacgggggcgccaacacgaagagaaacataaggggagata

SEQ ID NO: 28124 - DNA, 566 bp, Oryza sativa
tctacatgattcactaagattaataactgtgcctttgggtgattacttgaatttaaaagatttgtttgaattagtatccaaaataaataaaaacggaaactgacaaaacctacctctggacctcgtagtctagacttaaatctagataccaaatcttgtgtagtgacaggagcaacagcaagaaaaacagtcttgatttatccctctgtgacaggaaatacatttgcactagtttttgatgcaacaatggccttcaatgcaggttttgaggaaaatggtgtctcatctttggccactgatggttttgtatcctaaaaataatgaaaggatttatcatttaaagactaaagtaaaaaaagtattcttgataatagtgtgtaagaacttacagattccacctttgcttttttggaagctgcaccgccagatgcttttgaatcatcaccaccacctgatttcctcttttgcttcgatttggatgcaggaggtgtgccacgagcatgtcctgatggtgttggtttagcggggctgttatctacaggttcatctttgggttgatccttctg

SEQ ID NO: 28125 - DNA, 1397 bp, Oryza sativa
tggtttccgtgtccaacgtttgaccgttcgtcctatttgaaaaaaatatgaaaaaaaattaaaaagacaagtcacatataaaatattaatcatgttttatcatctaacaataatgaaaatacgaattataaaaaaatttcatataagacggacagtcaaaattggacacggaaacctagggtttgcctttttttgggacggagggagtagaccttaagatttgtcccaaaatataacaatttctctaccaacattctcttcccaaccaatcacaaccctctactattcgcttttttcatctacctccaccactcatccaattacaaccctccatcgttcacttctacctactttcttaataaccgtgtccaactctaaaactttttatatttagggaccgatggagtactaatactcctcccgaaatttaggggccatttggatgagtccctgtcacatcggatgtttggacactaattagaagtattaaatgtagactaatgataaaacccatctcagaactctagactaattcgtgagacaaattcattgagcctaattaatccatgattaacctatgtgatgctataataaatatgtgctaattataaattaattaggcttaaaaaatgtgtctcgcaaattagctcacacttatgcaattaattttaatattaatttatatttaataattttaattagtattaaacatctaatataacatggacttaaaatttagtcactatatcaaaacaccacgcttaaaattcaagtggttctaccccgctactacacctccacgtggttcggcacctgctggccgggccaccgtatctcgtggcctatagacccggcctacattgactatccaaccccaaaccgctttactttctcatcacttctcgtcccccttaattaatccctgattacgagccctcatttcctccccccgcatccgtccaccgatgccctcattcacccactcacccccatcccccatcccactgacagtgggccccacactcttctgtccccaccgctcagcgaaacaccgtaggcgcacacgtgaagggtacacaggaatgcgtcttctctgaattcctctcacaattcctcatctgcaaaggaggagacctcggagagccggaggtggtagctaatggtggtggaaagccaacccgctttgcgccatctcccactcgcctcccgctcccgatgccctcgcgccagccgccgccaccgccgccgcctccgccgcctcggcctgacgtcgcccgccgccgctcagtagctgtcgccgcggcggcgggggcggcgggggctggggccgtggcggtgctggtggtggtcgcgctgctgtggtggctgaggaggaggagggggaaggggaaggggga

SEQ ID NO: 28126 - DNA, 3541 bp, Oryza sativa
cccatcctaaatggcaaaaaataaatgttctgaaaaccaacaaagatgtgttgctacagcaaacgataaggattatacagaggcatataacttaaccatttgtagcaaggaattggaaacttataggatcaagcagaatgccattgattaaataatgtaaactactgtacgttcatgaagttctcttaactgttttgcaataggctcatgatcatcaaatcaagtgcaattcaggctgaaattcaagaaatccctgcaaactaaaacttttgaaacggtgaagtgaacgaaatctaaaaagcattatactcatctaaattacagcactgccattacctaaactacagcattacacctactacaactactacatatgaacatgaaaagggggagcattacacctactacagccactacatctgaacatgaaaaggggtttttgagttgtacctcgaatgagctatagaacaagatgacagtgagcctaggaggcagctaatgcagtgtgccaagcaaataatatatatagttgtagccgaaaatatttgaatatttgaagttttgaactccacccgccaagaatccaagcccgccatcctcttctcccagattgtgaccaaataataggtcgattttgtgctttccccatgaagagagaggtctactgccctaacccgtgctcctgtcataccagccagcagtactccttggtagtatcatctatcaagtcttaagagagggagagacatgccgtgtagaccactcttctccaatcagacctgctacatttccaatcaaaggagtgtgtgtggttagagagggggattgaatgcagcgaatcagacacctgctagatttccaatcaacggagggtgtggggtaaattgttagagatgggggattgaatggagcgtgcactggaatggatgagactgatcttaccttggattcagagagtgatgtagtactccgtagaggacttgtacgctcatggatcctgttgcaggcaagtactaccaatgtgacttgtgaggtccttcacagtacgacgacatggcctctggattcgattggtgcacgagtgctccgctgcgacgtggtccccacaatccgccgccgctccgagccctgcgcctccacgtcgcccttgtccgccaccgctccgccccactggcagccgccgacagcaaaggaagcgacgggcggaggacgggaggaggggcggagggaacgacgtcggctcggtagggggagcgcgctgctggccccgctgtcgcccttgctcgaccgggccatcgcctccgagatctccctcatccaaatcctgcaagcccacggaagagggaggggcgtcggctgggaaacgcgtgctggccggggaaggaggaagggggcgccggccggaggaagtggaacggcggcgctggccgggggaggaggagaagaagcgctgaggcgtggcggccgggggataaggagaagatgcgctggggctggcgatttttttcggtggcccttgtttttcgttttcttttttttttagcgcgatttgtagtcgtagaggacggtggatgatagactctgggaagggataaggaggagattttaagtttctttttattaaatgggtgtggcaatcgatgataaatataagttttgtaatggagtgatatcactatatttgtacgtatacaattcagttcaattataggctctcaattttaaattttaaatttggaatttattatatttgcaattttgaattttaattaatgttgtagtgggttctatatggactcttcttccattattacttaattttaattcagaattttatttatttctaattgcatttttatttgaactcttctttttctaattttggaaatatattttattttttattttaaattttaattaatcttatatcgtacagagagttgtacagcaatgtgggggtaatcttcgggactgtacgcaatgacttctcactttagcactggccgatggttttggtgtccttagcacttctttgctggctatcacgagggtccactgtttggcgcttaaaatttttgaactcaggtgtagcttctgtttctgtggaagatcttaggtgtttatttggcgtcgatactggagttgataggtctagatattgttcaatgtggtccaataatggttgcattcggtggttataacagttatccatggcaataaacaaggttgagagcggttacttagccattgcactggtttatacacatacttactattgcctcgtgcgctcgggtacgcgtctcattgagcacgtatttataggggagaggaggggggtccgggtgtggttactttggcctgcttttgtcgagcacgtgggcaagagagaggagaggggaaaatggagaggagggctggcgggggcttacttcgccggcggtcggggccgaaggtggcggagatcgaggtgcagcggcgagctattccaccggtgcaagtgacgggtggcgctgccgttggcgagggcgctggagcggttgtgcctaagcgttcctgtcgaggggaaaccttcctggcaggggtggccattgttttgcgctgggtgtgctccagtatgcgatttgtcggggcaaccatcttcaccatcttagcttggatggttcgcccgctggtcttgctctggaaatggtggcgagatctgatcgatgatggccactctgattacttatgcgaggcagtttgtctcttcattgtgttggcaccgattgtttttgtttctactcttaaagcgctactggagtagataatttatgaaatggttgccaagtcttggcatgtatcccttatgtatcaacttgcataatctctactttaatctttctacacatgtgcctgatttgtgttgcctgtgaatgtgggatttctagttttttctcaacattcttaggcgcttttaggtttggcatcctctttattcggcgggataatccattcttactcgataaatgatttaatgttagaagggcacttcggcgtaagggtgattatggacaaccatttctgaaccactaagtcatgggggcaagagattgcattactccatattcaattttcttttacaacaaggtaccaggtaatacatctctagaaaggggaagggaactactaatactggattgggtagtgccaaacagggcctatgcacatcccttctcatggagatggtgggggcgagaggggatcaacttccaacggacgcttccgacggatcctgcccatcctcccgctctcgatgtagcgggctatcgtgaacaccttgcagagaagtaaggttgtgtgctcttgagctaggcgccgatagcgggattccagatcggcatatcgatcccgaagttcatcaagttcttcaagagcttgctcgtaggcattctcggtggtgtgggctagctcggagagaagggtgcatctgctcccttcaggctctccagtcaggcggaggcggcaccggctgtcgtcttcttcgcggtacgggtgcatgcca

SEQ ID NO: 28127 - DNA, 1497 bp, Oryza sativa
tcaccttccagatctccaaggatccttgggtgatccgctcacaacaatagatcggctcatggaagtaccctacttgctggagtaggtacttcaactgttgggcatacccattagggttttccatgggctaaggtttttttgactggcttagttcaagaggggggtgtgccctttttgaagttgccttaggttccttttataggcactattttgtcggtggttcctgtatcccatcagctgggttcccattaacattgcttgggaaggggcgagtctggattttctgggattctggatctgcagggttcatttcgaatcgtcctgtggttggtgcgtgtcttcaatgtcataccatccctcttgtggtgtttccaaggtggctttggatagaacgggtggactggtcatgctagtttgagtaggtcaggtggggaggggtaattcgagatggttcccggttgtttttctcactggccatatcatgggctgctcaaccggttagacataaattgtgaaccacttcacaaatgaaaccatcgcatgacacaaacatttccatagtgctatgaattcaactgatatttctagaataatacaaattatgtgattatgttacaggaaatcataagtgcgtagaaagctaagtgctaatacatatcttacatctgaaattaggtaaaaacaaacatcagcacataaatatagtgctggtatgacaaaagctagctacttgcatgctagctcagaggattgctgttcaaaccaacatactacagtggtgctagctcagaaatcagtacctctatgacgtgagaacctctctatatacaatgttcctcgtgtacgtcccacgagacatggaacgatggctcttgtccttgctttgtaccgcgaggatcttaatgttcattcttgctgttgctctagacaatgcaacatacaactgaccatgagagaacaccgggtcagggaggtacacgccaacatttggaatggtctggccttgcgccttgttaatggtcatggcaaagctaagtctgaccggaaattgctttctcttaaaacgaaatgggaacatctcatcgtcggaggggcataggggtatcctaggaaggaacaccctcttcccagcatgttgaccaagcactatctcagcgtcgatagtgtttctctggaatcctcgaaccaccaacctcgtcccattacagagtccgttggcaggatcaatattccttagaagtataacggggcaattgatcttaagctttagtatgtgcggaggcaatccattaggggtcaacgaatttaagaattcaggaggatagtagttgtgaggatcatcctcggcacgatcgaagctgtggtataacatttcctcccctcgaaaacgatcgatcatcttcatgtttatttgatcaacatactcatttcgtgttgacaagatggcccgagatgtgatatagtttgggtcggctagattagcatcaagcatcggaa

SEQ ID NO: 28128 - DNA, 1298 bp, Oryza sativa
tccaccgaacacaactgtcttccccccaaatggcacgtcaggacggtccatgatgtcgcgcatgcttctatctagggcctcgactgcttgccgttttgtcatagaagcttcgtcccatataattagggaagctctctggagaagtttagctgtcccactctgctttgtgaaactgcatacccctccatcatcaatgttcagtgggatcttgaatcttgagtgggcagtcctaccgccaggcatgatgcaagcagctacaccagacgtcgcagttgcaacggctatctttccctgaccacgaatagtagcaagtagagccttgtataaaaaagtctttccagtacctccagggccatctacgaagaagagacctccttgtccgccctcaatagcggataatatctcatcataagcacatctttgctcagggttgagtgaacttgacaaatccatgtgcccatgatccacctcgattgtagactcctcaaagatctctctaggctcgctgcctgaagtgtcgtatgactcatcaatttcgggtagaggaaacgacgttatttcttttcccatcgactggagcatatttctaatgtccaaaagcaccatctgctcaattgtacgtgggcacgtgtgagaacgacgatagtcatccaacattccctccaagtgcttgttccatagaccaagtacgtcacttggctcacaaaagaccaatatcgtggcaaagagcctccgtagcgatgatggcatttggaacacctcagcctcagtaaggcactcatctaatgtgttgtctgcctcgataagaccccttttttctgcagcttcacgaaaggacgagcagacttcaccatccactgtcctaaggtgttcaaaggaggtggcgccagtcacatgggttagcagcaccctaaggtagtaccgctccccctctgcaggatgagctgtcacgattctcccaatttgagtgattcgccgtttcctccgttgccatacttttgggccagcttgccaagtaaatgcctctggaaaatccttgtagaggattcctcgagcatcttcgttaactttatttgcctcaaaatactcagttagcatactcttctcgacgccatttctctctacgacatcatggagatcttgccccgcacgaaatgagaccatgtgcatgtttggaagatgcagttgtagctgtttcacaggcggatgtaccttactaaggtcaaagctatatatacgccatagtgcttctggtggggtgacccaccttgcatctctatattgttgaatctcatcaa

SEQ ID NO: 28129 - DNA, 25905 bp, Oryza sativa
  unsure (1)..(25905): unsure at all n locations
cactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagatttcaaagagtggagaaagcgaagccaagactaagaagattcccctagatccctctgatcctactaaaactgctgtaataggcgccgagttagattgtaaataggaaagcgcgctcatcacctttcttcaaaataataaagatatctttgcgtggaaaccttcggatatgcccggtattcctagagaggtgattgagcactccttacatgtcaaagaagacgccaagcctatcaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgcatgtgtgttgattacactgacctcaacaagtcttgccctaaagatccttttgggttgcctcgcattgaccaggtagttgactcaaccgccggctgcgagcttctcagttttctggattgctactcggggtatcatcagatccgactgaaggaatccgactgcttgaagacttcattcatcacgccttttggagcatactgctacgtcaccatgccgtttggattaaaaaacgcgggagcaacctatcaacgcatgattcagagatgcttttcaacacagatcggccgcaacgttgaagcctatgtggatgacgtagtcgtcaagaccaagcaaaaggatgatctgatctcggatctagaagaaaccttcgcgagcatccgcgccttcaggatgaaattaaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaaggcttggcgagcgggggatgcctttcttcaagctactgaagaaaacagatgatttccagtggggacccgaagcacagaaggcctttgaagatttcaagaaactcctcaccgagccaccagtcttagcttcaccacatccgcaggagccgttgttgctgtatgtatcagccacctcccaggttgtgagcacggtcttggtcgttgagcgcgaggaggaaggccatgtccagaaagtccagcgaccgatttactttgtcagcgaggtcctagccgattccaaaacgaggtaccctcaggttcaaaagctgttatatggtatactaattactaccaggaagctatctcattactttcaaggtcactcggtaacggtggtcacatcatttccacttggcgatatcctgcacaaccgcgaagcaaacggacggattgctaaatgggctttggagttgatgtctttggacctatcattcaagccccgaatttcaatcaagtcccaagcgttagctgattttgtcgccgaatggaccgagtgccaggaggacaccaccgtgaagaagatggagcactggaccatgcattttgacgggtcaaaaagactttcgggcactggagcaggggtggttttgatttccccaactggagaaagattaagctatgtactttggatacatttttcggcgtcccacaatgtcgccgagtatgaggccctccttcatggactgcggattgcaatttccctagggataaagcgtctaatagttcgaggtgattcacagctggttgtcaaccaagttatgaaagagtggtcctgccttgacgacaatatgaaggcatatcgacaagaggtacgcaaattggaagacaagttcgatggactcgagctcagtcacgttcttcgacacgataatgaagccgccgatagacttgccaactttggatccaagcgcgaggtggcgccttctgatgtcttcgtcgaacacctttatacgccgacagtacctcacaaagatactactcaagctgcgggcattcatgacgtagctatggttgaaaccgactggcgagagcccctcatacgatttttgacttctcaagaactccctcaagacaaagatgaagccgagcggatttcaaggcggagcaaactttatgttatgcatgaagctgagttatacaagaaaagcccttcaggaattctgcaacgctgcgtatctttagaggaagggagacaattgctgaaagacatacactctgggatatgcggaaaccatgctgctgcacgcaccattgtcggcaaagcttaccggcagggtttcttttggcctactgcagtgtccgacgctgacaaaattgtgcgcacgtgcgaaggttgccaatttttcgccagacaaattcatctaccagctcaagagttgcaaactatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgagacttcttcatcaacattgtgcatagatttggagtgcccaatcggatcatcactgataatggcacacaattcactggtggagtttttaaagacttttgtgaggactttggaattaagatttgctacgcctcagtggcacaccccatgagcaatggacaggtggagcgagccaatggcatgatacttcaagggattaaagcgcgtgtctttgaccggctaaaaccctatgccggcaaatgggtgcaacagctgccatcggtactttggtctttgcgaactacacccagtcgggccacaggccagtcaccctttttccttgtctatggggcagaagcaatgttgccgagtgaagttgaatttgaatctttgcgctttcgaaatttccgtgaagaacgctacgaagaggaccgagtggatgacttgcaccgactggaagaagtccgcgaggcagctttgattcggtcggctcgatatttacaagggttgcggcgctatcataatcgcaatgttcgatctcgtgcctttttagtcggtgacctggttttgaggaaaattcaaactacacgagatcggcacaagttatctcctctatgggaagggccatttattatctctgaagtcacccggccaggttcttatcgactcaagcgcgaagacggtactcttgtcgacaactcttggaacattgaatatcttcgtcgtttctacgcttaagtttattattgtacttccctatcttgactgtcaacatcaagttttcttcttgaagttgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtatagtacaaattatgcctccatttgctacatttacactcagtcagaatcagtcctttcatcatcagagttattattgcttggctgaaggtcgttgttgcggaattgctctacaacatcacttgcaatcttgtcagccgcactttgagcattactgataagatcaagagcagcttcttcacttgtcccgtctgcaaagccatcaatggtatcaatttcaatcctcgggtacaaggatttggtcatcgccaatgccatactagctcccatacttccagctttcttgatattcttgaaatatacatccggtgcaactctcagcttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgagatttgattttacggtctacaaaacacatttataatgagaatctgctgcattaaagagaggacagttcaaattgtcagctggcagtaccttcaacctccttcaaggctgagtccctttccgcagccaattctaccttgtctcttttcaaggcttcaatttgcttttccatctgagccattctggtggcttgcgctgtttgaaatccaaatgtttgaggatacagttatgacagcataaatcaatggaacagatctggaagattaccttttgatgaaccactcagctcgaagtttgaatcctggagctgagcaattcgttcccttaattccttctccgttttcttggcatgctccttggcctcgtgtagctgttccctaacggcttcaagagttcccaaatgtggaaccagcttttctaaggttgcagtcttggcctcattgcgaagatggattctctgcacggtggttcatggattagttttgctaacgagaaaacaaagtcatcaaaggcagtcacctagaagacttacattcacaatgcgagtggcttctccaagtactttcttcagctggcacacttcctcatcttctttttggcgatttataacaatgccggaaacttgagagttctcgtcccaccatttgagtaagataggaggacgagagtcattagctgcctttatgcggagaatttcttcttcgtcgccgcctagtggacctgatgtattcccaagacattagacgaacaagctggagttattcagaacggcatcacttgagaagatgagttacctgaggatatgcctggttgagcgtgaggtgatccttgctctttatctggagacccaatcactgagtcattaccaacttctggtccttgagaagttgtctgcgcttcagcttcagggatctcttgatttagatctacatccgactgatttccagtcgggggctctcgggttgttgcagtttcagttgctgccgactggtttccagtcggcggttgatcactcggattggccttatcgtccgaagcttgggcgccagtcggctgactttcggcagtcggttggctttcggcagtcggctggctttcggcagtcggctcagcatctttggataaatttggctctgtggcagccggatcaggttcttttccagttggatctatatcggacggtttcctgcaaagtgtcctttcgatattcagcgtaatttctattagagaagcatgtcgaaataaaatggtaccgagaggtttatacctagaagatgttctaatctttggcatttgacggccagccagttttttcctgggcatggtatgctttgggggtttattgggcgttcctttgtccccagatttgttgctgtcatcgtcttcgtcgtcattaagcaccagctttctcttgcgagaacctgtctgcccagccggtttagaggtttgaggttgcgggtctgacctgattgtcggccctccgcttccctgaacggtgtgctggcgaggagatcggcgttgagcagttgggggatcagatttcattaatacgtactcctgaatgagatgcctccacggttagctcactcaacatgaagataaaattatgttttggtcatgagttgaaggtttcagatacgtacctgtggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcgaactcgaatgctgtgcgggatctctctttgattggagctaatcgacacttaatgaaatgccgagtgatttgctctccctgtaagccttgttctttgagcttcagcatgcgttccatcagttctaaggcttgggcagcttcatctcccatgggaagagagttccaggtatcttggtatactgggggaagacaggagtactcaggaagagcgggctcgggattttgaatataaaaccagttggcgtgccatcctttgtttgaagtcttgaaaggcatagagaaatacttttggctcagagtgcccctcagttgaaatccagccccaccaactacgcatggtttatttttgttcggttgaggcttaaggaaaaatattcggcggaacatagcaaaatgaggtctaatgcccaaaaaagcttcgcagacatggacgaaatttgcaatatggactatggagttcggattcaagtgatgtaagctgattccatagaaattcagtatcccacggaagaactttgaggttggaagagcaaatccgccataaaagaaatgagagaagaccacgacctcgtgtgtatcgggggttggaaaggcttcaccgcatgctggccgccacccgatgatctccttggcagggagaacgccgtgcgctaccatctccttcaggttttcttccgtcacgtcggacggcgcccattggctttcgaagctttctctctcttccgccatcgatttttctcaaatgtgctgatttgattcgagggatggcttgggagaggtgaggaattgaggcggtggatcacgggaaggattttgatcacgttttgaaggtggatttgggtggattggtgaaccctagttcgccggcgcagctctttactgtagcagggagtggggaaaatggcgagcgttccggcggggaagacgaagcgtcgcttggatctcggatttcttcagttaagggtatcggaggtgcaaatgggcctaggcctgaacagtacttcagcccaatattttcgacagcgtggcccattgtgttccttagggacttaggcattttttgctttggcaatttatgcgcacaatagtgttgcccaatgctgataaaatcctttttatgcggtcatataattctttggaattattgcaatgcaaattaaaaggtgcccgacagaaaggtgttatgctgtttttgtacgcttttttaggctacaaaagctgtctgggctgacttggaatgacttgtttttaccatagtcatttccttggtatgttatatacctgttttcattatggtaaatagtcatagcctaggctattagacttattcattatcataatttttataatatttggtgggtaatctttagagttttatattcggatgcctgtcaagtgagttcattcgtgaaccttttagagtgtaaatcactcggattcattttattatggctaaaaagcagtcggcaagaatgtctctttaggcgccgcgtatgcttttgccgtatgatgcatgattatgctattattttgttctcaactatatgtttagtttgttaactaatcacatagttgggggctacacctaattaggtgcatctattcgatgcaccatattctttgtcttttcgccctttacagtcttcgtctttgctactcggcaggccttggcatgcataatttgaagcactcggattactatctttgagaaggctatgatggttgactgcaaaggtctcgggggctactgtggagattatggatatcccatatctacacggcgatgatatttgggctgaatataggataccgaatatagatagaatatcttatgtgtatcctgggtttgtttcttaacttgtacatcaaggaaacaccttgagacttagtcggtcacgactgtatttaatctgtatctgtgtattccgttagggatatagattaacttttgtaacccggactccttcccatatataaggggggtccgggcgcctctaggggcgaaggttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacaagcagcccatgcacgagtgactctgcttcctcgccaagatcgaacggtgactgcagcctcaagccgcagcacgcttgagtggtaatagcacacatcctgataaacgtaatcattgtaaacattggagcccttatcggtgataattgaaaccctgcctgcgagccattgaaactgacatcaatgtggaggcacctattgcggataagcttgatccgcagacagccatcacggacctcgacgaggaacctgatgcttccgcgagtgtgaatttgaacccttcaccgatgaggagaaatatggaggagtcagcttcagatctgtggagattgtgggtatcccatatctacacggcgatggtattcgaactgggtacaggatacctaatgtaaatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttccccgaatcatacaatcaataatacactcggcggattcatccccggacaggagtagggtattacttcttttataagaaggcctgaacctgtataaatcttttgtctccaaacccatacacttttctagcttgatagccacccccttttattattgccgaaatctagtttcgacagttggcgcgccaggtaggggcagcgtcaagcttttcgccgatcagtgcaatgggtcctttctctggcatcgacgacctcgtcttcccgcccgggcagacgtttcggttcggcagcctcgacttcatcaccgacaacttcggcaagatttctctcctcgactcggaatcaaaccagtcgggagagaaccggatttcggtcccgtttggattcccgaacgcggctgaaagctacttcaagaccatctcaaccgagtcggcttcaaaccactcggccgagattgcatcttctccaatgacaccagatcaagatgatggggcttacccaccggtcctgatgaagctccccgacgatttagcagccgtctccaccatgacagcgtcttcatcccgtaggcctaggcggaagtcggcttcaacaccgatttcgcctagcttcagggaagtcggcgtcatcctccaaccactcggcacggtttcgacggatcagctagatgaccactacagctctcccaccgtcgactcgcgccccaccgacatcgtggagtacgacgaatttagttctcgctacaacgacttccacgacttcgacgacttcgacggaagcctagatgacgactacacccctctctactttggcgttttcatggccaataatgagacggaggagcaacgccaagcccgggaggccgaagagcgtcgccgactggaggaggagcaccaagcacaagaacaagaacggctacggcgtgagcagcaggaccgtgagcggatcgcgaaggaggctgaggaccgacgtcaacgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcgatccgaccacgtcgtcaacatcttgaaccagacgaagaccatgatcgcggcttcggtcccagttaactccgaaagcgtccacacgccgactggcagccgagtcccccacttccgatctcatgactaccgtcatccaagcctcagcatcaccggcgcaggatccaaccgcaggagcaggggccacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccagaccgccacgacgacgaccttgacggagtagcagccttcaccgacgacctgcgtcgagtggattggccagccggcttcaaaccgactggaatagagaagtatgacggcaccactaaccctgaatcgtggcttaccgtctacggtctcgcaatccgcgcagcaggaggtgacaacaaggccatggcgaactatttaccagtggctttagcagattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgagattacatccggcgattttctgaacaacgtaacaagatctccgacatcaccgacgacgtcatcatcgccgcgttcaccaaagggattcgccacgaagaattggtcggcaagttcgggcgcaagcctcccaggacagtcaagctcatgtttgaaaaagccaacgagtacgccaaagctgaagacgccgtcaccgcgtcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagaacaaagcacgtcgaggaagaaggacgacggcgacaccctggcaggttttcaagatcaccgcaaggagctcaaccatatctttggcggccccctagcttatgaatctaaacggaagcagaagttaactgaacgagagatcaatgctgttcagcccgacacgccccagtatcttcgatggtcagagattgcaatcaagtttgaccgctcggatcatcctgaccgagtggtccacccggggcggtaccccctggtactagacccagtggtccgtaacgtcaagcttcgcagaaccctcattgatggcggcagcgcactcaatatcctcttcgccaagactttggatgatatgcagatccctcgctccgagttaaaatcaagcaatgcgcctttccatggagtaattccaggattatccgcaactccactcggtcagatcactcttccggtcacttttggcactcgggaaaacttccgcacagagaatatcagctttgaagttgccgatttcgagacagcataccatgccatactcggacacccggcgttagccaagttcatggccgtcccgcactacacgtacatgatgatgaagatgcctggtccccgaggagtcctaaccctacggagcgacatcaagcaagctgtcacatgcgacaaggagagttgcgacatggcccaaacccgcgagatagcgtctgcccgagaggaaatccgactggccgcaaccacggtgagcgaaggagaagtgcccgctgccaagatttcaaaaagtggggaaaccgaagccgagactaagaagattcccttagatccttctgatcctaccaaaactgctgtaataggcgccgagttagattgtaaataggaaagcgcgctcatcacctttcttcaaaataataaagatatctttgcgtggaaaccgtcggatatgcccggtattcctagagaggtgattgagcactccttacatgtcaaagaagacgccaagcctatcaaacaacgactccgccgatttgcacaagacaggaaggacgcgatcaaggaggaattgaccaagctgttagcagcaggcttcatcaaagaagtccttcatcccgactggctggctaacccggttctagttcggaagaaaacagggcaatggcgcatgtgtgttgattatactgacctcaacaaatcttgccctaaagatccttttgggttgcctcgcattgaccaggtagtcgactcgaccgccggctgcgagcttctcagttttttggattgctactcggggtatcatcagatccgactgaaggaatccgactgcttgaagacttcattcatcacgccttttggtgcatactgctacgtcaccatgccgtttggactaaaaaatgcaggagcaacttatcaacgtatgattcagagatgcttctcaacacaaattggccgcaacgttgaagcctatgtggatgatgtagtcgtcaagaccaagcaaaaggatgatctgattttggatctagaagaaaccttcgcgagcatccgcgctttcaggatgaaattaaaccctgaaaagtgcaccttcggagtaccgtcagggaagctgcttggctttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaacttctcaccaagccaccggtcttagcttcaccacacccacaggagccgttgttgctgtatgtatcagccacctcccaggtcgtgagcacagtcttggttgtcgaacgtgaggaagaaggccatgtccagaaagttcagcgaccaatctacttcgtcagcgaggtcctggccgactccaaagcgaggtaccctcaggttcagaagctgttatatggtattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcgggcactggagccggagtggttttaatttccccgactggagaaagactaagttatgtgctttggatacatttttcggcgtctcacaacgtcgccgagtatgaggcgctccttcatgggctacggattgcaatttccctagggataaagcgtctaattgttcgtggtgattcacagctggttgtcaaccaagttatgaaagagtggtcctgcattgacgacaatatgatggcatatcgacaagaggtgcgcaaattggaagacaagttcgatggactcgagctcagtcacgttcttcgacacaacaatgaagctgccgacagacttgccaattttggatccaagcgcgagacggcgccctcagatgttttcgtcgaacacctttatacaccgaccgtacctcataaagataccactcaagatgcagacactcgtaacatagctatggttgaagccgactggcgagagccctttatacgatttttaacttctcaagagctccctcaagacaaagatgaagccgagcggatttcaaggcggagcaaactttatgttttgcacgaatctgagttatacaagaaaagcccttcaggaattctgcaacgctgcgtatctttagaggaagggagacaattgctgaaggacatacattctgggatatgcggaaaccatgctgctgcgcgcaccattgtcggcaaagcttaccggcagggttttttctggcctactgcagtgtccgacgccgacaaaattgtgcgcacatgtgaaggttgccaattttttgccagacaaattcatctaccagctcaagagttgcagactatcccactgtcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgcgatttcttcatcaacattgtgcacagattcggagtacccaatcggatcatcaccgataatggcacacaattcaccggcggagttttcaaagacttttgtgaagactttggaatcaagatttgctatgcctcagtagcacaccccatgagcaatggacaggtggagcgagccaatggcatgatacttcaagggattaaagcacgtgtttttgaccggctaaaaccctatgccggcaaatgggtccaacagttgccatcagtactttggtctttgcgaactacacccagtcgagccacaggccagtcaccttttttccttgtctatggggcagaagcaatgttgccgagtgaagttgaattcgagtctttgcgctttcgaaatttccgtgaggaacgctacgaagaagaccgagtggatgacttgcaccgattggaagaagtccgcgaagcagctttgattcagtcagctcggtacttacaagggttgcgacgttatcataatcgcaatgttcgatctcgtgcctttctagtcggcgacctggttttgaggaaaattcaaaccacacgagatcggcacaagttatcccctctatgggaagggccatttattatctctgaagttacccggccaggttcatatcgactcaagcgcgaagacggcactctcgtcgacaactcttggaacattgaacatcttcgtcgtttctacgcttaactttatcattgtacttccctgttttgactgtcaacatcaagttttcttcttgccgttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacattcaaactcagtccgaatcagtcctttcatcatcagagtcatcattactcggctggaggtcgttgttgcgaaattgctctacaacatcactcgcaattttgtcagccgcagtttgcgcactgctgataagatcaagggcagcttcttcacttgtcccgtctgcaaatccatcaatggtgtcgatttcaattctcgggtacaaggattttgtcatcgccaaggccatgccagctcccatacttccagctttcttgatattcttgaaatatacttccggagcaacactcagcttatcaaatatttcggttgcgtcgagtgcactcggaccaccattattgaggaacatggcttggataattggtgcagcggcattggcgacgttatcccttgctccttcaagcctcttgatcttaccaaccaggacgtcaaactgagcttgagatttgatcttgcgatctacaaaacacatttatgatgagaatctgttgcattataagcagaaaagctcaggttgtcagctggcgattacctttgacttcctttaaggctgagtccctttgtgcagccagttctgtcttgtccctctccagggcttcaatttgcttcgccatctgttccatcctggcggcttgcgctgtttgaaattcagatggttgaggatacagttatgccagtttaaaccgatgaaacgaatctagggattaccttttgatgaaccactcagctcatagtttgaatcctggagctgggcgattcggtcccttaactctttctctgtctttttggcgcactccttggcctcatgcagctggtccctaactgcttctagagttcccaaatgaggaaccagcttttccaaagttgtagtcttggcctcattgcgaagatggattctctgcatgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatgcgagggatttcttctccgtcatcacctgatggtcctgatgtgtttccaagacattagacggatacactgaggttatttaaatcgccattgtttgagaagacaactaacctgaagatgtacctagctgagcgtgaggtgatctttgttctttacctgaagacccagctattgagtcgttaccagcctctggtccttgcgaagtcgtcgtctgcgcttctacttcggggatctcttgatcagggcctgcgtccgactggcttccagtcgggggctcttgagttgttgccgtttcagttgttgccgactggcttccagtcggcggcaggtcactcggattggccctatcgcccgaagcatgggcgccagtcggctggctttcagcagtctgctggttttcagcagtcggctcagggtccttggatatattttgctctgtcatagccggatcagggtcttttccagatggatctatgtcagatggtttcctgcagagtgttctttcagtattcagcatcattttcatgagcaaaacatgccgaagcggaatcataccgagaggtctaatacctggaagatgttctgatctttggcgttgcacggccagccagttttttcctgggcatggtacgctttgggggtttattaggcgagcccttatccccagatttatcatcgtcgccttcatcatcatcaagtaccagctttctcttgcgaggacctgtttgaccagccaatttggaggtctgaggttgcggatctggtctgatcgttggccctccacctccctgagcggtgtgttggcgaggagaccggcgctgagagactggtggatctgactttatcagtgcatattcctgaacaagatgcttccatagttagtcaactcagcatgaagataaaactatgttctgatcacggtttggaggtttcagatacatacctgcggaggcggattgaatgcgttgtatggcacgactggcagctggtgtgagtagctaacgacaatggcgttcgagaatatcttgtacatcctctccttcatgattttaaagtccagagagtctgggtcttcacggtttggatcatgcttgccgtcgaattcgaatgctgtccgggatctttccttgagtggcgccagtcggcatttgatgaagtgccgagtgatttgctctccctgtaagccttgttccttaagatttaacatacgatccaacaactccaaggcttgtgctgcttcatctccaatcggaagagagttccaagtatcttggtacactggaggaagacaagtgtacccgggaagagcaggctcgggattctgaacatagaaccagtttgcatgccatcctttgttcgaagttttgaagggcatcgagaaatatttttgactcagagtaccccttagttggaatcctgcccccccgactacacacggtttgttcttgtttggttggggtttgaggaagaagatccggcggaatagggcaaagtgaggtttgatccccaaaaaggcttcacaaacatgaacgaaattggcgatatgcactatggaattcgggtttaggtgatgcaagctgattccatagaaattcaagatcccgcggaaaaattttgaggtcggaagagcaaagccgccgtagaagaaatgcgagaagactacgatctcatgtgtatcaggggtcgggaaagcctcaccgcacgctggccgccacccgatgatctccttggctgggagaacgccgtgcgccaccatctccttcaggttctcctccgtcacgtcggacggcgcccattggctttcgaagctttctctctcttccgccatcgatttttctcaaatgtgctgatttgattcgagggatggcttgggagaggtgaggaattgaggcggtggatcacgggaaggattttgatgcacttttcggaggtggatttggccggagttgtgaaccctagttcgccggcgcagcttttcactgtagcaaggagtggggaaaatggcgagagatccggcggggaaggcgaagcgtcgcttggatataggatttttttcagttaagggtatcggaggtactaatgggcctaggcctgaacagtacttcagcccaatacttttaacagcgtggcccattgtgttccttagggacttaggcatattttgctttggcaatattatgcgcacaacagtgttgcccaatgctgatcaaatcctttttatgcggttatataattctttggaattattgcaatgcaaattaaaaaggtgcccgacagaaaggcgttatgctgtttttgcaagcttttttaggctacaaaagctgtttgggttaactaggaatgacttgtttttattatagtcatttccttggcgtgttatatgcctgttttcatggtaaatagtcatggcctaggctattcgacttatttattaccataatcttcataatacttgatgggtaatctttagagtttttattcggatgcctgtcaagtgtgttcattcgtgaaccttttagagtgtaaaccactcggatttcttttattatggctaaaaagcagtcggctagcatgcctatttaggcgccgcgtacgcttttgtcatataatgcacaattgtgttattattttgtctttcaactatatgtttagtttgttaactaatcacatagttgggggctacacctaattaggtgcatctattcgatgcaccatattcttcatcttttcgccctttacagtccactcggcaggttttggcttgaagaatttaaagtacttggattatcatctttgagaaggctacgatggtcgactgcaaaggactcgggggctactgtggagattgtgggtatcccatatctacacggcgatggtattcgaactgggtacaggatacctaatgtaaatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttccccgaatcatacaatcaataatacactcggcggattcatccccggacaggagtagggtattacttcttttataagaaggcctgaacctgtataaatcttttgtctccaaacccatacacttttctagcttgatagccacccccttttattattgccgaaatctagtttcgacaagatcttagtgagggaacccggtcattgcatcccaagctagacgcggcgtctgccgctgatgaggatgttctggaacccaacgatgctttattcatctccaaatgtggctgtaatttgcgcgctatatagttccggcggtttttatgagaggaggaggagctaccatacgttgtaagctcttgtgcaggggcatcattaagtactagcatgaatagcacacatgcatgacatgcttgatattgatcatgaaggggttctgaccagcagccagataatgtcactatacaagattcctggagcacaaaatgggataccaagagcatggtgtctcatgtgtagtatattttgagctcttgtgataagctcaaattcttgtttggtgtgaactcaagcatcgatgtggaaaacgtatatattcttctcgtaaccgtcttatagttgacatattcaacccctgtcatcctgctgtagcgcaacgaagcttgaaatcaagtgacacttgcaggatggcaggtatgcaatatatatatggaggtcttgtttgacacattcagatcgttgcttgttacaaccatggaattttatttcaatatacaccatgaattgaaagtgtaacatgatgcatggtagtaggccgtaaaatttcctatcatgacttcagattgatagccatatatgacatgggagatgaatttaatatgtgagcacatgaatgacggagtgcacagctggtcctttggtagtagaaccggggtaggaagacagataatctgatgactcaggtgatgctccaaagtcacgacaatgatgctgtaattgttagttccactgaagtggaactttgacctgcccatagcacaagtgtaggcaagaattttccttcttgcccccagcccactttgattggtgctcgagcttacaatatacaatatacaagtttgtcttcaagatcatatgttccaccaaggttataatcactgtatactgattatccttcctcgttggggatccttttttttttggataaaataaaatagccacaagccacattagagaagtcagcaaagataaacttgacgaccatttgtgcgcagcaaagatgggaggagaaccaggtcccactgggcgtgccattttgtttggagagaaaattcaactttgatctccccgcccagggaaataaaatgtgcgggcgtgccagtgtactaagtacacaaataaaatagacgaaggaaaatgcatttattataattctcaaagaattacaaaaatacaaaatccttggtcaaatgcgcttcatggcctataggcaaggtggatccgaattggcgattgtgttctcctgattcccggggtctcggaagacacccggttaattactctcgtgagttaaactcgtgagaaacctccgattaagctgcgctggtcgtcgtcgtcgatcttcgcttcacgttctcccatgcatgacagtgatggtggtgtagatgtgtgtgggcgtcggcaacggtccacgacctcgtcggtccatgcgccggtgttggtgacgtcttcatatagacttcgcccgccctgccattcagcctcgtcggtggtgcttgtagtggagactagcatggcattggctggggtgagaataagatgacggtgtcggtagtggtgctgagctcgagtatgttcgtggtagccatgaagaggtcattagcgaaagcatgaatgacatcggtggtggcgtcgagtttgagagtatatatgccgacggtggtcacgaagaagtcatcagtatgtgtactgatatcgctaggagcaacagagacaccgatagagattccaagcttatggtcactggcggttgaggtagcatcacccatctagtctccacggcactggtcgatcatcatcatggtacagaagttagccttctaatcgctacagcacgcacttagtatcaagtggctgtaggggatgttaggggcgtagtgaaacctgggagcgatggataacactccaggtgtcgatgaccctgttttatgcgtgctgtgtgataggggcaaaacccaattatgttgggagtgcctccgatcatagcgagcatgagttggtcacggaatcttgccattgggcgtctttagttcgagctcaagcatgtcagccgaggcagcaacgagacgccagtagcagtgttgcgtttaggcgcgtcatcggcgaatacatgttgaagccgatggctcgtcaagctcaagggcgtccttggtgatagttggcagctccaagcttgagcacgtggcggcggatgcatgggtggcgccggcgacgatgacagggtcgagcttgtcgttgatggcagccacgaagatacacgtatgccaatgagtgatgacgaacgaggatacttccgtcttgtgggcgagatcacatcaccggcgtcgatgacaattatggagacactccggtcgtgcgggtctgagagtatgaccggcgatggcgacgagtcggaagttgtcccgacaacggtgtacatatgaacattttgtcaccgagcggtcgaggccgatgagtgtgatactgtagttgttggcatgaggatgactccgtgtgatgaagcgaaagcatcgtggatggacagcacgacgacctcagcctgatgaagataaggaatcatggccagacttgtcgacggcgtgtgggcacctagcgatggcgctccagtgttctcctcaagaggcttgacaatgaatgagaggaaggtgaaattgccggcgagggtgagcgtacgtcggcggcgtcatgacgaaggaacagtggccaacaaggcgacgacgtccggcatggcattggcagcaggtagatggtgtcaccggcgactgatgcctctgatgggatgctgcagccgtggtcaccggacgacatgatcgaggatgatcaaagatgtggcatttgcttccgagcaccatggtccatggacgatcgaacaccagtcttgtgcatgcaagcatgaaactgaaacaggagaacaaaataaaatacatggatagattagctaccaatagcagtgggctggaacagcatcatctcctccccggcgacgcctccttctcagcgcacgcgccctcttgccaaacgccgaggtgctgcagccgaggtcaccagccaccgagcgcacgcgtcctccccacgagcgccgaagcagtgagcatgcaggctctcgacttttctctctctctctctgttgctgccctctcgtgtgtgtgtctccgtctctgtgtgttgtgtccctgtgtttctcctcccccctgtaaaatgaaatggacaatcttttataggggtgataagtcggttcacaggctagctcatacatggattagtatctgctcagccagccagccgcttccatctataagccaaatttccatttagcaaatatcatgattatgataattccattgtattgtgatatgattattggagcttccattctatggtgatacggagagtagtatttccatgtgaaatctcaagtgcttgctgctattatctgtttcgtttccaatctgacgtgatatggatcaattttccttgtatacttatacgctcacgcactgctcatagaaagaaactttcatatagagctatcttgcccttttgatttccttggtttccatgcaagcatgtacgtggtttccatgcatatgacgtgagagattaacggccggcaaatgatgtgattaacttcctctaatgacagtgctacagtggcatatgcttccattcccatgaaaacattcacacctttttccttccatcagccaaccatgaaattggatcgatcacgctatatcaaaatgtcgtgagtacgtatatactagagcagccgacggcaagtgtctcataatattcatacgtatacgccatgtacgccaggttgtattattagtgataattaatcaccaatttcgttattatgtcaccattcccgaaattaatactttgacacacttcatttctttcatttataaaaaaaatgtacaaaatatcgtcgaacaaatgccccctcaccaagttaaattcgagcgtggagcggctcggaattaacttggtgaaaattttccatttcctgaggaacaatgaattaagtcccacagcatatatatattttttaatctcataactacaagcagagttcaagcactgaataaaccaagacgaacttggtggttttttctatgttgaagaagcgtatgtagctgccgccatactgcttaaagacattaatcctttctactagggcaaatctcacggtagttgtagattatgccaccaaaattttgcaacaaaggaccgtatggattttcactatggtatatagtccacccggatgtactggggcaaaataaatccatgccagcgtctaatgaattaacagaacatgaggcaaaaaatccatgccattgtcgaaaaaaacaattcttcagacctgtgtattgatgataaggtctaaagtaaattaatcaggcgaacggccatgccattgttaataaatatcccacggaccagtgtattagtgataagatcccaagtaaacggatgaggcgaacaaccatgccattattaacaaaatactccttggacctctacatgattgataagatccgaagtttgataagatccaaagcaaaaggatgaggcgaacaaccatgccgatattnnnnnnnnnnnnnnnnnnnnncattcttgatgggggtccgagagtaaatatatgaggttaatatccatgccataatctatcccggtcacagcgaaacaaacgtgccgtgtccggagagaattttatcaacccacacacgatcgcttttttaaaaaaatccacgatgtcagctgaatgggttgaagggtttcacagattcacactggccgcattggcgtgctgcactactcccaaaatatgcgtagcggcacatccatcgctatatacgaaaaatcaatagttatctgggagacatattgatcggagtcttaagttcttttaagaacaagtgagacgaaagatcatgcccaaggaataagaaaatcgattttcttgcccgagacatatattaatgtcaggggtacaaggaattaagaatatgtgaggcttaaatcagtgacatcgataaaatataatttataagaccaagtacaaatggtctcaagaatatttaaggtagaaatccatgccaaaaatttattcttcaagggatcaagactagcatgaagaattgccaggcaaaagtatatgccccagataaaatttatatttcttgagacaatgacaactagtctcaaggatatttgaggtgaaggtccatgccggaaattcattcttcaaactagccggatgacacatgttagctagtctgaagaattgtgaggcgaaaatacgtgcctccgataaacaattatatatttcttaaaacccttcatgaatggttttaagaatatttgaggcgaatccatgccaaaatgatgatttattctttaaaccggcttggctgtagattaatgccagtgtaaagaatggtgaggcaacactacatgccccctgtaaacatatatatatttttcaagaccaatgatgaactgtctcaagaatattgtggcgcaaatccatgccgaaaatgggaatttattctttgaacctgtcatcagattaatgatggtctaaagaattgtgtggcgaaagtccatgccactactaaagaaaacatgtgtgaggcgtaaatccatgcctttctcaatccatggcgaaagaacatgccatttcatgaagggttttatcaaccaagtcgcgaccatttaaactccacggtgccagccgacctgatcgaagggtttcacagattcacactagccacactggcgtgctgcactgctcccatttatcgacagcagaatcaccatcactgtaggtataaataaattaccatcacggatgatttaaagcggaatggaccatcacttatagagaatgatagtgtgctatacggtagatgcatatagtactagcagaatgaaccattgctaggcatcaatttgaattgaccatgtaggtaagaaaagg

SEQ ID NO: 28130 - DNA, 4736 bp, Oryza sativa
  unsure (1)..(4736): unsure at all n locations
aaaacatgttttggcagggctaccagttgacaatagacctcccaatgcttgtctcatcgcaacctagagacttgggtgggctaagattaggaatggttttttaggacatcggctatggaataatgccattacttttgctgaagggtgttaaatggctactctcctccttcaaatcaaatgtgcaatatgccttattttctactttgatattctggagacttaaacatcaagagcttatttatcttcttcttcattttttttttatatccttgatacttcttgcttgaaaacggaatgatcccatctaaaatattgtttgatggtcatagcttgattataaaatttcttccaataactgtagttcttcatatgacttgttggagaaccatccccttgggaattcagagagtagccattcaactttgtgactaaagaacccctcgcaggcttgattttcttttttttttttttgggtcccttgttatcaccgcacagggttggcaagtggctgcacaccgcatcacaacttttgttgggacaggtagccctttcatgctctttatctctatatttttcccctggggttttgtgtctccactggtctgagacgcattgagaaaacgagggacatgttgacctcgctaatcggtagttatccgagcaattatttccattgcccccggtagccgctgcttgacatgtgtgttgtgtgatgaaagtagattgattcttttgcttgattagttttggacaagtcctagggcagccaaatctttagtcgtgagcatgacatgacatagagaaagccagttgcccctgtttcatatgggaactgaatggaattttgtaggaaaaaaacaatttttttttaaaaaaaatgaaggctataattgcatagcatctccatgataatgtaagaaagtagatgttgatggcagaagtagctagatgaaacatggctttgcactgtcctctgtatagtaacagcttgaaagagtggagggagaggtcggtgcggacgaccgtcgaaggaacgtgactcggcaccttcctgtagcaaagactcaagaagaaaatatcgatggagaagttggtgcagatggcagccgaaggaaacgtggcttggcacctctccatgtggtagattacacctaacatagtaccggcgaaagtttgaaagcgagtccggtagtgacggtgacctaggaggaagcaattcctcgttgaattggcggggcagttgtggaggtcatagatgcatcttcaacacagacagctccctaatatcacaaatagtgccacgttgcttcatgacatagtcgagcggcgctcaaaagacatgggcagcagtgtattgactcatgccggtgtagacggggctaagctccacggccacagccgacatctccgtgtcgtgattatgggtcctcgatcaggcacagctaagtggcgtccacggctgcttcgacgacctcctgtgaggaagcgtgatgatgctctcacgtgagatggtgtgatggaaatctttcgtgaggtcggatatttagttgttatggatgcgggcagctcagcgatgttctcgatggctccggtgagaccttctagatcggggatggcttggcgacatctgcagctgctccgttgatccacgacgcactccggcagggcgatgtaacgacatcctcctcctgcagatgatgattgctcggcgaggatgagcattatttgacagtgcctcgtctgctcgatgatggcaataaggtctcatgtatcgtggatgcgagcagctcgatgacgtccacatcggctccaaccaccctcgacgcactctggcagggtagcgacaatggagagagcgagcatcatggatagataacatcgatcttgacatgatggggaggaaaaaaaaacgactccgatgtgacggaggacaggttcccctaacgagaagcacgacgacaactccgacatggcaagttcgcctcagcaaattgagggcgtccggcctcttgacgacgttgcaacgtcaggtagatgcatcaccagtgactcgaacgggtgatgtcgacaccaaggatgagtagcatctcgtcgactcggatgggtggcatgacggcattcttgggcagccattgatctcactttcatgcttgctgatggtcagggcgctcgtcctcctgccggacgcggtgcttcggccgaggtcgttcgccgtcgctgatgtgctacggccgcgtttgtgctgctgctccgccgcgggtcagtgtgtattgttggtgtgcctggataggaataaatggatggatgtgttggatgtatatgattatcaaagttgatggtctactggccgccggtgcgtgcgcccagatggctttctcctcctttggcctctgcctccctatcgcgccgggcaccggtgatgtgcaagcgtcccagctgtggatgagtagatgtatctgttctcttgccgctatgttctacctttgtcctctctctatagtgagatggcctcccttctatagtggagaggagatagttcacagccagctgcatgcatggctttatcgatatatgcatggccagttgtccaactaaatactccggtgttcacgtcatggttgtaagttcgggcaattttgacatgcccccggcacaaatttaagtatgaatttgcttgcccccggttgagcatcttgaattcccgatttcttgagcacttcacaacctatgaggctgctttcgaaatcgcaagtgccaccgggttgttatcattatggaagaaaatagctcttaaccagagcatttcatcaaccatcatatgtgttggagaaagaacacgaaagatgggaggaaaccagggcagtagacaatatgagtagctcatccaacacaatggaagtgaagaaggattgacatacgtgaaaaaaatcacttgattatttttttttgcggggaaaatcacttgattattacttcgcagtgtgagaagagctcttctacgcttgattattttaataaagaaaantttaacaactatttattagccggtgttgcatgagtcgacactatttgttaaagcccttgatagggtactgttcatgacttgctctttttcttgcctaggaaattacttcctcattttgctgtacgatgaaccgagtttatctgaagagcaccaagtattgcagttgttgggtagtataatttatataagtaccatgcagaaccacggcaggtgatcatgctattaggccatcagaaatgttgcattttaagaggctaccatggttttgtgcttgttgttcaggagctggcccgcttagctccattcccctgttcaagactcaagagcagccatactcaatatgatcgctacgcttggcatggtcactgcggtcgcatgctagccgtagttgcggtgcgcgcgctcacgtagtgaccatttttgccaagccagctgtcccgtgccgcctgctcttcccactgccagtctgccccttgccacaccggcgcgcctatgaccgtagcagtgtggagattatggatatcccatatctacacggcgatgatatttgggctgaatataggataccgaatatagatagaatatcttatgtgtatcctgggtttgtttcttaacttgtacatcaaggaaacaccttgagacttagtcggtcacgactgtatttaatctgtatctgtgtattccgttagggatatagattaacttttgtaacccggactccttcccatatataaggggggtccgggcgcctctaggggcgaaggttgattttctctaaatcatacaatcaataatacactcggcggattcatccccggaaaggagtagggtattacttcttttataagaaggcctgaacctgtataaatcctttgtctccaaacccatacacttttccagcttgatagccacccccttttattattgccgaaatctagtttcgacagttggcgcgccaggtaggggcagcgtcaagcttttcgccgatcagtgcaatgggtcccatctccggcatcgacgacctcgtcttcccacccgggcagacgtttcggttcggcagtctcaacttcgtcaccaacaacttcggcaagatctctctccttgactcggaatcggaccagtcgggagagaaccggatctcagtcccgttcggattcccaaacgcggctgaaagctacttcaagaccatctcaatcgagtcggcttcaaaccactcggctgagatcgcatcttcttcaacgtcaccagatcaagatgatggggcttacccaccgatcctgatgcagctccccgacgatttggcgaccgtctccatcacgacagcgtctccttcccgtaggcctgggcggaagtcggcttcaacaccgatttcacctagcttcagggaagtcggcgtcatcctccaaccactcggcacggtttcgacggatcagctggatggctaccacagctctcccaccgtcgactcgcgccccaccgacatcgtggagtacgacgagtttagctctcgctacaactacgcggatctcgacgacttcgacggaagcctagatgacaactacacccctctctacttcggcgtcttcatggccaataacgagacggaggaacaacgccaagcccgggagaacgaagcgcgtcgtgagactgagcgtcgccgactggaggaggagcatcaagcacaagaacaggaacggctacggcgtgagca

SEQ ID NO: 28131 - DNA, 1132 bp, Oryza sativa
ctggcagccgagtcccccacttccgatctcatgactaccgtcatccaagtctcagcatcaccggcgcagcatccaatcgcaggagcaggggtcacgacgagcggtccgttcactcacctcccgatcaccatagggagcgccgagtggaacagccccgctcaccacctcgtcgccgccccgtcgatcttcgcgacacaatcatacagcgccgagcagctcgaggctatcaccactcgccgaaccgccacgacgacgaccttgacggagtagcagccttcaccgatgatctgcgtcgagtggattggccagccggcttcaagccgactggaatagagaagtacgacggtaccactaatccagaatcgtggcttaccgtctacggtctcgcaatccgcgcagcaggaggtgacaacaaggccatggcgaactatttaccagtggctttagcagattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgagattacatccggcgattttctgaacaacgtaacaagatctctgacatcaccgacgacgtcatcatcgccgcgttcaccaaagggattcgccacgaagaactagtcggcaagtttgggcgtaaacctcccagaacagtcaagctcatgtttgaaaaagccaacgagtacgccaaagccgaagacgccgtcaccgcatcgaagcagtcgggtcccagttggaaaccgaaaaatacgccggccacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggatgacggcgacaccccggctggttt

SEQ ID NO: 28132 - DNA, 870 bp, Oryza sativa
tgtgatatactcataaatgcccctccacaatattaatcagttagtgattagtgaataattagttgatttgcttgcacagtagaaacagagagagaaccggcggcttggggcggcggcgacggcgccttggggcggctctgcttcttcgcgggagtcgggcagcggcagcggcttgcacgagagagacggagagacaaccggcgccttggggcggcggcgatggcgccctggggaggctctccttcacggcagaggggcggcggaggcggctttgggcggcacggattcttcgcgggagaggggcggcggcggcggcggagggccggcgcgacggcgcggaagaagcagcgcgggatggccggcgcggcagcagcggcgggggatggctggcgcggcagcaagggaggggcggcgacgctacgatgaggcgagagagagagagagagagagagagcttgcgcggcgaggtagcagctgcgcgggagggccggcgcggcagcggcggcggcggtggccggcgcggcagcaagggaggggcggcggcgcttcgatgaggcgagagagagagagagcttgcgcgcacggtgaggcgagaaagacgaagaggagacagagcgagagagaaggggaggcgcttttattggtgagcggcttcgccgcttcggtgggaacggacaccacgcttagagtctttttaatatggtatagatatacctagaaccaaaatcaaacaaaaaaagttcaaactcagttcaatgaacttgctagtaaagaagttaatgttcatacctaaacattttcaaaaaattcatactcattcaaattgggtacatactcaatttgagtcttggagcccatactccatatagc

SEQ ID NO: 28133 - DNA, 5897 bp, Oryza sativa
cccctacacccacgagacccatggatcagtcaacagcgcggacgtcgaggcagacgcgggcggcgatgtcgacgacggagccggtgggcggtgctggctcagagatgaagaccgggagaaggagcagccaatgctccattttagatatgaagcttcttcttcagaaaccgtctgacgggacgaagaagatagcctatgagctatacctgtgcagatccacatagctttggatggtccgatgctgcgagttattccttgggccacggacatgccagtgttggctatggctccggcggcgctgctctgatccccgaattggattgacgcgattggggttgaggtgtactgatccatggctagatgacgtaggctgctgtgtaacgtaccgggcataatatagacctcagctcgctagtcgcgatcaaagctggcatgctcctacacgccaggttcatcagtaaaaggagatataataactgcaaaactgaaatcaaggtagttgcttgcttgcttgcttgcatccagcgtggcacgtcgccttgatctatgtggatcgcaggtacttgctggagctgagttgaaatgttactccctccgtttcgttttatctgacatcgttgactttttagcacatatttaaccgctcgtcttatttaaaaaatttaaataattattaatttttttcatatcatttgattcattattaaatatacttttatgcatacgtataattttacatatttcacaaaaaactataagacgaacggtcaaacataaaataaaaagtcaacggtgtcaaataaaatgaaacggagggagtactgagtaatattttgggtgcacgagttgccgcccatcatcgttagtggccagcagtagctgatgttttatgtgcattttcatgcatgtcgcataattgttgtaacatatatatgacaattcggacttacgtgtacgtctcttacttgctaggaaaatcatggcgtgagttacatgtaaacaaagcaaattaagtttgtcaaggtctcctcactccggccgttccatgggaggaagttcttgctgatggacaatggatagaagaggaggatgcgtgagcgtgactagtcagcataagctttactttgctatactagtcagcatgcatgtggaatccacgttaccaaacaaatttatgaaaatgttgaatatggatcccatctgaatctctatttagaaagacaatcttgaaagcagtggaccaaatataaccatctacaacacacccacttctttgccgattttgctatacttcttacgaccgtttttttttttttgcctcaaatcactcgaatttgattccggcggatcacttgggcatgatttaatttgacagttgtgatttatcccttaccaccacggcaccacctagcagtatctttatcgggcacacaatgaacaaatgaacaatacaaacaaactgatgagtacgggcaaaaatatgaacagatgcaagttagttttgtttgatgatttgatgttctattttttcatgtcgaattagggcaggaaattgtggatttagtgattatgtttttttctcaattctttagtgcttacaaccaactatattgtaatatgtatttgttgtacagacaaaataaagtttatgttagagttacgctataattacactatagttacagtgtacttacattgtacttacattgtaattactatgtaattatagtgtaactatagtataactacaatgtaacttttggatgggttaatcatattttttatacaatataagatctagcaaataaagtatacaatatatatacctgctgatatcatactataaggcagctttcacggttacgggttaacgatgtgattaagaatttgactaattttggttagaaaatactcgtatgtgactgtagcatattaatgaactgatattatctatggtggtatggtgcccattggtatgcagactaaacatgcctcttagtatcgttgcaagtatacttgccaaatatcaaaagcgagaagcaaacccgagtagaaatcaaccagttacaaataaatttgtgcctctacagacctgacaatctggatcactaaggctacagcatgggatgctgacttcataaaagagtatacacgtcaagtttaaacatcggtatttttcttcttggcacgggggccgtaccacttcagcagacatcggtaggagggcagcagagccagtgtgtggcttaaatttctgtttttcaaaaggtagcgcatcttgaacacttttttgtgcttgcaatgttcacctctgggatttttatctgctttgtacgcttccagctcaaagccgatggagagctgtcggctctacccttgcttccgaggttgattcttcatgtgctaatgtgtcgtagcagtttctatgtcattagctttaactgttcttgctgcttttatctactattacttgattgaaatcaaagtatctgttttcgcttgtttgggtgtaggaattaaggtttctgtgtatgtttcatatgcggtctgtggagcacgctgtatttttgtatattattatttatttagtagtgtagtctatttagattagagggttgtttgtctataagcgggttacatgtgtacgtgtatgtactttggacttaacatcctccttttgtttgctttattggcatgttgtgagtattatacttatcataaatggaagattaaattagtcactacatctataaccttctattcatcgtaaaattatcagtttcacaaccgaatttcgtaatatcacctggacccatttctcagcacatatgcacttcaagatggttgcgatgtttatctttgcaatattcatatgccttatccgctactggctcaaagcacggaaaatcaagagtatacttggccttggcctccggtcaattcaacaccgcgtgggggcaaatgccccctataatttttttacttagttattgtaactaagtagtagattgtcggcctacacttgtcactaatagaattcaatggattccctagggagtttattgatcccatagccacgtacttggagtgccacactaaaatacactcaaaaccactaactttcaaaattccacgacaaacagttataaattgaactagtaataatatcattcccatagtgtgatccatccatataacccatggaaagaaactaaaagctatctaaaatattattacaagaccgaaccatgatatagtttaagtatcattatggacctaggcaatatagtttcatagtgtgcagataaatgtgtatataaggatgctacttcccacccatgcatgtcggtctcaatgcgtacctaaaaactagataaaacacaagactaagtacaaaaatactcagcaagtacaatgtggaactagaaaacacatgatgcaataaaacatgatgtgatgttgtatccatcgccgttcatcttctattgatttcttcataagcgcattaatttcttgcccccaagcaaaatcagctttcttgattacatgatttcgaaggcaaaacgataaactataccggtttcggacccggtcagcagcactgtttctagtgtttttcctgaaccgtttatcagaatcaaacgaaaccagaggtgttgaaaagataacagcaaaaactacaaatcttatttaggtcaccaaacttgaatctctatgagtaattatcagatttgaaaatacggtttcagcctagcggccgataaaaaataaattcgatctaccggaaacggatcgtcttctatataaattagaaacaaccaggggctaaaacgaattacctagcagtactagtttataagaagaacaatgaatttagaaatatccaccaaattccccaatttctcctattatttttcctgtcctccttgttccttctctgctttgctcttccattctctaaacgttgtagaagaagcagcagcagcagaccacctagcagcagcagcaaggaacgttggtagcagcagtagcgagcaaatcacaaagcggcaacaaatcagattgaagctcaccggaatgagcagaatagaaaggaaccaccgatgacgacggaggatgatggctgcagcaaccggcaacggtcggggcggtggtggcgatgcagaagcggcggcggcgtccgcaagaatggcaacaatggcggctagggcttcaagtatcgatctgttcttttttttcctttcttttttttctgttggttaaatagagggagcctaacaaagatcgagtggcccacattaattcgataaccggaaattcgtcaggactccgattaccacaaacttatagtctattttgcaagatacgctacctttcaaaaaaacagaaaattgagccacgcactggctctgctgccctcctaccgaggtctgctgcagcggcacgacccctgtgtcaagaagaaaaaggtcgagctgtacctgaacgatatggaacagctcggtaactacatgttcgaaggtgggccatgggatcaatggaactccctagggaatccattaaattctatcagtgacaagtgaaggctgacgatctactacttagttacaataacttagtaaagaaatgatagggagcatttgccccacgcggtgttgaattgactgggggccaaggcccccaactaagtatactcttgatctcacgtgctttgagccagtagcggataaggcatatgaatattgcagagataaacaatgcaaccatccagtggtggacccagcagtaaaatttagctatggcggatcaatgtgatatgactagcgtattatactcttaattaatgaattaaatataattatacacaaactatatactacaattgcacttattgaaatacatgtcactaaaatataaaattaccactataattctatatttgtcatgtggtttttacaaccaaaattttaattttctttataatatatctctattttacatatgttgtcactcatatcgaccttttttcagcatgttgctgccttttgtgcatatggtttagagcttggatagtcaggccaatcaacagttatttctgaaagtagagaagtagtaaaccactgttacacttacatccatttaactaaactgataaacttgtactaaatcagatagcaaattaatcatgtgattatcatctaaaatcaacatgctaatgaccaaatggacaaacaccaagcttgctttaccggtggcctagctatggcccatgccatggcatgccacaagagaagttccaccagtgcaaccatcctgaagtgttgaaggagtggtcgaggtggttttcaacttcggttttgactgcatatgtgctgagtaatgggtccaggtgatattacgaaattgggttgtgaaactgataatttttagtgactaatttaatcttccatttatgataagtatcatccgcgtttcggtacgggtgataaccacaggagacatggtgctgtgattgcggggcttaagagcgtgttcattcaacaagcccaatcgatttgtgtcgcgactccggctaaaccgttgattatcagaacctttcggaagatcaggaaccctagtccacatcaactagtgaatgaacatgttagttgcatagtcaaaccaccactattgagtttaaataaaaaggttatattatccacttttttaaatacttgggttgtattcaatttgatgatttttgtctacacaactgtagaaaagaaattcttggtgatatttgaagtgccatgtttttctcatataatctatcatgttattggcaattttgataacaaaggagaatattatgcattgagtatatttttgtttgaatttgaatgtacccttctttttat

SEQ ID NO: 28134 - DNA, 5157 bp, Oryza sativa
attcctgcagcccggccaacagtctctaaaatgggcctaagcacagaaccatcacattataaaatgttttgatttctctattacttatctagaattgctaacatccatatgaatttagaagcatatatgttataatgtgaagcctatttaaaacccaacacatgttataatgtgaagcagaggaagtagtatttgtgagtgacatggcattacagaatttaccgttatttacgtacggtaccatagatgtcagattttatgatacaaaatataagggctaccacaatatgctaaaaaaaagtgatcttaagtaataaatatatagttaaggtgcatatacattgtacaagttaaaaatagtaaaaagtttcttgtgatgtaccttaagcttacaactaaccttaacaaaaacaagtacttattctttcctttactttctctctcctcaaatcacttaagagagttgggagccaccttaaattttattgagaaggctaatctctttttgcgaatcgaagaacacaaacaagaacaaagaagatacaaccaaaattgtagatgaatgatttagctcataagttggggtcttacaaaccgaactagcggcgaaattgttctcgatagaataatctaaacaaaaccccaaaccctaaaggtgacgacgggtactgatatatagattttagggtcgtgcaaccaacccttgatgcaaccctaataggttccaacacgatacacggaccaaaggcctaaatacgatgacacagcacttgaagacatcaacttgttcggtcaactagaaaggaaacccgcgcagatgcgcgggtgtcttatattactgttttatgaacacaacgctaaaaaaaaccatatttgttatttcctccgtttcatattataatactttctagtaatgcccacattcatatatatgctaatgaatctagacatatatgtatatgtgtacctaagattcattaatatctatatgaatgtgggcaatggtagaaagtcttataacctgaaacggaggtagtataagatatcgttattaccttataataaaaaagtatctacattgtcaaatagaccctagataatatgttagatgataataatttctcccagattctaataaaaatgacggcacccggttacgtataaattcccatattatcaagactacttattatcattgttttgaaacccgggcatatttaatagatgaaattgcatatgtcctatcaccaaaattaagcctaatacattattaatatactaaaaggtttaccattaatctgagtgtttgggtctcacttatttccaaatccatatataattattgcaagaatcccacttctataggttaatggaataacaccgttaaaatttgacataaatacccctctaacgggtgaagcttgccatagccgccaaggctttctttctccattaccttgaaaaaggggtcacgcatccatgtagccatgtcacttaaacctggcgttgaggacaattatcggcatgctcgtagaggattacaacggtaagtagaaagttgagcactattaccaacagtgacctccaatagggccacctaaactcagccatatgtatgcctttgctgatgcttacaacaacgtagcaagttttctcatccatgtttgatgtccttcaacgaaggacaagagagatgatggagatgataaacatagtttttctcacagaaatagttttatttacgttttgagtagatttgtggtataaagtagacatgatttgtttataatgttaatcggtactatttaatattttttatggatacaatattctcttttgaagataagcatggttgatcattcgactgtgcttaaaaaactatacataaagagacatatcacgatgataatctaaaaagcatcctatcattagtatttatattttgacctagatcctttttttggcaacatttgcttttaacacatgttgttcgtaataatatgaaaaactttcactaattccaagaatatatttattttctcaaacttatttacataattaatttgttcaagtgcacttataggcatcgttcgttctggtgagataggggagattgagtctcgtttaccgcgcgcacgcttttcaaactactaaacggtgttttttttgcaaaaaatttctatagaaaagttgctttaaaaaatcatattaattcatttttaaaatttaaaatagttaatactcaataatcatgagctaatagctcacctcgttttgcgtatcttcccaatctcctcaatccccttctcctcaaacactcccatagtcaagttagtgggggatatggcatacatatagcaattatgcccgacatattagaattcatcaacaataataaaatatatcatgagtagtttaatgtgcatgctattggactgctcatttgtagctaaaactattctgcatagaaaaatcatacatataaccatcataatccttgttatggattaaggtgcttgtgttatagaaagatcattgactcgaaatattttttatagtatttttcacattaccttgtatttaagaaagaattttccaggtgatagaaaacttgggagcaaagaagggattgggtaaaactttagggtcacatagaaaattttctctaaaatatgttgtgaaattattttaaaaaaatatcatgacattaattattttatgttggtcttatgtgtcctgatgtatttagcattataatatcattactataagtccacggtagttcatttaattagaggaatacaatatgatcacaaattgaatatctgattcaaaaataatttaaaacatggacgtatgtttagaagtaatatgttttatttttatattatagaaaattatatagaccgtccttttttccccatgatactaacacgcgtatacatgttttatttgggctttaactttttctactcgcacgtactacgtatggtattttgggttttttggctggtgaacagtacatcggctttaattattttttatcgtaagtaaatacgttgttaaattttcccagcgaaatagttacgtattttgtttgtatatatacacgggagatttggtggaagggattaattttgttcaatagatctaatctaatggtgtatactaatgggcccaccagtttaaatgaaaatcgatggtgagatggtttgcttttctataaattattagaaagtgccacgtggcggcctaggaatgtctgtaggagtccacgtggccgcttgagagcgtttgtaggaagtttaatggacttttagtatataatagatagatagattcccattgactcggaaacaatttggatgtgggaccaaaaccattggaaaggttatcttcttagctttccatccatataaagaacgccccaatccgagcacgtatgcgacctgggcacccgttttagtgtagactagtcatggactctgaattgcactcgaagtcggcttggtttgggcctccaccttgacttgcatgtccttgatgattctccatggctctaagtccttctccaagtgtctccttgtcctctccattgttgctaatcacaatataatcattaggtagcaatctattctcaaattcatacaaagaagaacataggaatgagctcacctctaaattcaattgtcgcgtgcgagctcttgttatcggtccttgaatgaccgttggaggattgttgtgtgtatccgaaggagtgatgtccgcatcgctagttgtagtatggatataagtgagacaacacacaacttttctttcttagaagaaacatcaagcaaattgttttatgacaaaggtatttcaacagttgtttccaatatgggttgctctaacgtaacatatgtagtgggcatatttcgtacatcataactattcataccttgagtaaatgtcgcaccattatcatcaccattgttctcatcttcagaaattgttggcgcttgctcaattaaactttcttaaagcatgcatggagcaacgagtaggccttcttcctctatgcctttcttctcttcctctttatcctggttgttctcaaatacctagaaaatgttagtaaatccaaaactcatgcaacaagtggcgggtatggcactgttgcagcggtggatgaaggtcgtgtactcactggcggtggtgtagtatgaaaatgaaggcttagctagtccagtaatgttaatctttcttggcatgcaggatgtgccaaaatttctctggttctttcgttgatgttcctgcaactcgttttctacaagcatagcaggctggaataaactattgatagtagtaaattctttattataaacaatatcctgaatttcgctcctcaacccaccataaaaacgaccaattgtatcccctgcttcatctactactccgtaacatatcatacacttttgaagctcgagtagtatttatgaacaatcatatcaacttgatattaatgttgtaatttcttatgcaaatcacgctggtaagaaagaggaacaaatctattacgcatgacatcttttagcttattccatatagcaggttgtaagtggatatcgcttagatcattccactagattattgcaaagtccttgaacacactagtagattgtctaaatctatgtaccttaggaactaggtgtgagttaaacttttgttctactatcatctcccaatcaaagtattcctcagtatcacaagcaccagaaaatgatggaatactaaacttgactttaacaaaattattactttccatacattgacgtagttgttcatcttgtgttgcttcatggccaacctctccatgttcatgggtactatatcagaggagtagagagccattgaactcgtgaagtctatcgtttagagtagctaaccattttttctcatgctcaagggaattggttatgtctaactaggtaatagccactactggaaaattaactattgccacataaatattgcaacgatgtataaattgttgcaattagttacactgtagccacaattttattttttgtggtatttataatagtatatcaccacaatatataattgttgtaataatagtatatccacccttttcatcgcttggtctattgtacc

SEQ ID NO: 28135 - DNA, 2423 bp, Oryza sativa
taatgtgaattatttttagggacttttttcaggttgaaaatgattaccatagacaggcaacctaagatgcctgcccgtggaaatcatttttcacaagtgggtgatctaatttgcctgactgtgaagtttgattttcagtgccggctgtttcctgcctacaaaattgatgatttctgcgctcgtctagatataggcggaccgtcgatctagatacttcgatgaatggaataacactttgtttcataaagaatctaataaagtatctatgattgcaatagcacatgactatatcaccaaatcctagtaaacattttcttcgaaaggaacatactctattgtcaaaatgacatgttcaacaattccggaagtcacatttttctagctataatatttggccgggtaggcgggccatggatctagatacttctatgaaataacactttgtttcataaagtatctatgattgcaatagcacatgactatatcaccaaatcctagtaaacattttcttcgaaaggaacatactctattctcaaaatgacatgttcaacaattccagaagtcacatttttctagctataatatttggccgggtagccattgacaccgctaatccaaacttctcagccatgtctaaaccattcctgttcaccatttgaggcattgtccatttaaattggtgcataagcgagccaagtatcatgtgcagcattcggttggcaagaggcaatccaatgcaaatgtgcctccctgaaccaaatggaatgaattcgaagtgtctacctgcaaaatcgatatcttttgtaatgaatctcttggggaggaacttttctggttgtatccaaactttaacactttgatgaatagcccatgcattcactattactttgctccctttggggattgtatgtccttctatttctactgtcctctctgcctcgtatagtcgcaaaggcacaattgggtgtagccgtagtgtttctttaacaattgcttggagatagggaagttggccaatgtcagattcttcaacttgagatctagtgcccagaaccatttttatttcttgttgtaacgttttcatgatttcaggattttgaagtaactctgccattgcccactctacagtagttgcggtggagtcactccccccaacgaataaatcctgaaattcattcaaattgatgattactgcacagtttatttcaacatatatacaatatgtacagttattgaagttccgatctaagggcggatctacagtgtcaatgccggtatcaggtgatatcgacgacttcagcatatatggttaaactgcttgtctatatattataacactatgatataagtatgatgagtatactacaatattgataggcaccttatgacactaacgaaccaattttttttgatccgtcactgttctgatcggactgacaatatgtacatatcagtgaaaatcaattaaaacaacaaacgtaatatatatgtccatttagaatttacaaataaccattttgaacgactgtgtttgactccttttaggtgtaacaaaaaccttgtgtttttattttcattccaaaatgtagttatgtagaacatgtattttttcagtggtcagagttcgggagttcttttacttaccgtgagcaacgccctcatcaaatcacggtttatcacctcgtcgtcgccatcttcccgctcttgctcggacatgtcaaggagcacgtcgagcaagtccatggcctcgccgccgcggccgccgcgcaactccctgcagcgcatccgatggtcgatctgcgcgtccaccagccggtacgtgttcttcatcagctcggcgagcctgcgacgcaggccctggaggtcgagcgcggcgaccgccgggaagaagtccgagacgttgggcgtcccgaggagaacggcggcctcgcgcgcgacgtcgcagagcacgtcgagcgtcgccgcgtcgaggcgggtggagaacacggagcgccacagcagctccacgttcgccgcgagcgccaggcgccccacgttgaccggcgcgccgccgcggtggtccgcgcgctcggcgacgcgccggaggaggccgccgacgatctcgtcgcggagcggcgccagctcggcgagcttccgccgcgagaacaggtgcgccgcgccgagcttgcgcagcaggcgccacttgcggcccggcgggaggacgaacacggagttctccgcgtggccgccggcgtgccacgcgtcctgccggccgcggccggcgaggctggcgttgtgcgtctggagcaccgcgcgggccgtcgccggcgaggaggcgacgacgcaagtcgcggcgccgagccggacggtcatgagcgggccgtagcgctcggccaggcgcgcgaatgagcggtgggggaggtcgccgatgtcaaggaggttgc

SEQ ID NO: 28136 - DNA, 777 bp, Oryza sativa
cgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgtttcagtagtcttatagcatgttttgcttgtgtgctttgttcgtcgcgtaggtttcggccatttattgtttaccttatgccattgataacttgggtatcaaaatgactagatgttggtttaggaaatgcttagccatgcttagttcaattagcacacacatggggatcacattattacatagactttgactatgagcatagctttggattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttatccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacat

SEQ ID NO: 28137 - DNA, 515 bp, Oryza sativa
tggctctagttcacgccaggaacatcggtaagtccgatgcatggattacacggcatcacattgatactttccccgcgtggctacgacaacatctcatggataacgagtcaatcaaccaacaacttgccttcctggcgaggggaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgcgaaggacatgtctagcaaaggaaagaagggc

SEQ ID NO: 28138 - DNA, 914 bp, Oryza sativa
  unsure (1)..(914): unsure at all n locations
ggatccccttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaacccgggagatacctatagaacgttccattcaagcagatcgcacatcctgttttacctttaatttgacctaaaactgaaaacattgctggataatcattaatggtcacgaagatgatggccttcactgtgaagtattcccttaagtactcctctcacactttcaatccctctttccataaatcagccatatcttccaacaatggttcaagaaatacgtcaatatcaataccaggctgacggggtccctgtatgaggatacagagtagtacgtatttttgcttttgacaaagccagataggaagattatacatggtgagaagcactggccaagtactatgtgagctgctcatgtctccaaaaggattaactccatcagtactcagggcaaatgtaatgttccgtgggtctttagcaaactctctgtactgagcatcaaagtttatccactgacgagcatctgccgggtgtcgaatcatcccatccttcttgcgcccttcttcatgccagtgcattagttccgcatctcgtgggtttgagtatatcagtttaatgcggtctttgacaggaaggtaccacatcacaagctgcgggatttttctctgtcgtccctcagttgtgtcagacggttctaggccagtattgctattcgatttgtaccggctagtaccgcatgttggacattcatctaaaaaaacgtactctttcctatacagtatgcagtgatttacgcacgcatgaatttattccacaccaagtgaaagagggcatatgggtttctttgcttgatatgtgctgga

SEQ ID NO: 28139 - DNA, 4035 bp, Oryza sativa
cgtgtccatatttcgtactcgtccataaatccacgagttactaagtgctccttcactttaaaagcatcgtcgaagtcccagactatttcattcttacagtcagcacatggacaaattatcttcctcatattgttcttctcagcgtgtgccttggcaataccaataaatttagacacttcgttgctatatggagacaaaagcctcggccaatgatacatccattcccgactttccatatctctaaaaaaatgcacataaaatatttgcacaattaataccaaatttgtagggtttattgaaaaaacttatcgctattcaaaactaattaactaaaggttaagtgtaaattaataaaaaatcaaagtttatttcaattttttttacacggacatgccaaattagtacattaggaaaatctaacaaaatcagatcatcggcatattacaaaatactataactatactatttttttattgcaccgaataaatagacattaaaaatttttttctctctctatatatgacaagatctagatctagatctagaactaagaggtggatgtgatagcaaaaataaaaaaaaaattgagaatttatgttaccacatgaaaccactacaacaagaggcatcaagtattacacatacatctaacatcagcatatcaaaagaaataaaattaaaaaacatggagttcttccttcacaattttgcatgcataaatccatcacaaattaaggtctaaaagcttaaaaaattacatacctagtgtggaaataagtagatctaagcaccgtagaaaaatcacccgaagatttgaagtcaaaacctcccccctatatttaagtcactttaggagagagaaacttcggggagaatgaacagggctcggggaggaagaagactatataggggcatcttttcaggcgggccatataagctgtcacaccctacaaatcccaaaatgtataaattgttgtttaaatgaaattattagaaatgattttaaaagccttgaagaaaagatctaattttaagtgctaaattccaatataaaagtgggccagataaaattttattaaatacttcacttgattctatagttcctagatttttctgggatttatttgagccaagaaagtatttttaataaatggaattgcatttcatgaataatttaaatataaaaaggttttaaaatctcccttttggctttgggccgaaagtcggcccagttctctccctctctatcttcggcctgctagagcccggcccatccagccccccgagctgagccgcccgctctccctcctctctcccgctaacaggtggggcccacctgcatggtcgtcgtcttcctcctcgcgccgcagccgcgccttagcgcacaagccgccgccgcccccttccaaattccgtcgcccctttcccgatccagtcaaattggtagaggggaaatgatcctcttgatctcctctatcttttctcctatagaaacttcatctaatttcgtttggaaattgttggattcgagctcgattcggattcgtttttccctcctaaccttaaaccttccttctcgccgccggccgccatgggcctccatcgccgccctctagcccctatataaggacctccgagacctcctccatccgtcgccacctcgccttagctcgccgccgcttgtagcgccgcctccgcgttagcctttgcgctgccgtcgccgccgcaagtccagccgtgcgccgccgccgctccggtcgtcgtcgtcgctcgggaaggccgccgtcgggttcgccaagtcatcgccgttcttgtcccatcctccgttttcgccgaagaccgctggagcatcgctgtcgtcgtcgacccgtgcacctccgccgcttcgacctcgccgccgtcgccgtccgttgccgtccatcgtcgtctgagccctcggtgagttcgccgcgtcgccctctacgcgtaggtgtcctccgtttgcgccgccgcgccgtcgttcgccggcgagcgtgagttgctgagccgtcgccggtgatgacgtcatcgctgacgtcagcgccgcgtcatccgtagacccgcggtagatcgattagatcccggccgttcgttttgggctagattagatctcggtcgttcgttccgtagaccgtctccgtgcacccggtccaccatgaacccgagccgctgacgcaataaatcatttttccttttcaaaaataattctttattgcgtcataattcaattaaaatctaaataaatgatttaatccgatttaatctttaaaaattcataactaattcatcttagctcggatttagttggttcaagtctctaaatttttctaaaattgagatctacatgttaaaaatatccacatgtgctgtttacgattgtttatgtactgttttggtgattttgctcttttatgcttagattccgacgttcacggagagtctgagtttgcaggagaagactttgaagagttccaaggccagcaaggcaagtcacacagatcccaaacaaccctttgagcatgttgatcccgtttaaagctattgtttctattcaactattgcatttatttttgaatgtcattgggtgggaataacctattgcttttgttatagccctttgatattgattacctatactttgtcacctggttaataattggattagctagaacattatatgattttagctaaagtaattaggatgcttagccatgcttagagactctagctcatatgaatgggataattaatgattcactattacttaatgatggcttaatgatagctcatgatggttaatcatgataggatgattaattaagatgccaactaaaacatgataatggtgagttgtgagcacatggttttgatggtcgtgctcatgacaattaaggaccggttcacgattttcggttgtgaaacattaaccgtcaccataagccagcgtgggcaacggctttaccttttgtatagtgtggttcattgtagagcaccagattgtgaagtgttggagataagctcacgggggtcgctggggagtccatgccttgtttacaagggggtgattatgattcgagaacggtacactgctttgatttgtgttatgcagaggatattgtcacaatctctattcgggtacttgttaagtatcgcgacgcatggttgacatgatgttgaggttatgtattgtgggtacagtggtacacctctggccagagtaaaactattcaaatagccgtgcccgcggttatgggctggtcgaacaatgtctttcgtgattagtctcatacttctcaccataataaatgatgctgtaattgataataacttgtttagctcctggtttggaatggtatattcctggtttggagataaaactgtgcagccgggaatggttgctcggaatggttgggcctatgcaacgggtatgttgtatagcgttggattaatattgtttaattaaatactttactgttttattaaattctgaagtatttgttaaatgccatttatgcaaaatgagactatattatgccatcctttgttatcccttgcatctgcatatttgctgcgtggcttgttgagtatgtcatatactcaccttgcaatcattcatcagaggaggagttctagagtgatgctgaaggtgtggagggttaggcgtagtcctggtcaagctgcttgtggaatggagtcgcctgcgccgtttatcttattttccgctgcttagaactttattgtttgagaggaactatctacctctgtaatgactttatattcgcttattaattagagtaataattgtactctattatcaatttgttattgtgtgcctcggctgattcctggatgagggtttacacacatgtaagcgtttggaattttggatagaaattccgagcgtgacataagcggcgcctgcgaagattgatctttgcaggcaggccatataagcgtcgcctgcgaagatcgttcttcgtcggcacacgacgtctgccgcctgctaagatcgatcgt

SEQ ID NO: 28140 - DNA, 8575 bp, Oryza sativa
cttccaaactgccaaaggacctcggttgcactagttttgacagctcagggatcggctgtatctgtttttgaggttgaaggacgaaaattagatttattggaaaattaagggacctcagatgaacttatttcggaatggaatgtaagaaaaaaaaatctatgatccttacctcaaccatggtcatgaaaaataatatgaaggaagatgattggacattgatttgtagaattcaatgatttatagatggtgttgcagatgacatgtttacatgttgagctttagaattagtgggttataactttacagtaagataggatacacgagtcctaggcctccactcttttttggcacacaaaacatcattgcagcaggcagggaagatcctgattcactctagcatattttgaattttttattcggtggaagcagtgatttattccacaaactagcaatcatctcacctattggcttaggctagttcctttcagattatttatcgaattattaaatcagattattcgctccatgtgtctgtaaatatatttttaaaaaacttaagtttggaaggtgcttgtacgagtagagtgtgtacgttagtattggttagaccaattattttaggttatttatcaaaatatttaatttattcatagaattaagtaactgatctgtttcaaactaagtcgagtagcttaattaactcgcagatcgtacgtgcgtcctccatatataagtccacaaaaatactgtgtcataaatgatatactgaaaaaagaacaaatgtgcacgaataaactttattcaaccgctgacttatttaagcgtagattgttcacattttgtacagagaaattaaagctgtaattattctttgcatatatatatacggagtatgtacaagaaggaaccgccatatatgcatccaaagaacatgttaatacaacactagagataacaataacttaatttagaataaaacaagttgtcatcattttgccttgtcttacaaagttgaccagcggtaatgcacgccctaattaattaaacatgttcatctcaagatggcaacgataaaaacggcgtaccaagaaaacctcaagcttctgtttttctccatttattgccctaattaaccaccaacctcataatcctagccatacaattcgctgctaaacctgtccttgaaaccactatgtatatccaccgcaaagccggccacggcgtcctctagtcgcaacaatggcgcgtcatcgtcccatgaccgccgtcttcttcgtcttcgtcgtcgcactactgtcgtcggcttctccggcgacagccaaggcgacaccggcggcgccgccatgcgtggcgccgccggcggcagtggcgttcctccgcgcgagctgcgccagcacgctgtaccggctgacctgctacgacgcgctcatcccctccgggtgcgcgttccagaccagcacggtgaagctcgcccgcgccgctgccgacgtcaacgcggcgagcctcaagaacctgacggcgcgggccaaggagctcgtggcccacggcgtccccggcgaggcccccgcgatcgccgccgagatccgcgactgcgcgagcgcgtcgtcgtcggcgtccggccacgccaaggagacggccgccgagctcgcgaggctcgacgccatgggggacgccgccaaggggagccaggcgaggtgggcggtgtccaacgcgaagacgtggctcagcgccgcgatgaccaacgaggccaactgcgccgacgcgctctcgtccacgggcgccgccgtgtcgccggccgcgagggagttgatcgccggtgtggtgatggccaagcagtacaccagcatcgccctctcgtttgtcaataccataccggtttcttgaggtgtaacttgcatcgtcttgtacctccgggttataacattcgttgtttcggacaaagacgtacatgaaacaacttttgaccactatttcttattataatatatatatctatctctatctctactacttaaaaaattcaaaaggtttctctgtctaaaataaaaaagagtaaactgcactcaactcacgatacacaaacttgcgtggtgggtgcaaatagatacaataacttgtaaattgtacattttagtataacaacttgtctagtccgtgcaaaccaggccaaaacagaccatgcattcaaaataatttgatgtggcgttgacacggatgccatgtcgctttccttcttggctcgtttcagttcatgtttgcgtcttcttcacaaattaaagttataaaatcataagcatatggaaattttgtttcgtgcattctattacactcacccatccctgacatagttcaatgcaacatggacctaaatcgctgactagctacaagtgctcagagatattggtgaagggtcgattggccattacactaccgttttaatacgtggcaattagtatgtgctattgctagtaacaacttgtatgagatgaagctggcatctacacttctgtcgttgatcagtctcatcaccagccactctagttgttccagtcttagaaactactactttggtattacaggatatgtgcttctttccactactgcaacccatcttcttgccattactacggtgtgcaactaattgtctcctcagccgcatagttccagtgccacatcatgttattttcaaatacactgactattttggccttaatttatatggactacacagttgttgtaccgaaatatgcagtttgcaagttgttctatctatttgcacccaccacacaagttcgtataccataaatgcaatttactcaataaaaaaagagcaaaaaaataagtccgaatgtatggtaaaaagcacggcaaaaaaagtccgaatatccgttttcatcatccgtgtgtatatcttctctatctctaatctaatctaatatatgactcttctctatctctaatcaaatctaactattttaaaaacaaaagtttccatcgtgcgctaaaaaacaaaacatacaccaaaaaataaaatcggtttacaaaaaacgcgtgagaaaaaacacatgagaaaacaatgtcagaaagcaaaaaaaagcgctagaaaaaaaggtttccattgtccgtaaaaatgtaaaaaaaatgtgtgagaaaaaatattcccatcatccgtaaaaaaacaaaaaaaaataacatgcgaagaaaaaagtcacgaaaggagccatttctaaaataaattgtttgaaaaaaccacgcaagaaaaagaaaacaccatttataaaaaaaaacaaaccgctctaaaaaaactgtgaaaaaaaacactaaattgatggacgcttggatcggataggatcatcgattttttttcatctcctacaaggcttttgtttcatcatctattcttttgtattggagaccctgcatgtctctataggcaattatcggactatttttgttaagtaaagctactattcttgataacatattatatggaaataatatgaaaaaaataaacatatatttaattgttatctagagaatagttcatagtgactctattttgtgtagacttgactatgcgaggtaatgtatgatttgattgattctattattggttgcaagaatgagattgaaagagtattttagataatatgcatgttgtcacatgaataattcaattattttaggtaaagcaagcatcggtaaggttgccatcgttaaggttgggtcattacattagatgttccagttttctgattgttctaaaacaatccatacaaacgttattattgccatggttatgcataaaaagcgtatattatcattagaattttttcactcgttgcaacgtatttttgttagtatataaatatatcaaccaaattatttgttaattaaatctccatatttttaagataaatattttaactattatctatatttaaagattttaaaggttgatataggcctgatttaaaacgacgagtattatctatcctccttggagatatggtttaatctttcagtttggtcatttataacgggggtgccagaaatactatcataccgggagggtggggtggcggcgctagaaccaaaatttcagaaattttgatccgaaattttgaaccctgcttgaagatagtacttgacatggcgttttctttcgttcggagacgtacggaggacagtaacgtgtgtctacacgggtagaaagtttaaacataattttcaattggaatttcaaagtatgaactaccctcgtcaatttcaaagacgatcgaccgaattacccctaactcaaatatcagatatttttaaccccgaactttctaaacaagacgaattaccccctaggactattttggacggcgtgacaatccaatcaacaaaaataataataataaattatagggcccacctttcgtttcctttctcctctctcccaactatctctctccctctagccagtatcatctctcccctccctctctccgcggatgggaatggtggcagtggccggctgaaagaggcggggcttggcatgagggagacggccggatgcaaggctgggaataggggcggcaaccggctataggaggtggggctcgacatgagggcggtgactagacgctgaccgcctcgccacctttctcccgtgtcatcgctgtcgaacggtgtcaacatgatagagggcccagatttgcttcgtggtgaggcacttcacctagcgatggcattggcatcctcgggcgtgagctgggcaaccacgccaatatgcacccacttccttcaccgtaggggatgagctcttgtcatcatcaccagaggagaagtctccccgactcgactgcgtcataaggagagggctagacccgattttcctgtctgctcaccttctttctccactggtagcaccgatctctccaatacacgaagagggacaacacctatgacggcaaagctacctcaagcgcaagtggaggtgggcgaagatcgcttgggcatccggcggcagtggtgggcgaagctcgcccgggcggccggtggctgaggcggagcttgcccaggcagccggcggcggatgtgcagcttgccccgccgccctcctggttgtcgatgtcgcttgatccatgcgccatcgccgcctgtcgcattgccatccgccaccaccgcagacccgtttcctccccggaaacactgccaccgcaacttttgttagccatctctgccccctagcgtgtgccattgttggccacaagacgcacgatggttgctgcctctatcgctgcccgcggctgtgctcgcacgggctcgagcacctcctaccactggccactgtgcggtaccatcggcctggtcctcatagcccggttcggtgagagagagagatggaggtgagggaagggagaagagagagagagatgatggggaattggggattaaggaaagagatagagagggtgagcatatggcatatggggctcaccaacatttttttaaaaaaattaattgccacgtagtaccaaaaaaccactggtttgagttaagggggttatttatcaggtttgcatggttaaggatataaaatgtgtggtatttgagtttaggggggctaattcgatcgacctcgatagtttatgggtaattcgtactttttccttttcaatttacagttacagagaacatatctcctaagaattgggagagtgtttatttgtctcatagacatcgataacttcgtctttcattattagaacaataagacgtatatctaacgactcacatggccattttatttctgtatgacagatgaaccatactactttgaactaaaataaaaggtgaagtgcatgagctgctcataaacttatcttggatgtcatgtagatttaaataaccttatcttggatgtcatgtagatttaaacgggctctaacctatttggtgcgctgacatagcatacattgatggcgcttacctattagtagacagaaataaaatcacatagaaaaacatcttttcttctcttaggtagacagaaaaaataaaaaagtagagaggtgaaaatatttttaaaattttacaaccccatcgtttacctggtaagagtaaaaagcgaaacaatctatttgcaaatgaaaactaattttgaatagaaattttatatatgtgttctaaatgatctaaaaacaaaggctgaagaataaactatgatgaaaaaagaattacaaaatcaactccaaatttaaagttaaaaattaaaattttggtcgatacggataagcataagcgaaaagatgaagccgttagtttttcctattgttggtatttgatactatcgcagaaaaatctgcaagtacacgaataccgttgtagcacttacccttacagtattctaaggtatcgaacatgagaaacgtgtgtgtactacctatgaacataattcaatcaaaggacaacaactgatgattgtttagttagagaggattcctatgtctttgaattagctacttaagttaaaagtaaaactttaccatatgctttaggcaccggccctccactggtctaccaggtcaagtctggtcttgagctctacgatgtgccgaacatagagggatacatgggacggataaggctatcaccacgtaccgcctacctcactttccgtggagtacacaacaacaaagataatttcaaacctaaacaccatgcctaagtcattaattactattctagcaatgcatatgaacttccttctttgtccagagtcctagtactactgcactcagttgcacactaagcgtcgtggcggttgcgccccgcggcgaggggcatggacaggcagagcgtgacgtcgttgggcaggagcaccatccttgaccaccgccgtcgccgctgcccacagccaccgtcgtcaccattgtctccacaccagccagatccttagggccctcactgaggagaagctgattagtggagaggagagggctcccgctggatggagagagagtggagaggagggggaggtggctagggaggggggagggagagaggaggggcagtggacggagagggagttgaggatggggcgaagaatgagagaagcccgataagagcgaagaaagaggagacaagaaggggggagggagaggggagcgaccggtggatgagtgaataaggtcgacgcgtgcacttggctaccctggcttggctcagtttggattttatgggtaccaattttttagaaaccggtacctattgtactgtagttgtcggttttaattaaccaatacatataaaatattataggagacgtttcttttataaaatcattacctacagcattggtgttggtttttactgtataaacagaacctatagtattcaaaggtacccgtttcaccccgtcaagatacgaaaaggtatataggtgctggttttaaataaactatcacctatgtgccgttacctattagagttttttagaagtgtatgcgtacttctccgcattagaggctgaccagttagtgggaacacgttgagttgctggacaacagtgtgagggcagatgatatacatctctctgggaaaggatcgcgagctgcggaatagtgattaattattggagcatctgattgttctatatgtacaattttgaagttaaccaaacacacaaagcacgttccaaatgtgtatttctaaattcgtgttcctcgaacattggagagcaattaatgttagtacttgcacgtaataaactaaacaatataatatattatattgcatcatatatacacgtgtgaagccgctaataacttaagtcaatgacttatactagattaaagtattttataattcaagcacgaatcggcaatatacgtactatacacataattaacttgaatcaaaagtgatctgggcagatcaagccgtgcaggggaaaaaaaaaaacagttggattacttacgcgtcatagattccgtgtatatacgtgaagccgtgtggagcaatagaggcacctctgctgacagcagtgtgagaagcacgtacgtggacggtggagagggcgacagagcagatctgatcatctgatggaaccgacactcggcaatttctgcaaactaccaaattacacccttcgtcgttctacgtatgtaatgtatgtaagatgtagttttgcggtaaatcgaagaagcttattaactttctgtgagtttacagaaaaataattaatatctataataaaaataaatagaataaaacacattataacataacaacctatcagtgccacctctatagtgtctaactgtctattggataaaacatagcgccactacatgtcctctcaaaccatgtgcgctctgcagacaagaactagcactgatggcaccaaaccagtgccaaattctagtgaacaatcgatacttattatggagggataatcggtattggtttgtgtaactagccagcactattatctcactcattagtgctactacattgttattataaccacactaataagtttttggttgtgaaattttaaaacagttgatcccccgagcatttt

SEQ ID NO: 28141 - DNA, 616 bp, Oryza sativa
tatgggcacgggaagggtggacgaggccgggaggcggccggatttctcgccgacgtgggggagtggggagagagagttgggggggattcaaaccgaatcccgcccttacggggcgcgcgcggggcgggaaggcgtggggaagggggcggcgacgtgggcgcggcgacgcgggcgcggggcgcggagtggaggaggtggggcgccggcggttgccgaccggctggaggttagggaaggtgctgacaggtgggccccacctgtcagcgcccgagggagtgagggggaggcgacctagacttcgggagggggcggaagagatgggccggcggcccaaaggtggaaaagagggggaaaaggatggaaaaagggaaaaaaaaaggaaaaggatttctagggatttaaatattgcactttgcttattttaattggttaaaattatttccaatgctctgaaaattccactaaaaatcatgttagcatattttgacatgtagaatccaagaaaaattccacatgccgattccgattattatttgcatttattaatttgaggaattagctctaggttaaattgaacaatttcttcggtatgatttattttacaaattttaaagct

SEQ ID NO: 28142 - DNA, 364 bp, Oryza sativa
ttgatctttccgccccggcaacaaaacccgtttgtctcatactggaacttcttagcaccacaatgcttgcaatttgctgtgggcttcaagacatgtgtgttacgaggtatgttactgtacacatggtcgtagggatcatgttcaactgagtcatgttctatttcatttaagtctatgtcctcctcatcttccccatctgtagggatttggtttaaggagtcacaatatgcactacaagatatggaaagaagagaactatgccaaaaatacctccaccagcaaacatatagtactcgtcatcgtcatcgtcatcaaagtccatatctggatggatttagttttgagtcacactacgctctacatg

SEQ ID NO: 28143 - DNA, 5269 bp, Oryza sativa
tcttctcttttctatcatctttcctttcgtctcctctattctcttcttcagcgagactgagaggctagcagacgaagcaggcaggggtcggcgcaggcaatgactacgagtgcaaaagaaacatcagtaactttaataatcctcaagtttctaaatgataatcaaattcatagttaagccgttgttgtgttgctcttctctctcgcgcatttcatcgagcatctctctggccaacggcaagatcttggccttccactcccggaagtccgcctcgaagcccaaccgctccattcccatcaccatcaccatgtacatgtacttgtccaccttgcagcctcccatcctcaccgccacctcgtacacactccgccccgcgcgcgtcttcgccctcaccaccagcgtgcgcaccagttgtacatgtcctcctcccccctccacgaccccgttgccttgctccttctcctctaggaacgcctccacaagcgcatccacggcagcggtggtgccgtcctcggtgaccggcgaggaggacacaaacgtggcatagagggtcaggttggggcgttaccaaggctcggcgcgggcaacgtggagcgtggagagggcgaaggaccagtagccctgacattggagctcggccatggcggtgaggaggtctctcttgaggaggaggccgtgagaggttgaggcggcggcgacggccggggagcggttagagtaggtgagtcacttgagggattgcacggcgaggatggcctccatagatagggagcagtcgcgctgaagcgggccacagttgatgcgccccgcccctgtctacttcgcctcccacccgctctcgcgctcgcccaccatcgtcctgcccgccggctcctagtctcgctgaagaagagaagagaggagacgaaaggaaagaggagagaaaagagaagaagaaaagcgaaaaagaagataagagaagggagaacgctgacatgtggggcccaccatatgctacgtcaacaaaaccaggaaaattgggtcaatattgcctcagtgtctttttttgcatggtttgtgatagttgaggggtagagatttctggtattgcggattgaggacctcaaatggtagcaattactattctagcccatttaaaatcccacgcaagcatgtcacatcttcactcactagcaattacgcatcatttacaatattatattatagagatcaataaaattattagaagttaaagctcacatgcaagtataccacatcatcacccactagcaattattattctcgtccatttaaaatcccatgcaagcatgtcacatcttcactcactagcaattacaaatcatttacaatattattgtcaacgtttaatgtcgcggcgattccggtatttgcatagtatggggatcgttggtaccagatatatgcgagacttaggtaaaagagatggggacgaggatttttatacaagttcgggcccctgaattgttaggtaatagccctacatcctgttggccgaagccggtcattgctcttattcaccataatcacaccagtacaatatttggggtagcttatctaaccgtcatcgacttggcggccggatcaccaacactagtcgacgacggggtagtcttcctcctcgaatcagcattcagcgaggtcagagatagcgctagattcctctctttggttcctgtaggtaccatatggggttttcctaggcttatctctgatgtcgatatctggcagcttgtcttggcgtatgttggcttgtatgttgatcttgtgtcttgatctattgttccgtgtcccctctcctcctagggggccttgtatttatacacataggtgtccacttgtccaagtagaactaggaaaaccaatatagatacgatccgagtagtacttgtcgtttccatgtagaactctattcatccttccttatgcggaactcctcctatatccgaaagttgtttccgtataagacatggtatgtggtgggtcctaccgagatttagtcaactactattaggtatgtggtatccataaccctgacaattatattatagagatcgacaagtatgtgtcaaatcatcttcctcacattattttctcaatatttcaactttcactatttcgataatatttaacctatacttattcatgaattccgcagcaaagcacggggtatcacctagttctatatgtgaacacaacaaaacattagagacaattagctattttatttattgctgactaaaaacaatagttcagccacctaggagaataggagaacaaccaccaaagcacaacggttgcgtaccaaacaagttatgaagctcacatctatactatctatatagttgatgcccactaacttctaaaacataatatgtaagtgtgacacatcattactcactagcaacacttagagtattttaaatatcatgcaaacatgacatattgtttacaattttgttatatttttagaactcaatatgcaaacaatgttaaacgattaactccacatcattttttattatttaaacatgaacatttaccatttttataatgtataacatgtatttaccacatatcccgcaacaaagcgtggggtatcacctattcctctaatgatgggattcttcttagagcatgaacaatgcaccgacacggtgagtggttttagctcgccaaaaacggagcgactgctccacgttgtcctctggcgtgcactctggagctacacgtgtcctcgacaaaggattttagtcattctcagtttgttgatttcacaaattaattaaatgtcatgttggagggctgagaatatagcattttatccctagccccaattcccgcataaattaaacttttttaatgttcactccataatgttagagcaagtttaaggccattcccaacgcaataactaggatggtgtttatagcattaaataagatgccaactaggatgaaaaatgatgtggcaagtgaataaataaggaaagagaaggaaatcatgtcttgcatgagacatagtttctacacgacatccaagatatcatgtgagataagtagcattaaaattaagtatggaatagtggtatttgcattggaagagtagtttcttgatgatgtggagtttatggaaactatatctagtatcttgggttgggaatggcctaatagtataaccaactactagctgcaaaataactatagccaacttaatagccaattcatacaaaaattacctataaacatacacttacatggtcccacccatcatacacgtattctgtcttggagtccgtgttgcagctgcctacaaatctgtaacctgctgctcttctctctcctcttttatcttctcggtatgtggttatagttggcttatattctgctattgtacctgctcttacaacgactaccggttgtgctatttccccttcttttctaactcaccactctttttccgcatgcacccttttttaaaattgttaaatggtgttttttttaaaaagttttctacatgaaagttgctttaaaaaataatattaacctattttttaaaacaaatattcaatacttaattagtcattttttcagttcaatgtgcgtgggagatgagttcccaactcattgagaataacacagcctccggaattaataagttttggcacgtggtactgttgcacgctgcagttttagcaaggaatcaaatctttcaccaaatcatgttgttgaacaaccatggtgaatggtccaatcactttctagtgttgtactaccattttagtcacgtgttgcgtgtgataaaatggaatgcataaatgtttttcaactaaaaggactattcaagctagtccgtcaattttagtttacgacttttcctagcacccttgtaaatagccacccttttatgcagggacatattcttagggaatttgtttcgccttaagctttcattgtctgcttagggtgtgtttagttctttgggtgtaaagtttttaaaatatacggacacacatttgaaatattaaacgtatagtaataacaaaaacaaattacagattctgcctgtaaactgcgagacaaatttattaagcctaattaaacagtcattagcaaatgtttactgtatcatcacattatcaaatcatgacgtaattaggcttaaaagattcgtctcgcaatttacatgcaaactgtgcaattaattttttttcccacatttaatgctcaatgcatatgttcaaacatttgatgtgacgttttttgccaaaaatttttgggatctaaacaaggccttagttacctattagctataagcaaaacttgaattctagttacctattagctataagcaaaacttgaattcgaatcttagttttgtagttgattttagggttttttatagtttattttttacatggggttttaaatcgtaaaacgtatagatagatataacctttttatccatacataatatggttgatttttttcaaggcttctcaatcttaactctacggataagtcataatttgccgcatacggcaacacattgaggcggacttctacctaattaaaaaccatcgctctcaagatggtaaaattcgagacaatttctcccaaagcgggaagatgcttggacctaaaccaaaccctctccataaattcgtcaaacagatagacaagcaagatcccggcggggcccaccaggttaggaagcgggagccaatcagagaagaatggtctaccgaggttggtgggcccaccagtcatacacagcagcagcagatgaaagtgatgcttggccctgtttagttcccaaatttttttttctcaaaaacataaatgaatctttaaatatatacatggagcattaaatataaataaaaataaaaccaaattacacagttatggaagaaatcgcgagacgaatcttttgagcctaattagtccatgattagccataagtgctacagtaacccacatgtgctaatgacggctaaattaggctcaaaagattcatctcgcggttttcagacgagttatgaaattattttttttattcgtgccaaaaaccttttctgacatctggtcaaacatccgatgtgacacctaaaaatttttatttcgcgaaataaacagagcccgtgtgtcgcgcgtttgagggcatgtacaacggtgtttattagtggtctctctattgccatgcaagtaaatttgatgacatggaagaaagagaaagaactatggttgtt

SEQ ID NO: 28144 - DNA, 3079 bp, Oryza sativa
  unsure (1)..(3079): unsure at all n locations
aaattaggctcaaaagattcatctcgcggttttcagacgagttatgaaattattttttttattcgtgccaaaaaccttttctgacatctggtcaaacatccgatgtgacacctaaaaatttttatttcgcgaaataaacagagcccgtgtgtcgcgcgtttgagggcatgtacaacggtgtttattagtggtctctctattgccatgcaagtaaatttgatgacatggaagaaagagaaagaactatggttgttatgcatgacaacagctcagagtcgactcttagcatttattagagcaaattttgttgcatggttgtgaaacaaaggaaagaaaagtaagaaaaagtattttgatacattaatgattagagaccatattgtctctaactattataagatgctaatctttagataacgtagagcttatatctgactctacctttgtatatgccctgatgatgatctccaactggatccggggttccagaagggacaccgtaccaaacaaatccagcaagagcccttttctcacttgaaaacttgaaatgacggctttcccgttttcgatttatcaaaaccgattcataaattatttgttaagatataggagtataataaactcctaatgaggtgtttttttagcttaatttttttgttaaatgccaatagacgttcgattttgaacagattttttatttggcgacatgttattgctcgtcctctgtgtgtttcgtcaaaaggggttgacacacaaggaacatccggtgcacaatattttcccatttgagatcatgacctaaatgattttcaaagttaacgtaatcaaagattaaactagcttttaaaaaacattacttaaaataaaagaacaaagtaccagacacctttttgatgtccacatctacaatgatggccattttaactctctggaaagagactttcatgtgttcatcccgtaatctctccgtcaaaaaaaaacaaaccctgcgtttccgtgtctaattttaactatctgtcttatatgaaactttttataatttatattttcattgttgttagatgataagacataattaatattttatgcgtgacttgtctttttaatttttttcataatttttttaaataagacggacggtcaaatattggacacggaaattaaggtttgtctttttttttttgacggagggaggacagctcatgacacgatcggatcgacggatgctacagctacatacttcttatctactcaagcgggtagcagtgcaatatttgatgcctcagttttcccattgctccaatggataaatatgtgtggtgcctaaattgcgcatcaaattctccttttagtccctgcaattcggtgagctcgatttttttaatccatttttctttatattaattgtccttttgttttttcttttgaaaacaaaccttttcccaattgacaaggaaatgttgtaccctcacaaaagttttatttctcaggtattacaggtggatgatcagatctttgattaaaagtaagattatttgagagttttattttgttatattacaaaagtatatagaataaaaccattgtcattgctcggacgtaccgtgcaaacaaatttatactttttgaattgtaaattttcttttcgctacccatatacatatacgcaggatgagctcttttccgtaactcaaataaattcttttctaaaatttataataaatcatactctaatgatccgtaccattttcctggtcacgaatagctctagcccaactacacattcgaactgggcctttaagtcgagtcataatagtttggtttatttcagttttgatattttttatatcttaacaaacttatacatatcaaataattagttttgagcccttagactaagaatcagcacgacacaaatttacaggtatttcggtggtgtttaaatctcctaaagatgaagataaagattaagtgtttcatgtaaaataaggtggtaataatgtgtgattaattgagttttaattattacacacttgaaaaatagattaatatgatattttagaacaactttcatataagttttcgtacgaaacacgccgtttagccgtttgaaaagcgtgccacgagtatctaaaagtttatctaaaacttttaatagagaaaagaacatggcattcatgtaccaaagatggagttatttttccacagagagggtaacaaacaaacattctccatcaaaccaacgctctactcaaacttcggcaatatccatatacaaaggctgcttttagttcatgccaaaattgaaaatttgattgaaattgaaatgatgtgaccgaaaagttggaagtttatgtgagtaggaaaatttgatgtgatggaaaaagtcggaagaaaaaattggatctgaacacggtgaaagtcttctcttttctgccatgaaagtttgtacgcaccataattttttttgataggatcgcaatacaaaccaacccatcttaacgttatgcttattttcactatattattttctaaaaaaggaattatatagttaatctattactttaaaccatcaaaatcagataatctataatccgcttaaagcaattagatgggcttacatattttatctttttatcgtcttggtctttggtttctaaaattcacacaaatactacttctttatataataagttcatcttttcctttttgattgtctcaaaataaatttatttttaatcaacatttgtatcagagtatataaaagtacaaaataaaataagaaacaattatttaaaacgaacggattacttcactgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccgagctcga

SEQ ID NO: 28145 - DNA, 2306 bp, Oryza sativa
  unsure (1)..(2306): unsure at all n locations
aaacggagtgaataatttccatctgctccggataaaaactgatacggatacctttcggatcggatagttcggatatggatagctatacaaatatggatattgtctcccagatacgaatactgatatgttattggggtttctgtcggatacggataataattcggatatccggtgaacagtactattcggatatccgcagaagccatgagtcataccctatttctttctaactctataacctttaatatacctttatagattttaatagtagtttatctcttaacactagtccatacttttagtattatttcaattttaaaaaatatttataaactatacttcatttttatataaaatgagctaattatatatgttgatatttgtttctattagaagttgagttggcatttgtgtcctgagaaaaaaatatttccgtattcgtgtccgatcatattcgattcttatttgcattcaagataatccgtatttgtttccgtattcaagctatccgtattcattttcgtatccggtaaaaaaaatgaaaacaaatatggtatgagcattatccatccgtatccactccgttttcatccctagtcaacagtggtagcgagcttgctactgcagagaagaagatgacttgtttgtttgctgctattagtttaatgatgtgagctagagtaacaaaatctgtgttaaacttgttgtaaccgtgaagcttgatgacacttattatttttcctggatgatttttgaacatttggtggtttgccaaggtacctatggtagtataaaaacaattttagcataacttgatcaattaagatggcaactttaaactacacgtacatgtcataccgttgggccttatttgtactcgatctcttagctagctctaaaaagacaatggaaaaggtactaatttcaccatcaaatacacaactaccatgcttgtcaaatcggggccgagtaaccgcaacaagaaacatcaccttctctatgaagtatatgcttttaacccctctttccggtcttggttcaatgttgatgaaatagtatttctagtcctgcattgtcctatagaactatttctcatcaatgtacacaatgttacgcactagcttgaatttaaattaagttcagaaatcaatcatatattgttaaggacgaaactgttgtgatttgattagttctgtaacatggagtattacacatcttgttctcaaatctgaacatgtattgaacattgcctttaacaatataggattgattttagaaattaacttaaattcaatccaatgcacggcaatgtgtacacagataaaaaaaaatagttctacaggacaagacagaactagaaatactattcaccaataatgtcgaaccaagaacggaaagagaggttaagagcaaatacttgatgttcattgttgtggttactcgacccaaatttgacgagcaagtattgacgaaaaatccgtgctcggtcgatggtgccggaactgtgttagcacgaactaagtcgacaacagcaacggcctaggagatctgctttgctccagtgtaggtccaaaaattgataagatacgggtgtgccagccagtttgatcctacaactgacaagatatgtaaacaacagatcaaatagctgattggctgacaagccgacggagtagttccagtcaatgctgatactagccgatgccaatagggttttgagcaatcatttatatgtccaatgtagatacgatataaagacaatcggctgatggtaatgtaacaaaataacaatataatccggtagaaaccaatcagctaatagtgatatgatagaataagcgacctgatccaaaggttaaagcatacatcggctggaggtctgatgtcataaaatccacaagattagataaacattaaaacctttgttgcgattggctcaaaccgacttatatgtaatccttgtaagccgatgcaacgtccatataacttatcggctgaaaccccgatgaaaccgttactataattaaaaacaggttagcctttatgattctaagcacagctaggaatgatgcatcgcggagtatgcaaagaagcataaagtctaaacaatcaagcatttgactaatttttagggtggtgaatatcttagttaatttaatctagctagataatttagccaatactaacatagaccctaaaatgaatctcagctgatatgatcaaattaagattctaaactagattnnnnnnnnnnnnnnnnnnnnnnnnnnnnnnnnnnnnnnnnnnnnnnnnnnnnnnnnnnnnnn

SEQ ID NO: 28146 - DNA, 11969 bp, Oryza sativa
  unsure (1)..(11969): unsure at all n locations
gtagccgatacaattgtctgggccgatggaacataggacttaccccttcgccggagatcaaaagctaatgcagccccgcgtcaggtgccatcttccactggatgataagtaaaatcctcggaaaagagggtggcgatgcggcgaaagtagttgtattgatatgtaagatagtttacaatgactccatgtgtacatatttatacccatgggtagatacttattggacaagaaagaaactttcctaaaaataaaaggaaactactaaatcctacctaattaatagatagaattatgccgccatgccatagtcttcacgattctttcttaaactcggtctcttctagggaagtttcaatcggctaaatgtgctcttttcttagccgaatccgctaaagaatcttaccaatttttggtgttaacaacaaggtaaatatgtatttgatgggaaaattggtatgttgctctccgtttatgtagaaccagctaacagatcaagcataaacaggtgtcacatcctgatttttgtttcaggatttataaattatttaataaattattattataatttatattaaatgttcattaatttacaagtgaagctaaatgtgggaaataaaatttcctaaatataaagcatggatggatttaatttttattaaattcttcatggttaattatactctctggaattttcttggatttttttcggagctcaattcctaattttaatcttacaaagagcatttcagtaattacccacatattaaattaattattaaatggtctaattataattttttttaagtactttgagtgtccaagtattttcaggatttttcttgaaattatttgagcattggaagtatttttaacaattcaaagatcatttaagtgattattttaattggaaaagtaataaaattctcctcccttgtccttaggctgaatcggcccattcctttccttcctctctcttccgccggtccaacccgagcctgcatcctctcttcttctctcagccaaagtctggtttagctccctcttctaatcaggctgagaaaagaaaagcccggcaagaagtctacttttcctccctgatatactgttcatcttccagctcaggcagagcccgagccagccgtgccgtgcacagtgccgccgcctcctccttccaaatctcgcctccccgttgctcctttttccaatttagttgaggggaaatattcctcttatcctcctctatctttaccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgcccctctcccgtgatctcccgtgcctcgtagcgccgccgccacgtgctccaccccgccatcgtcgccggccgagctccatccgtgtcgcgccgccgcctccgccgttgccgccggtcgccgtcaccgccgtaaggtgcgccgaggtgtgggcaagctcggccgctccctccccgctgtcgccggtcaccgcagctccggcgccaccgccgaccgaagccgcccccgccgtccacctcgtcgccggccgtcgtcgttcgtcgtttggttcgagggtgagtaccgttgggttcgtctcgtcgtcttctacgtgtacatgtcctccaaagtcgcagccgaccatccaatctccggcgaggtcgccatcttggtttggccattgatgaggtcatcatgacgtcatcatcgtttttctttttcctgtttttctaatagattaaatattcggaaattcataactaaatcatcgtaactcggttttgagtggttcaagttgctaaattcatctaaaatcatgatctacatgtttgtttactttatatgtactgtttatgcttgtttttgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaatacaatcctttgagcatgttgatcctatatttaaattccctatttatttcaagtgtgtatttattttcgaatgtcactgggtggtgtgaatctattcctttgttatggcctgtttgcattgattactctattccttgataccttgggatattataatttgactagttgagctttatatatattggttcaactagatgttagatataattgcttagccatgcttagaaacattagctcactaataggatgaatcatatatactacattattatttatggatatatttaatggtagctcacgatggttaatcgtgttatgataattaattggtaattaaaatatgattaatggtgggttgtgagcacatggttttgaaggtcgtgttcatggcaattaaggaccggttcacgagctactgttgttgtgaaacattaatcgtgccaaccacaagccagcgtgggcaacggctttaccttttgtatagcatggttcattgcggagcaccagactgagaagtggcggagataagcccatgggggtcgctggggagtccatgccttgttttataagggggtgattatgatccaggaatggtgcactgtggtgagttgtgttgtacagagggtattgtcacagcctctattcgggtaccttctagtatcgcgacacatggtagacatgatgttgaggctgtgtcttgtgggtacagtggtacacctctggccagagtaaaactattcgaatagccgtgtccgcggttatgggcgagttgagcaatgtttttcgtgattagtctcatgcctctcacaataattattgatgctataactggtaataatttgtttagctcctggtttagagttagatctgtacagccgggtatggttgttcagaatggttgggcctgagcagcatgggcgtgttgttcagtgttgattgaaattaatgattaaattactctactgttttattactcttaaatgtttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagttgcctgtgggagtggagctgaagccatcgctagaccgttaattccgctgctgtttttcttttgttttgtaagtatgtaacgttattattatgatggatttgtatattaaattgtcagtttatgtacctcggctgattcctggacgaggattttatgcacaaattagttcggaaattattagtgaatttccgggcgtgacaataggcctaaaagtatgacattcgtgtatattttaaatttgtgatcttaattgatcaagttatgctaaaattatttttgctaccagaggtagcttattaataacaaagacgatgatgtccgttactaaggaaactagccgataattccttgacaacaaggttttgcctgcaatccaggtaaagtggaaagccaaaggaagaggaatgtccaaattactccaacaagacaacaaaagacgcacattgacgtaaaaggatccaaaattgtagaaattcctcaaatagatgggtggaacatatgactaacatgccaacctccgaactcacctgatcttaatgcactatatctttttttacaacaatctaggcattgttttagaacagccctcctaacaatattgatcaaattgtaacaaaggttgatcaagcatatcgcaagtaccctttggaaagggccaaccagattttcccaacccagcagggttgcgtgatggagatcatgaagcataatggagggtaacgctataacatcatgcacatcaagaagaatacattgaaaatgcactgtaatcttcccataagcttgttgtgtcctatagacctatacaatcaagctgtgcaattcatcgattggatgaagtactgaattgccactgaaatactctctcgtagaaatctaatgtttccaaggtctgaaatcaacaagttccgatattgttaggttatgcaatctaatgttgtaagcatggagtgctgaattgtcactgaaatgtgctatacatctaaaatctgaagttgtcaagttctagaattgataacttctaaaattgtcaagttatgtcatatgaacttgtgaacatgaagtgttgaattgtcaccaaaatactctagtactgaaatcagaagttgtaaagttctaaaattgtcatgtcatataatgttgtcaagttctgaaattgttaagttctaatttttttaatttctcaaatctgaaatctgaaactgaatttaaaatgaataatgaatgaagattagatgtcaagttctggtttctccctacttgacagccgaacaaagtgcaaaaagtcggaccggccatcgaattggtcgagcccttggtttgaccgtctggtcatgcagttcgactacagaaccgagccttcatttggtgtgaatattgttcactaattaggtgcatgggtggtccctaattggcttagggtgagtttgtttgcttgcattcctttagcctggcccatctctctcatggaatcagagtttaaccttgatgaggagatactgtttggttgtttccatctgtttagtttggctgggatgagattttgtttgattacttgcatgatagatactgttgggaagagattttgttttgttggtcgtatggcattgagcatagacctcttcatttagttgggtgagcttacctctacaatatcatatgacaagtttatattacctctactatatagcaatagtgattctccatataattgatttttttttcaattttcatagtgaaattggtagtaaaaaatagacttcttcaaaaacaagtttataagacgaaccggtcaactaatctgtaatttattacctgagaaaaacaaataaaaaagaaaaaaaagaaaaagatgggaggtagaaataaaggggatcgtctatagatggccatatggcccgagggcacgcccaaggcccggagatttggcctggcccaggcaccgcaagactcgggtcatgcccgtgccggtccggcctaacagccgtgccgtaccgtgcctggactgctatctcggcacgctgggccagcatggcccggcatgaagtttagggatgtgaaacaaacttattttcaaccatatgtaaggcacggtacaaagaatatagtggagaaatagatatattatatggcatggcccaaagagtagggacgtacaatagacttattttagctatatatatgtcaaagcccaaagatgagggacaggaaatagacttattttaaacaatgcacgataggccgcccgtgcctttgggccggcatggcacggccagactactggtgggctgtgcctgggcctgaggtgcagcctgtgggccggcacgacatggctcgaagtgccggctgtgccgtgctggcatgatcatctcgggccgggctgggccgagcgggccttacgaccatctatgggatcgaacgtggtgcctcgttgtcattgccgtcaactcgcctcgcatccggtctctctcctctgacctggcatctccgacagggcctcctacgctcaccgccgtcacggtagtaattggatcctgtggcctcctgctccagcctccaggccatccaatttggtgcctttggcttccaaggaggagagggtggtaggagtgaggaagaagaaaggtgaggaagagaggaatctgaggtagagaaagatggtgtaggcccaagcggtgatgaccacagccctacctccttgttcccttcgattgctgctcctccaagactccacccccaccactcacgaagcagccagatctgaggtggcacccgtagcacctgctgaagaaaacaacgatggaggcgtcgatgacttgggaggagtcaagcatgcaaatggggtgagggaggtaaggggatatgcgacccctcttgcctactgcacgcgcgcatcccgctctatacatgctcgtccctacgccaacatggcctcggcctagacgagaagtgaatctcaattcgagcgttcccctcgggcctggctagagaagcgattttgcacgcatagagtcagccgtggtggctttgcaaacacccatccactgcacgtgtggatgtgagccaaccctagtgtaggtaaccaaacacacccttagcccataggtggtgactggtgagctagtggggcctagtgggcaaccatggttcgacgcatgcatgacttggggcctagtgggcagcgtctctttctagccgggaccatctgctcgttgggaccacctgttcagaagcctctgattcactggcttttgaccaaaaattatccggttcatccgagatagcttggtggcggtggcggtgcctgggtctggacggcggcggcgctcctgctcggaaagatggacacagcaaaatctccccgaagggctggcatgcatgcatgtccacaacattagagaggtccctatgaagctacacatgcgaatgttgaatcgtggctcaccggagaagaagataacgacaacagcgacggtggccgaagttgagaaagaaatgttagattaatgggctaggcccaattaaatcctaataaattccattggcccaccttgaaaatctaagtgaagagatctcaacttaaatacggagctagtggagagtctatgttgattagttgagatggtacgctgacagccaggtagggcggggagaggcgaggcaagctgctactgctgttctctctctcgttttgtaacggacggtaataaacacggagaattgagatgttcttccgactcttgcacttcgagttcctgcttgagaacttgcacaggtagcgcttgcacgggagcaggaacttgcacgggtagcgcctgcgcttgcacgggagcagaaacttgcacgggtagtgcttcaagcgcgactgctcctgttcttcgttcttcgatgacaacgttgcatcttcctctgcttctgcttcaccatggcttctattggagagaacggaggagacaacatcaatgaaggcaatacgaatgcctcaacatcttctgcaccattctctggatataagattctaattttattcgattttcttctcgttatttacatgttcacaatgttatccataggatttcaatcctatgtgaatgtcaacgatgtctatgcttatttcaccttaaacatgctcatgtttatgtttagccctatcactagatcgcttctcattgtgtatgtcatgttantcgtcttaatattttagattaaaatatatcgaattataaccaaatttccaacaagaaagagaacgatctccccattctttgcatctcccgatggggctattgaggggtaacggaaaggaggtcgaggtgatgaagatggcgcggtggtttggcctgcaactgtccacggccgccagaaacggtgatggggatgcggtggagtgcgctccagagcgtccgagtgcgcggttgcattcctgtttaaccgctgcatggaatagcacaaaattagatggaacggacacggcatcgagagtagatagaggaacgcaaaagaagaggaaatgaccgcggctccatggtgttggcaaccttcgtcttctcggtggccgacgatggagatgagggcgacggagagactgagggcctcctccctcagtttggtcggctctggaatgaagtgtgagcagaagcaaccgagtagggggaagttggaggcgagatcagccacggccacatcctcggacacacgtcgagcaccttgttctcccggcttttctctctcgcgcgtgtcccctatgttgagcagtgatggaggaaagtggagtatgatgcacagagaaggggcaagtctacgtggctgctaggtgggtccagcgcatgataggctaggatagagtaaggggtatggggtgggggattgagtgaaaatcgattttcagttattgtcatgattaattctcccctttactttgtaaattcaatagtttaatttgtgggaggtgcctagggatcggtcgcccgatccaaatctccaaaaatcgggcgctgatattagcatgacaacaggtatatgcaaaaaccactttaaactaatttttctcttaaattatttatccaaatcatgatccgattacaccattaaattcgttgcaattaaatcttcaaaacaagaccacacatggatatattccgacgaaaaaaaattagattattactgaatttttttaaatgttgcacgatgttccaccaggtatatcggaattgtttcactaagtagatcgaaaatatttcaatcatttaaatcgggcgttgtttcaccttatataaaaacaatgtttcagcaaatagtgaaataatgtttcagttcactgcaacatttgatccatacatagtgaaacattataagtacactaggtgaaacacttttggtggaacaaaaaataaaccaaattcccttaataaagggtttccaaaatatttgggtgatttgttgcaatggagtatttcagttcactgcaacattagatctatacatagtgaaacattgcgagtgcactaaatgaaacttttttggtgtaacaaaaaataaaccaaattcccttaaatagagggtttccaaaatatatggatgatttgttgcaatggagtatatgctggagacacgtggcaggtgggggcagggactgtggtgaggcccaggtggcatgcacgcgcacttgaggtggggggcgggggcagcacccgatttttgctccccccgcccggtcgaccgatccctgtcattctcctaatttgtgggtgggataaattagagttttttagatagatgatggtacctagattccattttctttggtttcacacaaaaattatgtgtagtttgctctcagaaaaataaagaaaagggctcggtagaatctagtttaaatttttaggaggatcaaactaaagaaataaattctgcaaaaattatatttatttatgataattaacctagtatttgaataaattattttccttatacttatttatgcattttaattcacattttggtgaggtaagattttaaacatttaggccccctttgattcaaaggaaattcataggaattttaaaggatttcattcctatatgaatatttcctatatagctctttcaattaaaggaatgaatcctatgaaatcctataaattttctatggaatgcctaatgccatgcaagtttcggaagaaatctagcatgaggttctacctcatggaaactttcctatgggtcttcatctctcctgtaattcctgtatttttcctgcggtccaatcaaatagtcatttatgtgtttttcctgtattttgcaatcctctatttttacccttgtattcatatcaaaatcctgcgttttttctattcatatgttttttcaatcctgtgattcaaatggtcccttagggtttataattaatctagtattttactggtttgacttattaacttaagtgataatatttgaccaaaattacagcgaatacacactggatagtatttatgtgaattttgttctaaagatttttagaatttcatctagtcattcctttatatgtgttttcatttatagaaatgcatctgagcaattttataaaatttataattgaacacttcttgctctgagatggtgttatttaagcttagtttcatacccaacatgtacacaaggactcaaacctagccatgatatgcatatgcttgctcgcactaagtttgtaaaatttcattttgggttggagaggaaaaagtttatataatttgccctcaaattccttacattcaaaacttagattgacctcagctaggtttaaaatgaaaattttaagctctcaaaaatggaaaagttatcttccaactactttgtcaagaaattttaaacccctataattcgggtacgttacatcatttaacacaaaaatccgaaccaaacgcttgacatgactagtcattcaactcaacacaatgagtttacaataactaggttgccaacagcgtggtgaagcaatttaaaattttagggtcgttacacgttgcaacatgatcttaaatgggttaggttttacggtattttttgagacggttactctgagaaggggataaaacagtttttttagattgtttttctttgaagggaagaaaggacaacaacggcagattctctgcataagagcacctaatgtaatgtgagagataataaatagagtactgttcattccttttggagggggaagtgcaattcaactcaagttcctctacttcaaaactaaaaaaaaaaatccaaatccaaatcaattgatatatttcgaggaagaaatggggttacctggagcctgttggattcactcagttatgtgcaaattaaatgacctacttaagttacatggaatgataccatggctaataagcaaagttcagggcaggtgtggtgctgcattgctacatcacgcagcagacggtcacctgaaccgtaaatttgacaaattgacccctttagaaaacttatttcagaaaataggccatgcaaaaacttatttgcaaaaatgagccatgggtattttctgcgcgggtattttaattatgaatgaaaacggtcagaaaaaccctaccattttcattttcatatttttttcttctcgaaaacagaatcggaattgtagacttgaaaatggtaacgatatcggtaatatcggtacatcagaaacgggacgtcggaacggaatataccgatattggtaggaagtcgaaaagtcatgtcgaaataagtggagtgtggcatagcacacatttaattatgcacgaagatgacttttttaactttatttttgcatcatcacactctacataacactattatatgatgattaattatatgataataagtttaatgaacaatataaacaaagttcaacaatactacaacatcgattagttgaggagaccaaagttcaggaaaatccacatgccacgtcataggattaacaacattttccctggtcacttcccattttttgtgggctgcaagtctaccatgcttccttccttcacgagcttccaatgtgttgggctggctgagccgctgggaacttttggaattttgacagaaattaccgtacaaatacggttaccgacaaaacggacggaaaaacctccatcccatgtccactaccatttccgaaagatattaccatttccatttccaccaacgtcggctacatataccgactgaaacggtcggtacaaactgaaaacggcagccggaaatctcggaaatttacgtaccgttttcacccctagtatttttttgatatttttctttttcatttgccacctgaggttttgccatcccatgtcctaaccgtcggatcaagagttgatgtacgaaacattgctgacagatgattgatgactaagttttgctaacatataattagtttctgctcttaatatcgctgacatatattttgactaaaaatatatctaaaattgccaacatatagcatgtcttgttacctagtattgccgacatatagtttgccaataacttttactaacagagagtctatcagtaattgtttatttttattgaaagatgtctattggtaatattgtcatgatgtagtgtggttcgatgcggcatcagcacgagcacttctggatattgtcgccgcactcatgtgggat

SEQ ID NO: 28147 - DNA, 2976 bp, Oryza sativa
ccctccccaggaatttgtcttaggaataattactaacgtggaggaatacccgtactgagctgtcaccatcagtgacccacctctactatcccgcagcatatattcccagataatgatacttaataatctagacaccacgtctacattattaaatactactctatatccctatgaatgacatagagcaaccgaataatcggacattaaacccacacattgcacctctctggtaggctagctacacaactataacgatacagatataaagtaaagccgatactcagataaactaaagtaccgagagtatataaagaataatattccattaattccgaaagtcttccaaaagaataaagaagagctactagagccatacccgaattccttcgaagactccgagagctgttctattctactccacttagcaatagaatactaaactaaagtataaagagaaatgttgagcttgcttgactgtaggggtgaaaacggtaatggtaattaccggccgaccggcgttcgtttctaactttgtaccggccgaaccatatggaaatggtaatagactgaaaaaatatggaaatggtaaaaaatatggaaatggaaacgtaaatggttttgttgttataccgatcgtctccgtatttaccatatttttgtggaaattaccgtttcttatcatatggtaattaccgtatttctaaatatgttgatatttataaggcatatctctacttgacccacagtttagacattgatcgactcttcaatcaaatccctaatttgagtgaatggctaaaatgaaattaacttataatttatatagtatgagcttgaatttatttatacatataacatacttatgtaaagttaaatatatgtttttatagtttattatttacatatttgttaccggtttccgatctgtaccgatatgtttccgtccatattattccgtttatggttttccgatatttccgatattgttttcgtttccgactttaccgttttcgattttgtttccgagaaaaatatggttatggaaatggttgaagctgttttctgattgtttccgaccgttttcatccctacttgagtgtgtgttgaagtgaatgaagcctccttcttttataggcaggtaatgacggttacactatgtgaattgtccaaattgccctgcaaccatcattgaggagcaatcaagagcatccacgtggaaggccgggatgagaggagctttccagggtttggccgaacccttggctcagccgaacctgggccggctcaacaggcctccgcactttccagggtcggtgacaggtggattcttagggcggttatggcagttatggcggtttccgggacggttacacctgacatgtgggcccgtcttacccttaagcttgcttcggagtgaagtgtccatttatgtattaatcgctgcaaaataataatactccaggtacaagtggaactacattattgtcaaataaatatgcattgcaagcatagctaattctcctttattttagttatattgacggtcgaaattggtctataacgaccatcaacaatacccataattaattggagccagatcaaactgaaaattgaccactttgatgaagattccatctaaatatatcatgctccattattaagttagcattcacatttgaaccacacaaattgtgcgatctaattaagttcaaaccaactaatgctctcctaaaagggacattaagtggaagataacgattggtatagaagataacgattggtatttgtcctttaaagatgaattacctaaccacttatcctcccagaatctaacttgttcaccattattaataatccagtaacccatatttagaaaagaacttttaaccttcatcaaacctgacaaaaaatggaaatccccttgtttcctgtcaacttgagttatagatttaataccaagatatttccttttcaaaagattttgccacacacattgctcatttattaatttaaactaccacttacttaataaacactggttttggatctctaaattatgaacaccaaggcccccttgatctttaggctgacaaataatatcccatcttgtcaatctatatttatttttatgttcatcatcttaccaaaagaaatgaggtctataataatcaattttttaaagaacccctttaggaatcttaaaaaacaaaatcataaacataactaaacttgataactcaaagttaatcaaaaccaatctcccacctacaaacatatgtttacccttccaactactaagttttctctcaattctttgttcaattgttagccaatctttattattaagctttctaaaatgcataggaatgacaagatacctaacaagaaaacctcctagtttgcatccagaaatatttgaatattgctcatgacatttctttgctcggccaaagcaagataattcactcttgtgaaaatttgtcttcaggccagataatttttcaaaagcaattaaaatcaatttcatatttttagctttctgtaaatcatgctctaaaaaaatgatagtatcatcagcatattataagatagacaaaccatcatcaaccagatgtgggaccactctagaaataaaaaatttttaaaaaccatcatcttttgctctattaatatagctaacatatcaacaactatattaaaaggaattggagataacgggtcccgttgcctaaatcccttataggtttgaaattttggttccacttgatcattcactttaatgccaacatgtccaccttggataaaaaaaagcaatacaatcaccccatttttgagagaaacccttcattttcaaagtttgttgaacaaaagaccattttactttatcataagctttctcaaaatcagtttttaaaagtacaccactcttttttttctgatgcaattcatgtatcgtttcatgaagaataacaatca

SEQ ID NO: 28148 - DNA, 5623 bp, Oryza sativa
ttaaccaaatttacttaaccatatccacaaaaccatctcttaacagccaattcctagtagacttaattataagagttaattatatatgaccaaatcaataatatgtcttaaaactattatcttttttcgttgttatttttaaagggtggtttgtgcattataatgtctttaccattaatggtcggactatatataattttggaggaaatatgactagttaacatgggcatatgtatctcatatagaagcagacaaggatcatcactatggataatgtaatctatattatactcatcaaatagtttgttcatgaaatctttagttatggcataaagtgcatctggaatgacattgtgcactcattttaccgcacagaacattatcaacctgtgtactagaaaagaaagcattaaaaaaattagatgcttagtttggagattaggatgagatatcagtcttcactatatatatactatcaattctatatatagtgagtatatttaatacaataccatctagatagattacatattctcgggatctgtttgttctgtacatttttttttcaccaatttcgagatgatatggtatctaaatctatattctcgggatccattcgtcatgttcatttttttgtcgctaatagtattctcggttctaaatagatatatatagatactccagatctattcgtcatgttcatattttttccccaatttcgagatgataggtagcgggcccgattatgaactctagagaaaggcccagaagtgtaagtattggtccacattccataatgtttttttttctagcccataaataatcctgggaaaaaataaaagaaaaaataagttagtttagtacttttaatataaatgtgtattttattttcttgacatactgtggacagagatatattataacccttacatacatatagactaaatgacaaattgctatatgtttagaagtgcacatgtgcaaacatacctatacattaacccttacatacaccagaaacccaatgtgttgacatcgttatgtaggttgaactatacattaacaatacaagggtagcccaaatgggactcaaatagaccgagcatggtcatgtacattgcaaaataccaaaagaagtagattagatagcggaagtgaagcagcggtggtccaacgtactccacaggaatcgacgggtgaacctaggtcccgactccaccgtcttagacatctcttcattagcatagttctcatatagttaactccaactcctttctaaaagatttagttaagtaaggtgagtaccaaccgtactcagcaagccaccactatagaatgcatttagtgcacacaggaattcaaggagttcgaggtgaagagagacgaacgtccttatacaggggatgccagggcatggcttcggtgcacggcggtgtgcctgcgaccagcgcggcacacggctggggtaactgtaatagatgtgttttgtatataactatagatggaaattgtaaagggaatttgtaaaggggattgcacaactgtaaatgatgtatatttggacttttgatttggctctgggtcgaaatttggaactggggtttggaactgcaaatatggacttttggtttagcccgcactcggatcgtttgggtggaatggtcagattcaattcggccgcttagtcgcctaagtgctcaacttaggggttttttgtgatcactcgagcgaatgaaaagacaacaatgccgagggttctagaagtgacgcttggcatacaaatccgttggatgcggtagggtttcaaggatagaagtataatcgataatgtatgaatcaacgtacggcaattaaatccgtcgaatgattttagagtttcaagcgaaaggccttactctgtaatttcgagtcaaagtgataggggggaaagaatccgtggagagccgagtcgaatagccgaagcaggttttgatccgatcgcaaggttccaagggttcggggaaagaaacgacattgcgaaaaaaggaaaggatcttgggatttcgattcgcttagcatcgaagcatttagcgaaaagggaagacgtcgatcggaggatgtcctttatgccgaacgatttaattgaggtaatccaacgattcaagggagggacggggaattgtaattgtataggagggttgagaggatagagaagggattttaccttgagaggcaattctgcaagaactactaagagttcgaataataccagacactagaacaattgtttcgagaggggttcgattgagagggagaatcgaactacaaaattcgaatcctgaggaattacggcaagagggtggattcacagggatggattaaatcgagatcttggcatgaaaatacaaatgcacacaattaacataaattccattatgcaggtcggctaggcctttcaatgaggaaaactagacttttctgtgagttctttagaaataaactcttttaagattttagtttataaatagagttttgctagtaaattccttctagtctttatttgtaaataattcccaaacacttataatttcaaaatagggttttcagaagttaactaatattagcccttatttgtaaaaatagttttctcgggaaaatatctctcaaagtatgttttcgaaatatttagtatttgtttttatttataaaacaaatatctcaaataggtttctaattcatagaaaagggttttcaaaaagacaaatggtattcgcaaatattttcttaattaatatatttcataatcatggttcttttaataaataagatttgaatccaaaatatattttgttcctagatttccgtcctcgtggtccaagcgcaaccgaaaaatgggagataaaatccaacatgacggattttgaaaaagatttttgattatcctgaatttttaatttcacaaatcaaaaccgaaattttcagggtgttacatagccagccccaggaccagccttgatcttgacattattagcaccgacccctccaaattaaagctggtggcaaagtgaggcgcggcctgcagaaatattaggcacagttgtatgtatattactagtatatatacagattaattatgttaatgagcatgtacgtacggtagtatgcatcgctgccgactcagatgccccggcggtttcttgaagcgtggagacttctcgggcgacggtatcaatgtaggcaagcgaggtgaatcgaatggaaccgaagtggaacggacatgggggcggttgaagcatatgatatttttattttattcattaaaatattttaattttttttatttttaaattattacagaatctttctctaatattttttgggagggcactttttataaaagaactatactatgagaagtgttttttatgatgcgggatataattattaatcaatgctaacgtttgtatgaagaagggttgactattttgcaagggggtcacctgcaaatggtataggtgacattttacaggttactccttgtcctcctctgggatggttgtaaggagtgttcactaaatggttagttttactctgtgcggcggttagtatacgctattatatgtcaaagtcataaaaaattgttcttaggagcgttggtggtttaaatatgtactactttgaaaataaaagttatttttaaaatattttaatagataaaatttaaaataaaaatccgagagagcacttatctaatggctaatagaaagatgtctactaatatgatggttggaaactcctgtgaaggctctgtttgactaggctgtaaagcttggcatattagcagtatgtaaaacaagataactcattagcatatgactaattgagtactaattactacaaacataaaacatggatttatttaattttcttaaagaaacttctataaggggtagaaaaaaaagctcatgtctcagatcagcttggagcaagctaggcctttagcttgcgagcttaatgagccaacttacaagctactcgtttagctcattagtattaagtataagagatcacttcatatgtatgctgtgcttcctatttagtgtttagtcatttaattacatccaaattatttatatttagtaggttatttattagtcaatgattattattatatttgtatatgataaaatggtaaagttgaaattataagaatgatataaatgcattaacgagcctaacgagcttagcagttctaagaaacatgctaatggaaaatgagaaaattaacatagccaaaatcacttccgaacgggccttgtaaatactctctgtggagcacctgtaagtcgtcgttctataaactatacttgggcgtacaaactataaactaatctcaaacatgacttaattgccctatatttatattgagttggagaaatggatcacttatttacaaggtaaccactatcgagatactatatagaatcgttttctatttgtagtatcatggaatcggtatactataagattttagaatgtacatattttatatcaaatatatattatattagataaattaaaccatataatattaatgttgataaatttaattggtttttatgaaaacttgagcatatttaatcacaatatttttcaatccattttatgttattaagcaggatcgcagtgatcgtaaaatcgggataataactaaaattttatagaatcatgtgaaaatgaatagtaatatcgatatactatgaaaattgatactaaataggaccgattttgtttcgtcattgcactatcgtaaaatactgaaatacagatcccaatactaattaataaccttgcttatttttaagagatgccccaactacaataaagatctcaaaacataaaaaatagctctatatatatatatcgaatgaggctctcttatgttatgtacgttagaaggacatgggccactgacatgtggggccatgatggtgggccccacccataagggacacatgtccctctgaatttacgtcatatgagctgcttccatagatatcagattagaacagagatgggagagtaaggccctgtttagattccacgcaaaaattttacatcctctcacattaaacgtttgaatacatgtataaagtattaaatatagtctaaaaaaataactaattgcacagattgcaactattttgcgaaacgaatcttttgagcctaatagctccatgatttgagcaccacattaaacatttgctaatgatggattaattaggcttaataaattcgtctcgtggtttattgacggattctgtaattagttttttattagtgtccaaacaccccatgtgacatcctatataatatccaatataatacgccaaaacgttacacccctttaacaccccctaaaaagacttgtatttgaaagcacgtgcacatgaccgttgcttgaccgttacccaaacaccccatgcggcatcctatataatatccaatatggcacgacaaaactttacacccctttatctaaacaccccacttgtatttgaaagcacgtgcacatgattgttgcttgaatgaatgacgtgaggccactcgcatatatgcatgcaacggaacacatgattttggc

SEQ ID NO: 28149 - DNA, 1236 bp, Oryza sativa
tttaatgttcggctaattattttttttataattacgctagttttacacctctgctcaatcagtcatcactcatcagagagctcaggcagaaacacccaacgagctagctatatagctatagctacatatgcagcgcgcgaggctagctaacgagctaactaaaccaatgaccaatcaaccatcgatctttgcctttggttgatcatcaggaggtggcggccggcgacgcagccgctggaagagggccctctggcggaggttctcccggaggcggacacggtcgtggacggcgtccggcacggcgcgggacacgcaccactgcagccggtggcagaggttgggcatgcacaccgcgccgtgcccgatccaccgcgccgccgccgccgcgtaggcgtccgcggtcggcacgaacagcggcgagagccaccgccgctgccgccgcttgctccccttggcggcggcgtcgtcgccgccgccgccggccttcgcgacgccggaggtcatgttggtcgccacgaacagcggagcctgcaagcatgcgcgtacatcgcgttcgtgtgtaccattagttaataggactatcacagttatgacataaaagagggtttatggacacaggtacttcaaccctcctcacgacttagaaagttgaaaaatttatcgataaattttcttctaaaaggttatcaaacgtaaatttagtacaattataatatactcatattataacttacatataactacaatataaatgatatataactttttatataaatttaaaactgttagatttactttaaatttgtgtaagtggagaagaaaaaaatcacaacgtgcacataaagagatttggtcccataacctcgcttcgtgaaaatagcatattactgcaagattttaatatacaagttgtattgtatttatatacaacttacaatataattattctatatttgtaactgtcaaatttttaaaataaaatttgtcaacatatgtataacaaaactgttcattaatagattatgttttatatacatattctgcaccttgaacgatcatcaagtgacaaaaagttatactatgatgatatggcttatctcggagtatcaggtatggcttaaatctgtcgttctttataacttcaaaactaagctcatgtttgagttcactgaagataaaaattaagtatgaacacgtgaaataagaaaactattagcgtctgatttatagatagtt

SEQ ID NO: 28150 - DNA, 5498 bp, Oryza sativa
aattcgagctcggtacccttatgagagcacgagctttgtgtacgataccacaatgagagcacgagcgcaacactcgtcaccgtggacttaaccacaacaatcgcactcatgtgagacgtcatccgctttgtacttgagaatccggcccctgagttttgctggccaggaactccaccatagccaacattgtcgaaatcttccacgaccacattgaccccataacattcgctcctagttcacatcacgaagtagaccattggccatcccacacaggcgatggtagtaaatgaagttgagttgtagagaagaagggagaagccttacatgtgtaaaaaaggggagatgagcatccgtgatttatttattcagcctcctgacatgcgaactgaataacatcgacactttccacatcaatgcattaaccatgtatgctgaaccgaggttctacatacaaatctgcatgcaaatccctccttgttttagggcaccttataatgatcttttagatgagccaccattagccataaggactggctacgaggaataaaaaataaaaaaccattcttcatctctctccatcgcagatccctctcctacgagtgctatgctgctgcggcctcctcctcctgtgagccccgctgcttgctcagccgcccccgccgatgtagcctcctcccacgagctaccacacagccgtagagttcctcccaagggcgccatggtcactgcttccaccacctcttccttccacgaggcaacgtaactattgctggatatgagctcttcctggttgggatggtggggaagaaaatactctctccatcccaaaatatacggcacaaccacgtttctcttatgtctcataatataaggcgtgcatgcatgcatacattaactagcacctcttggtctaataaaattgatctgttttaaatcctataccatcaaacctcctaatcacattgcttacatgcataaaggtgatccagccaagaagatgattaaattaatgttttcttgatctttgtgttatgagtggttgagcaaatggagtaaagaggactagaggagtcattggttggatggtaaaaggtggggcacagctaacttaacactcccttactactatatacattgtaaaatactctagatggtatataatagtggggtccacctagaacccacggtaagatccacttgcacattgcgcatgcttgaatttttcattttgggttttatgctgaccatatcatatactccctcaatctcaaaatataagcattttgaccctgacacgatctccgagatgctactttgaccatcaatatctataaaattaagatgttttcaataaaaagagttgcatattataatagtttgtttaatgataaatctagtaacattaattttacatggttaatctttttttatttttttgctattaattattaaagttaaaaatgtttgacttgacactatgttaaaaatgcttatattttgggacaggggagtagaaatttcaatctacaaaatcccactgcattacctggtttattaaccggttaatgtaaagagaggttttacagtgtttgcgaggtacttagaggtattgagaggtggagtaatatggaccgttgatcaagagaggggcaaggtatggaataaaattatcataaccaatggcaatgaagtaattaactagtgaaatattgccattattgccgaattgaataccttacttcgttgatcgttacggtaagatagagaaaatataaatctacctaggcattgattagatcaacacagaaaaaaattaggttatgttttatttctcttctcccacatcgtttcgttcttactagggtttgaattggttcactagaaaaaaaaggagggagaactgtcaatatggttgaggattgaagcgagacaaggttagccggtcaatggcaaagcgaagcgcatccgcaagatttcatttacgcagttgatttgtgatttacatagctcacaatttcattcatatataagagattggaatgagttctcctcccctgttattcttccagattttgaattggtgcactcgcaaggagacacagtcgtcatggttgagcatctatgcaatctacaacgaatatatatcaatggatatttggcatgtggtgtagacgttgtggcattgcaggccttctaaagtggcatgcaatccatggatggcatgtatgcacatatatgtccaataaatggacatgcaggaggtagtttccattttatcagatgtgaagtaaatcaaggagatggttatttttaggtaatattaaaatctaagtgtgtgaatggtattataaaataagttatttaattccataagatatataatttttttaattagtgaattctacaaaacatataaataacgtaacgtatgattaccgtacgaatctgttattaagaaaaaaaacgtaaatctcaaaaagaacacgcaaacaacatcctgaagataatgactataccgatgtggtacctatgtacttataattataccattctctatctcttagaaaattatctttttacccttactatctaagtacatgtgctaatatttaaataccttttaagtggcactttttattatggagtgttggatcattatcttttttaaatgtaaacaccgtaaaacctctctaatgtaaatcatagcgaagccaaatgggctacggagagcaaagctactacagcggtacagataacgtttcactgtgccagcgcccagcttggcacgaggagtaccatgccgtgcctgaccaagttacttttttttttccgggtttctctgtctgttttttcctcagtttttttttttggtttttctgtttttcagttcagtttttatacctacatatacaaagtttttatacatgtatattttttatacatacatatacaaactttgtattcgtgttcttttttgtttttttatgttttgaatatgtacgcatacacatataaagtttgtatacgtgtatatatacttttatacaccaaaagtataaaaaaatataatatatattgtatatatcgatatgcatacatataaatattatactagaggaggtggggtccaagaaacccacagcgcggtgggcacgcgaccacccgcgtaatagcgtcctccctattatgtgcactaagacctgtttagttccaaagtttttgtccaaattaacttccaattttcaaccacaacttttctatcacatcgtatcaatttcaaccaaacttcagcgtgacctaaacacaacctcagatttaaactcgccttttttttaagttcaactgcgctgcatgcagcatgacctgtattattgactgcattcatttcgagcaggtacgttgctcaattctcccggggcctacatgtcgagtatgcaggtaaaggaatccatgtgcaatgccaggtaattgacgaccgaccaatctataaccttctcctcattactgacaggatcggatccgatgaaatttgcagccaaacacacacacacaaacttgaataacaataacaaatttacgccaattatcttttatacatgcgcaggcgccgttcttcgtggcgacgaggatggtggaaaacctggtggaggcgaggcgcctctcgccgttcacggcgaccccgggcgcctacgcgcgcgcggcggtggggtggatcggccgcggcggaccgctctgcacgccgagcgtccggcaccagctgctgtggtgcgccgccgccgccgccgcgccggacttcgttctcgactggatcctcctgcgcagccacctggagcagaggacgttgctttcggcggatcagagcatcgagggcgccatctccgtcttcgcagcacagagttgattccagtgcaaaagggcacgtagcctgatgggttacagtgacccgagtaatacttcaagatccaaaattcaaattaagttcccaattaaaaaaactatatttatcctgttggatataaatgttgagtaaaattaaaaaaacaaattgagatgagtgacgaccatcttacgctgtactacattaaggtgtgtttgaggaggaggggattgaggagattggggagattggaaagatacgtaaaacggagattggggagattggaaagatacgcaaaacgaggtgagctattagcttatgattagttgagtattaactattttaaattttaaaaatggattaatatgatttttttaaaacaactttcctatagagttttttttgcaaaaaacgtaccgtttaatagtttaggaagcgtgcacgcggaaaacgagatgttttctctctcaatctcctgtatcacccgggaacgaacgaagcctaagtctataaaagcgagtcagcactcagcagttgcattgtactatatatatacacagtactaagcgtacatatcacctatatttatatttactgtacttccttaatatcaaaatataatgatttttaagagttttacatgatgataaaaaaataggtgaaattaaatgaggaatgtttgtgatcggttaagattagctacgaggtggaaaaataaacacggaagatgattatgtatttgtgattggctataacaagagagtaaggtggtgtttagatcagagacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagttcaagattatggatgggttttattaatagtctacgtttaatatttataattaattttcaaacatccgatgtgatagggacttaaaagttttagtcccatctaaacagggcctaagtaaagagggggatagttttaccgtccttctgaagtacggcaattatttactacctccagcaagtactaggtaagttgaggtaccaaaatatttaatgtttggtatactttctccagtaaagaaattgatattttgggataaatttttaacactagaagttgctactcgctagcatttattttttcatggggtaattgcatccatgctcctactttcaaagccaattgttgttttatccctattttttagggtttacacttttaccctcattttttaatctgaagcagccatgtaccccctctaacagtcacaactaacaaacgacatatatatatacccttggtggttattgcagttttgcccccattttttcagtctttttgtgattttgccccattttttttcagcttgtgtgagtgttataatgtgaggctttgaccggccaaagctcgtgcattcactctgaacccctaaactacaggtcaacgcctgtcagttaatcgagactacgatgttag

SEQ ID NO: 28151 - DNA, 8664 bp, Oryza sativa
ccattcctttaggggtataaacgtattatcatatttcctaaaacatttttttatttccttttgaattttttaacacaacatcgtgggacccaccaaacggctgttacaactgagggtagatggctgcttgaaattcaaaaagtgagggtaaaagtgcaaaccctaaaaagtaggggtaaaacagcaattggcttcgaaagtgggggcatatatgcaattgtccctttttttattagcatttttttaaaaatttgatgaagtttatagaaaaatttagcaacatgtactacaccaaatttgtttcattaaaactaacatttaatatattttgataatatatttattttgtattgagaatgtttttatattttagtacaaacttgataaacttgaaaaaaaagagttagtacaacttataatataacacgaagtataatttttaagccaacagagtaatatttttaatatgtgtattttaacagtttacttcggattttaccgggaaacaatgatagtaaattttgttaaacatgataaataatattttcaccctatgtattactaaattgaacattggaatcaaaacaaccatgtgcacggacgacacacactctgctatgtacctatctatcctcttctgcctaattatcccttaaatttactcgtgcaatttgcgggtagctgctgcgtgccaatcggcaggtaaccgttccatgtccatgtccatgccagacggctgatgcgctagcctgccagctcaacgacgaaccgaacggcctatgcgcccgggcgtcagcctagtgctcgttataagcatcaacaacagtccttttatactactcccttggttctattttaagtatagccatggttttccgcgaccaactttaatcatccgtcttatttaatctttttttaaaaaaaaattaaaaacataagtcacgagtaaagtgctattcatgttttataatctcataacaacaaaaatagtaattataaaaaattttcaaataagatggacgattaaagttggacacgtaaactcatggttgcagttaaaatgggaccgagggagtatcatcgatcctaattttttagaattttggtgaaaaaaaatcctatcttgatactatttttcttttttgaaaactccatctccatattcttcgctcttcatttgagggagagcgacccaaatccctattttccgtgaggtttttctctttgtacacggggagagaagatcgcgcacttggagaagcgatattttttttacacgggtcagtggaaaaacaaatatttggttggttgttcaataagagggtccatttttagtttttaaggattaaatttaggctttcacttatagaaagaagtttttctctttctattttcaatttagaaaacccaatgatataattttgggatagattatacacattccgttgatgatgctcttaattacattcagctcgacgctgtccattaatctccggaaaatcttcagcttccggcacgatccgtggtgacctcgcgatgacagcgtacagtaagtcgtacagaccaagcccgtggaccgtggtgtttggggtggctcaagcaggaggccttgcagctggctgggcgtcaagttttaactaaggactcattcggaacaaattaaggttttgggaggatttaaatacgatgggtggaattactacgaggtaggcctctcactagagagggtacgagtaacctatatctgtacctaattttactcataaccatttcataattagcttattcatatccaatgggtatgtaaaatccatgtggccccacattattagaaatggctcaaaaacttgcacaaagttgcttctctgtataatattttattcctacgaaattcaaccaaatttgataagcttttatagtgtaaacgcaagtcttaaaattttgagactgagttctacatatataaaatgggtatggataaagtgagtactactacctccgttttacaatgtaagtcattctagcatttttcacattcatatagatatatgtctagattcattaacatccatataaatgtgggaaatgctaaaatgacttacattgtgaaacgaaggaagtaatgggtattacccttccctacccaaaactaaaatcctttctacccataccctccctaaatatatagtgtggataagagatcttttacagtgcttgaaaggtaactgaggtgcctccttaatcaattaatatccaccgataattcataaagcgtcagtgctcggcaactacctcagcacgctactcatcagtcatcgtcaccgccatatccaccaggggcagcggcctcggatggatccccgacaacctcaaccgcggccatctcgactacttcttctggctgctcaccgttctcaatgctgtcaacttcgtcgtctacctctggattgccaactagtacaggtgcaagagaatcaccaccactgaaactgaaactcaagcagccgcccagacttgaggggagattacaatcagaatcaaccgggaacgtatcggggaggagcgctcaaaagcggcaacggcgggtgcggccgccgtgagctcgtggtcgtcgacgcctcagcctcagccacctccaccgatgcctggaagtggaacggatcgggagttcagaacggatcgtacataaatatacatatattgaaaaaaaagaaaatatgcatttgcccttaacctcataaatcaattatgaaactcaatcttttaaccttccacttttcatatctggcccacccttttaataccttttcccttgtaccttctcttttggtgcgttagatcattagagatcaaccctactatgaggctgttgggaagaaagtattctccttggacttcctttaaaagtgtaattttatcatcttaagaaaataccataagatatcatattttcgatattttcaaatacacttgtaagattttggtcttataagtgctttctccgtaacaataaaatttctccctttgaaaaccctaagccattcatttggaattttggggaaaaagaacaaacacgagatattacatatatactaaaatgaaagtaaaaaatgacgccttatatttttagcaaaacaaccatacaatatatttacagccagttgttgaccctctttacgaacgaatccaacgtatgagccagagagctcaatgctcaaacccttctatcccagtggaatcccatgaagagaaggagatatgaaaggtggaaaaggactagagggctggagtaggaagaagatgataagcctcctcctcactaatcctagatccggcctggcccctatttatgccatccacctgcccttgtgacagtgtaccagtgcgagtgatcgatcccaagtttcagtggtccgcgtcctgccggttttatttcatttcaattcactgtgacattaacacacactactgcttcctaccgtgcctaatcacaccgccaaattattactcgtgtgcattagtccgtgccgcatgcgttccgtcatatatttccacactatatatcgcatatatctggcctgtttggtgatatagttttggcgactcggcgagtaaccgttccaaatcgctctcaaccgcgccatggccggctagactgcatgctaatgctacacatttatattgtacaaccccgccggtggggaggaagagagagcgagagagcgaatcatcatggctagtcatgtcttcatgatccggcaagagacggcgccggcgcagtggtggttcctctcgctggctttcgtcggcgccgcctacgccgccaccgtcacgctccgtttcgtcgcctacctcgcgctctgccggtgtcaccggccgaaggacgacctccgccgccggtacggcgaatgggccgtcgtcaccgggccaacgtccggcatcggccgtgccatggcgctggagctcgcgcgccacggcctcaacctcgtgctcgtcggccgtgacccagccatcctccgggagatctccggcacggtcaggtctctccacaaagtgaagaccaagaccgtggtgtttgacctgtccctcgtctggacccccgatggtgatgagccgctgcggcggctgcgggaggcggtggaggggctggacgtcggggtggtggtgaacaacgccggcgtggcgaagcccggcgccgtctacctgcacgaggcggacgtggaggcgtgggtgaggatggtgcgggtgaacatgtcggcagtgacggaggtgacggcggtggtgctacctgggatggtgtcgcggggtaggggcgccatcgtcaacatcggctcggctgggtcggagtacatcccgaccttacctctctacaccatgtacgccgccaccaaacggttcgtacacacgtaaagtgacatgtgtcataacttaaaaacaccatactttagatcagtggtattatactcttgtgtacatatgaatagaccatgagagtgaccggcctgttcatttcgatggagcaggtacgtggctcagttctcccggagccttcacgtcgagtatgcaagtaaagggatccatgtgcagtgccaggtaagttaatttatcagaaatctgtaaagaggccctgtttagatcttactttaaaattttttatcatgttacatcgaacgtttgaacacctacatgaaatattaaatataggctaaaaaataattaattataaagattgcgactaattcgcgagacgaatcttttaaatctaattgctacatgatttgacaatgtggtactacagtaaacatttgctaataacggattaattagacttaataattcatctcgcggtttactgacggattctgtaattagtttttattagtgcccgaataccttatgcgacaccctatataattaatatctgatgtgacatatcaaaactttacagccttagatctaattaaacaccccccatgcataatttgtaacttccatttgagtttactcattgacagattatgatgaaatctggaaagcataagggaatcaaatagctaggagtatgtatgatgctatgtatgtgcatgcgcgcaggcgccgttcttcgtggatacgaggctgatgttcaggttcgaggaggcggcgggcggcgtatcgctgttcacggtgacccctgacgcgtacgcgcgcgcggcggtggcgtggatcggccgcggcggcgcgctgtgcacgccggccgtccggcaccagctgctacggcgcatggccgccgccgcgccggactccgtccacgactggatcctcctgcgcttagccacctggaacagaaaacgttgtttcagcggatctgagtgacagatgacagattatgtgatgctaaagaattgccaacaaataaataatgtgtcttcgaaaagtgcaattgccgagaaattgtttgttgcccattttatgcatatttgcatacacataatcggttccgagatctagtattttcccaattaacttctgttgacaaaattggaccatggtgtagcgctggcgattggcgtttggtattgatttagtagtatcaacgaacataacaacgagtacttgcagaggagtcttaattatcccaaatagtatatatggggagtgtttgagaggagaggaaaagagaagattaagaaacgaggtgagtcattaacgtatgattagttgagtattaactattttaaattttaaaaattgattaatatgattttttaaagcaactttcctatggaaaattattgcaaaaaaatacaccgttcagtagtttgaaaagcttgcgcacggaaaacgacgtgttttctctctcaatctcccaggatcggaaggtagtgatcaaggggatcgtttcacttatcgcgtgattatcgcgcttaccgcgcgggtacggtagggaaaccggcgatatggtttggaagaattttcaccaaattcaaaattccggaaaaaaaattaaaaaaaattgaaaaaaatcatggatgtacttcttaatttgtaattgccaatggtaaagaaattttttgaaatagagaaagctagattcaaatttgtggacaaaaccgaaaatagtttacaaattaaaaaaatgaagaaaatattgggcgttaagtatcctacgtattcttccaattattctcaatttctagttttctacacatattcaaccataattttgatttttttccctatttattttttatttacatgatttcagctacacagctcgtgataaccgtacggatatcgctgttatcgcggtaaaccgtgcaattatcgcggtgaaacagcgaaactgacgagttttgaattcgaatttttggatgtgatttttgtgtgattttaggcgattatcatggttatcgtcctaccgcggggtggtggtaaccctggtccaaacgataaggtaaaccctggggatcacacatcatgtccaagaattacggttcaatgttcgttgtgaaagatctacatataccaacatcggcataacttatcaatgaactattggtcgatttccagtgacaacaccgagttacgcgtgtgtgatcgacacacgaggtgtgtgtttaagaaaacaggcaccgtcacgttcgtggtgttttgtaccggtgcatcgttctttgaaattcatgcatacgacgatactcagtaatgtgatttgtcggagtgccgcatattcacatggtttgtgtatcttttttctgctacatactactacataattagtttttataggtggctgaatttcctttctaaaggcggttaataaaacgccagtgaaaaaatgaaaatacaaaagattcccgcatggagctgctatctgcatatcacagtccacacaccacattgtcccatttccatagagaattaggatgaaatcaccataaaaccgtggaggataggggtgaaaaatgagcggattcggacggataatagctataccatatcctaaaccatattttttaagcggatgcggagcgggtgcggatgacgtgcggatgcggatgcggagcggattatttcgaacgtcggattcagtgcggagtcggtgcggactcggttcggaaacggacaaaaagttatcggatgttaagtttgtattcaatccatacaacaagagggcggcaatacatttagccccaatacgatggcaaaacattattagttcattgcgttcagttcaatagtaatagtataacaataagtaataagtgttcggttcaatagttcactagtaaaaataatccaagatacatccatgatccatcaaaaacataatataagtgttcagttcaatagttcaccggtcactacgttaaaatgtaaaaataaaagtcatcggcatgaggcaagccatacaggcatacaacaacagcaagcatagagcagtagagcacccctatgcagtggtgctacacgcagcatactgcatacaggcatacagcagtagtagtacaggcgtacagcacaaaacacacagcagtgagcagctagcagcctcctgcagccggcggcggcgctagcagcctgcagccagcggcggcggcactagccgaggaggagtggttggcgcgtgttggggaggaagatcggcctggcgcgtgttggggaggagcggccaccgcgcagggtcgccgtcacgccgtgccaccgcgctactctctccgactcctcgactgacagctgagggacggcacagagagagagctagagacggatctgggggatgaggagaggattaggttaggccaggttgggctattgggctagctaggtgggcctgaaagttgttgtgtggcctgaaatttgcggattatccgccaaacagtacatcggataatccgattaaaatatcggataatccgcatccgtcggatatcgttcatgtcaaagatagcatagtatcttctatatttggtgattgagacacgtatagaaagtcctctatcaccttcctttttatgtaattacattccattcatgtaatcctggaatatatttaattgaagatagccagcacgattgtgcttgaactgtgccaaatcctctccctgtttgcttggtatcagagcaggtattctgcttcttccaccccaaacttcccgatcccttcttccgctgcctctccatggatcatcagctccgtcccaacaacgaggccgctgcagccgcgggcgctgccgccggtgcccctgctggtggtgccatcgtcattcccgctgcgggtgccgctgccggtgctgccgccggtggtgccgtcgtcgttccccacggacctgcagcagcagcactcaccatcgctagtgtcaggacgcatgtgcctgtaaccctagagatgaaaaaccacaactacaccaagtggcgtaccttcttcgtggcattcctcggcaagttcgctcttctcctacacatcgtcggcccgatcccccccattcacgatgccgcctgggcccaagacgacttcgccgtcctcaccgccctctactactccatcgccgacgacgtcctggacatcatcatggagcccgagcagagcgctcacgctctgtggcttgctgcggaggaccttttccgagacaacaaggagactcgcatcatctacctcgagaccgaatttcgcagtctcaatca

SEQ ID NO: 28152 - DNA, 1278 bp, Oryza sativa
ggtgttcctgcctcgtctggcaaccgcgcaggggtggcggcggtgggggcgaccagaccgggtctggtaaccctcgcccacccactggaccgtgggttgtttacccacagtgggccgccgcttcgtggcccaccgcaccaccgcagccctggttcgcttcctggtgcccagttggtggaccgggcctcctcggacctcggcccaactatctgccatagcagcagcaggccttcgtcaccaacgactccatgggccagccggcctaggaccagtctggtttgatctctgcgattaataacatgtcgttgcagggaccttataacagtggctgggttgttgactccggtgcttcctcccacatggcctcctctgatggtatactccattcctctcaaaacccctcccaccccaccacagtcacagttggaaatggctcgtctgtacctgttactcgtgttgggcgcacctctctacactcctttaaactagataatattcttgttgttccttccattgttacaaatttactctctgttcgtcgctttactcgtgacaactttgtctccatcaagtttgacccttttggtttctctattaaggacctatggacggggaccgtgagacttcgcttcaatagctccggcgatctctacaccattcctcctgccgtcgccactcgattccatcccaacgtcgtccccaccagtccacgtgccctcctcgccaccgccccttcagtcgacctttggcatcgtcgcttgggccaccctggacgcgatgttcttcagcacctgcagaagcgttcttttatttcctacaataaaaatagtacacattcttgtcatgcgtgtcagctaggcaaacatgttcggcttccgtttggttgttctcgtactattacaactgctccctttcaaatactacattgtgatttgtggacatcacctttattaagtaattctggtttccgttactatcttattattgttgatgactactctcacttttactggacgtttcctttgaagcaaaagtctgacgtttttcccatttttcagtcttttgtctcgtatgtccatactcaatttcatctcccactgcagtgttttcagaccgacaacggccgtgagtttctcaactccgccattttgtccttcttcgacagccatggcatcattctccgcaccacctgtccctacacctcccaacagaatggtaaggctgaacgttctatccgttctaccaatgacatgggtaccgagctcgaattcgcctata

SEQ ID NO: 28153 - DNA, 11585 bp, Oryza sativa
  unsure (1)..(11585): unsure at all n locations
ccacaccctttgagcgcctgttcggtatttcaccctccctagaccatcttagagtcttttgttgcttgggttaccctaacttatccgccacagcaccacacaaacttgcccctcgctccacatcttgtgtttttctcgggtatcctcattcccaaaaggggtaccggtgtctcgacctcaccacaaaaagggttcttgtttcacgacatgtttatttcgatgaaacgatttttcctttctctactgctgcagcaccatcgaagtcttcttcactagacatggacttgtccttccaggatgatgcacctggacaaggtgttgggccagctgcagcccacggacagggtgcccctgctggagggccaccctccccacgcccgggtcctggtgcacgtgctcctgaccacgggccggcctcgccaccatcgactccacggcctgcttcaccatccgctgggctggcctcgccaccgactccacggcccgctgggccgacgctgcctggctcgcctccagatgggccattctcgtccactgggccggttggtgcgacctctccatcagctgggcggatcgctgccgccagtccaccaccagcgggcgatgacgcgccatcgtcgtccgcatctacgtgccatcctccaggggcgccgtccgagagcggcgctctcccacggcctgctcctggccctcatccgatggtgactcgtgcgaaggtgggggtggtcaaaccaattgactgcctcaatctctcgaccgtccacaaagacgccgctccgctcccgaagacgtaccgcaccgccttgcaagctccatgcaatgcgtgacgaatatgaggcgctggttcacaacaacacatggaccctggttcctcgtctccctggggtcaatatcgtcaccggtaaatgggtcttcaaacacaaatttcatgcagatggctccctcgctcagcacaaggcgcgttgggtggttcgcgggtactcgcagcagcccggcatcgactatgatgagacttttagtcctgtcgtcaagctggctacaatccgagtcgtcctcagcctcgccatctcccgcgggtggcccattcaccaactcgacgtgaagaatgccttcctccatggcaatttggaggagacggtctactgtcaacaaccgtctggcttcatcgaccccgtccaccccgactacgtctgccacctccacaagtcattgtacggcctcaagcaggcccctcgtgcgtggtatcaacgcttcgccagctacattcgcacacttggcttcactccatcggcctcggacacatccctattcatctacatgaacggggctgacatggcgtatctcctcctctacgtcgacgacatcatcctcactgcctcctcgacacggctacttcaccacctcactggtcgtctccatgacgagttcgccatgatggatcttggggatctctaccacttcctcggcatctccgtccagcgcacccccaacggccttcatctgtctcagcgacagtacgccgtcgaccttctccagcgggctggcatggccgagtgccatcccacggccaccccggtggatacccaaggccaagctctcggcttctgatggagaaccttccgtgatccaacggagtaccgaagcctcgccggggctttgcagtacctcactctcacccggcccgacctcgcctacgccgtncagcaagtgtgcctacacatgcactctccgcgtgacgctcacttgggctggtcaagcgcatcttgcgctatgtcaaggggtcactggatcaagggctctttctccatgctaccacggcatcgacgctcacagcctacagcgacgccgattgggctggttgccctgactcgcgccgctcaacatcaggttattgtgtcttcctcggtgataatcttgtctcttggtcctccaagcggcaagccatggtctcctgctccagtgccgaagcggagtatcgtgctgtcgctcatgctgtcgctgagtgttgttggcttcgcaagcttttggatgaactctgcacccctctccgctctgcgacagtggtcttctgcgacaacgtcagtgccgtctatctctccgccaaccctgttcaacataaacgtacgaagcacattgagatcgacatccactttgttcgtgagaaagttgctcttggccttgttcgtgtccttcatatgccgtcgtctcatcagttcgccgacatcatgacaaagggactaccagttcagctttttcaggattttcggtccagtctctgcgtacgggaacctcacgtctcgactgcggggggtgtcaaagatagcatagtatcttctatatttggtgattgagacacgtatagaaagtcctctatcaccttcctttttatgtaattacattccattcatgtaatcctggaatatatttaattgaagatagccagcatgattgtgcttgagttgtgccaaatcctctccctgtttgctgttcataccacatccgcatgacaaaatccgcatccgcatccggccggatatctaaaaacccttgccaaatcctcacatcggacggattcggagcggatcggatcggataacatccgctccgttttcacccctagtggaggaggataaattgtctagtttcatcagatgatgacacctctatatcggttagctcgtaactcctggttttggacagcctagcctagtaaggtagccaaccgtaatctaacacaccgacggatgcagatgcagcaccacgaagcaacacccagctcctcctctcgacatcgtcggctcaggcttcaaacccatgatacttgtcccctctcctctcgactttccaagggtacgccgcaggcccagcatcgccgcgtccacggcacgatgcaccggtggcgctccctttccctcttcaccgctgccatcctgtagctggccacctgctcggtgcacgcgatgtacgaccagcgtccaacaccttgtgcgatcacgctcagttcctcctcggctctcatttcacttgcttcttggctcctcgcctcgttggcttgatatatatttcccgagatattgagttgctgtatggtaccaatctgatgctgagtagacagtgagaggagggatgcagaccgccagggaaggaatgcgccggagtgaagttcgccagatcgcttggcagtggctgggtcaaagggattgatgtgtggcactgtggctatggaaggggagggatggattagccgtgaggatatggttggcttcaaaattacgtttttcaaaataaatctcccctcatataatacatatttgggcatataaactatcttaaatttaaatgttgtcagttttaaagttatagatctcatacattcatataggctatcttagattgtttaaaaatttcaaaaatttaaatttttccttatccgtggcggttcgtaacaacaatcattcacagataacattatttgtgatgggtggtaattaagacccatcacggatgagtgctctcattttttacgaatcatctcactacacccgttacggatgacttgttatacatgacggagcatggttgtgacccatcaaatgttatccgagacgtgttagactaggatccaacaaagttgacattctatcagtgatgggtcatctgctgtagtcattaatccgacatggatagttcatcaggaataatgtgtagatctgtactagggaggtaagttgttggccctgtttattccatcacgtgttgtgtgacagtgcaccagtgcgagtgccgactgcatccccaagtttcggtggtccgcgtcatgcgccgttccggccaaacaccgcagagcagcacgtttaatctaattaatttcactgtcacattaacgatctacagcagcttccttggtgcctaatcacgccgcgaaattattacttcctgtgcattatagattctcccatgctttaatttgcatcccgccagtttttgttggttagcaactcggcgagtaaccgttccaagtcgctctccacagtgctgcgccatttactgttacacacatatttatatcgtgcaaacgcggcgccctgtacagtggcgaagaagagcccggaatcatcatggctagtcacgtcttgttgatccggcaagacatcgcgacgccgtggtggttcatcttgcgggccttcgtcggcgccgcctacgtcggcttcgtcgcgctccgtctcctggcctacctctggctctgcctcccccgcatgcccaagggcgacctccgccgccggtacggcgagtgggccgtcgtcaccgggccaacgtccggtatcggccgtgccatggcgctggagctcgcgcgtcacggcctcaatctcgtgctcgtcggccgtgacccggccatcctccggcagatctccgacacgatcgcgtctctgtcggagttgatcgtggtgaacaatgcaggcgtggcggagcccggcgcggtgtacctgcacaagccgaacgtgaaggcgtgggccagaatggtgcgggtgaatgtgtcagcagtgacagaggtgacggcagcggtgttgccgggaatggtggcgcggggcaggggaggcgctgtcgtcaacatcggctcagcggcgtcagagtccatcccgtccttacccctatacaccatgtactcctccaccaaacggtacgtacccacgacaacagcttctaaaataaccaacatagtacgagatataacaaattttatattatacaaatttattgttttattagtactatgttgagtaattttagaatgccaaagtgagtagtaaaccaaagtgacatgaaacaacttacgacaccatatttatatcagtacacacaacgtcatacatatgcatgagaatgcaccactacaaaaatgttcataaggatcggccatataggtaaaaatcggcacctatactgtatttcccaccaacctctacaagaaccgatacctataaaactatatagacatcgaaccgatgtctataagatcgtatagatattctgtagaccggcttatttttttacagtattataggtgcccgttataatctaaaaaccgacaccttcgtaaattaaggtgtcggttataaacacaaaaccgacacctatgaagtattataggtgttggttttggtacagaatcggcacctatatgcttgcgagggcagcactttctctattataggtgccgattctttatcgaaaccggcacctacaatatcacataggcgccagtttggaaaccgataccaccgactttgatcattagtgttgactaataggtgccggcatcaaaaccattacctattaggtcttcccaaccgttacatatatggttttctgtactagtggtgaccggctggttcgtttctagcaggtacgtggctcagttctcccggagccttcacgtcgagtatgcaagtaaagggatccatgtgcaatgccaggtaacttaattcatcagaaatataattcgtaactttcagttgaatcatttactcattgacagattctgataaaatctggaaagtatgtgcatgcaaatagggaatcaaataggagtatgtatggctcttatgtatgtgcatgcatgcaggcaccgttcctcgtggacacgaggctgatgttcaggttcgaggaggcggcgggcggcgtgtcgctgttcacggtgaccccggacgcgtacgcgcgcgcggcggtggcgtggatcggccgcggcggcgcgctctgcacgccgggcgtccggcaccagctgctgcggcgcatggccgccgccgttccggactccgtccacgactggatcctcctgcacttaaccacctggaacagaaagcgtcgtttcagcggatcagagtgacaagttctatcgacagattatgcgatgctaaagaattgccaacaaataaatgtgtcttcgaaaagtacacttgccgatatattgtttgttgcccattttattcacactaggaaggtggcccgcgcgcatacgcgggcacttatattattgcaagctaagattattgtttgttcaaaattttcatctaatagattaagggcaaactaaagtttggataatgttatttcataataatttaagggttctattttgcttaagatatcttagaaaaccattcacaaaattttgagtaggagatacattaagtacttacgacttttgaatcatgttttttttcgagtaaataaaaaactattgtgacttttgaatcatgtttaactcaaaattcttgtgattaaatcgtctcatgaagacgcatgatatagttagaaagggagggaagcgtatgtatggaaaaaaaagaagaaagggaaaaatgaaaaaagggagggaaagcgcacgtacccacgtatgtaggtgcgtacctatgccgcgtatgtaggtgcgtacccacgtaggacctcgtagtatttagtttgttccaagatcaatttaatctaatagtttataatattgaacgtaccgatttaagtgaaaattaaataatagatactttgcttttttttttagaatttatagtactttctctaatttattagagcaccatgtggtagcttgagagcattttaagaaaatttaaaggacttaacacatgtaattagaatattaaccatgtaatatatatgtatggggcatatggtaatatttgtccagcttcgtccatgtttatataaataattaactatgtgtctaattaatagtaattaattttgacacctatttacaattgttcatagtagctcttacatattcatcttacgactttgattatcggttgatccccaatttactgatcaccatgactcgcatgaaaaaaaagtgctacttaggttttaggacagctgaaattgatgaattatcttatttgcgtggtagctatttgagggtataaacgaatgaattggcttctaaaaagttaaattgtcgtttaaaaagacaccatttataaacttggaaagtgtgcaaactaaaatccaaactatagaatcgggaaaaaagagaatcttaaactcccttataacacccttgtcttagtaagagttctattgttattcgttaatattgtgctcacatttataacataataatttctttcacctatacgaacaaatagtacaaaatccaaatacgacataacacaatacattataattattctataaccaactctcgtttttagcttaaacagagctaagtgttggaaaaaacataacccacggtgcttaattcttctctcgttgcatcacacctttaattttctttttatgttattaacaaaattaatcatctccatatatgatttgatatgtggcaaagcaatagcgttgcagcggtcgtgatcaccttagatgcctcacacacaacgcttgtcacgtgtgcgaaaggcaaaggtgcagacgtgcattgtgcagcgggccaaaaagagaacttcggacactttatttatttgcaaataatagatccgatgatttaaatgatgggtcatcggttctagtataagtgtaaattagttaatatagattttaaattactaatttaacaggtacacaatataatggtgtagactttattttgaaacagtgtattatttgagaataagagtccaatgtaataaaaaatagatacgatgttttaaataatgggtccatcggtttaagtgcacgtatatagattttaaattgtttatttgataggtgcacaatataattgtgtaaactttattttaaaatagtgtattattttaaaataatagtacaaagtaagtaatgagtacaccggtttaagtggaaatgttggcaaaagtgggtcatgatttagtggacgacgtctgcataggatcacaccaacaccagtctgccgccgtgaaccgtttgggccgagagctatactactatagaatggatttttctgtacaagagcgcctataggtttcagacggatggtaacttagtcttgcctgcaataatcactttttcaattgcagttaaaaacagcatgcgaaaatgcattttaactgatggaccccttaacatatctgcacgtgaaaattgataactctctattgtgcattaatttgctcagtacttttattatatctcattagtatatggcctataggtggttttagccatcgttgtcaaactaacgtaccgattaattaactagctttcagcttggttaatggtttgatactttgaagaaccgaaatctattttatggttagtattgttggcaattttttatgataagtcgacaagcacgatcgtagcacctaaacgccttgcggtgatatagagtcgccaaccaccttgatctagccaaaaggccaaatcaagatgggttttgtagaaaaaacaactaaaccggctagcggagccgatttagagtaagctgattttgatcataagaggataactacccgtctcgtgggtaaaacggaaggttttcaggacaaacctacataaaggtgtcgcactctcgcagcagcggcggacgatttacggtgcaaatcgacaaagatgggctaaaactatggtaaaatagaaaacattgctgaaaagtaaagataaaagaaaaatagaaaactgcggtcagaccggccctactagtcggccagaccgcccacatacctgtggtctgaccggccctgtgaaggaaacccggcactttccaaactttgacaattttcccctatttcgtccatagatgccaaatttgggtgtaaacaagtatttccaagaaaactaacgaaatgaactgataatcaccattggctactccatccagttcaaaatataagacatatttatgtttagttatgacactcttgataattgctacactggaatattattagttatgtaatataaagtgagtatataagaaattatcgcaagtttttttagtgcaaaactattagatataactatagtataattacattgtaactgtattgtaaatacattttaattatgatataacttatataaaacttatatttaagtatggtttggttggctcgcatcgggattttacgcgtgttatgtgtgaaaatttctttctagtaatcttttccctttatgcacaaatctcaaggcgatcctatgaccacaaatctaaaacttttagagaaaaaacttgcgaaatttttttaagcaattccgaatataaaagcatattcataaggaagtagttttgaatatgaatctaataaatgaaactttaaaactatacttttctgtgatcaaagcctctgttcttgctaacaacttagtttttgagccctccgcgactgttagctagttgttgccacattattgttgcaacttggaactaattagttggcgggtaaccattccaaatcaacacatttacacatatatcgcccatatacgtccacgtcaacacatttacacattaacgaacaaaacctagctctacccacagatacgcgcgcacaactatgtgcaaatgacgccgaagagagctgtgcattgcggtcggatcaaatgatggctagccatttctacggcatgttccggcaagacgacccagcgccggcgccggcgtggtggttccagtcgctggccttcctcggcgccgcctacgtcgccggcgtcacgctgcgcctcctcgcctacgtcgcgatctgcctcggcgggcccaaggacctccgccggtacggcgcgtgggccgtcatcaccgggccgacgtccggcatcggctgcgccatggcgctggagctcgcgcgccgcggcctcaacctcgtgctcgtcggccgtgaccccgccaggctccgggagatctccggcacgatccgctcccgccacggccgggtgcagaccaaggccgtggtgttcgacctgtccctcgcctcgaccccggacggcgaccagccgctgcggcggctgcgggaggccgtggcggggctggacgtcggggtggtggtgaacaacgccagcgaggggaggcccggcgcggtgtacctccacgaggcggacgtggaggagtgggtgaggatggcgcgggtgaacgtgtcggcggtgacagaggtgacggcggcggtgctgcccgggatggtggagcggggcaggggcggcgccgtcgtcaacctcggctcagcggcgtcggaggccatcccgtccttccccctctacaccatgtacgcctccaccaaacggtaaatacatggggtacattcaccaaacacaaaatgacatattacaacatgtacaattcatgttatatatacatgtgcgtgagatgcaggtacgtggctcagttctcccggagccttcacgtcgagtatgcgaacaaagggatccatgtgcaatgccaggtaaccaattaagtttgagtttagtgatcattgtacacacagattctgatgaaatctgaagagagaaaaaacaaatgttacggcctgctcgcggcgacgtgtgtgcgatgtgctttaattgtagacgccgttcttcgtggagacgacgatgttggcgaagttggaggaggaggtggggcttagcgtgtcgccgttgaaggtgagcacggacacctacgcgcgcgcggcggtggcgtggatcggacgcggcgggccgctctgcacgccgggtggactgctgcaccagctgatgtggtgcatcaccgccgccgtgccggagtccgtcctcgactggatcgtcctgcgcttcaccacctggaacagaggacggtagctgttgcagccagcggagcagagtgtcaaggacgaggggcatgcaagttcagagagctgtggtggctcgctaagttaccatcctggccgctgtcgttcgattaccctaacggcgatcagccgtacgtcgtgaccacaagtcgcgcccgatgtgtgtatctcgagcgagtcaggggtggagattaggtttgtaaaaactatgtcaaaatgtaattttactttcaagtattgatatggagttatggacagtatgtaatcaacaacttaattagcactatttaatctatcgtgatagatatggaattcaatgcaagatacgcactttcatcagtagaataggaaggggcgatttggtagcatcacggtcgggatgaggaggattaagcagtgacgattggaagagataggaagaggcagtgaggtctcttcttccttagggcaagttttatagtagatgtgactattacatctaattttatgtataacatacataattattgagaggtgatatgtataataggtcacatctaccacacaatccccaatatctttaacactctcatatgtttattgaagtttatgtaggggttgccccttgcatgagaggtgactatttctctctcatccttcttctctcctccacctcactatttagtcctatgtgacatcttgggatttgtgcttggatgcccatagtacttgccactactagaaaacttattttcggcgtcgtaggggatcgattttcgcaggcaggcatgtaattcggagccaaaaccccgccggcaaaaaagatacccggggtggagggggcggtccgcctgcgaagat

SEQ ID NO: 28154 - DNA, 12445 bp, Oryza sativa
gatgcccctatatagtcttcttcctcctcgagctctgttcattctccccgaagtttctctctcctaaagtgacttaaatataggagggaggttttgaacttcaaatcttcgggggatttttctacggtacttagatctacttatttccacactaggtatgcaattttttaagcttttagaccttaatttgtgatggatttatgcatgcaaaattgtgaaggaagagttccatgttttttaattttatttcttttgatatgttgatattagatgtatgtctaatacatgatgcctcttgttgtagtggtttaatgtggtaacataaattctcaattttttttatttttgctatcacatctacctccttgttctagatctagatttagatcttgtcatatatagagagaataaaatttttaatgtctatttattcggtgcaatcaaaaaatagttatagtattttgtaatatgccaatgatatgattttgttagattttcctaatgtactaatttgtcatgtctgtgtaaaaaaaattgaaataaactttgattttttattaatttacacttaacctttagttaattagttttgaatagcgataagttttttcaataaaccctacaaatttggtattaattgtgcaaatattttacgtgtatttttttagagatatggaaagtcgggaatggatgtatcattggccgaggtttttgtctccatatagaaacgaagtgtctaaatttattggtattaccaaggcacacgctgagaagaccaatatgaggaagataatttgtccatgtgctgactgtaagaatgaaatagcctgggactttgacgatgcttttaaagtgaaggagcacttggtaactcgtggatttatggacaagtacgaaatatggacacgtcatggcgaagaacaagtggacgggccttaaaatgtagttctgacacaagttgaagacatggtgcatgacgatggttctgttgaggacaaaatcgacctagaggaaatgttacgtcatgcagaacccgaggtgctgatggggtcggctaaagggttaaataactttgaagctttacaaaaggcagcaaaggaagttttgtacgatgagtcgaagggttgtgacagtgagttcacaacactccggtcagttcttgaacttatgaggttaaaagtgagacatggatggtctgataccagtttcgacagtctgttagaacttctgcagaaaatgctcccgaggcctaactcactaccatcgagcacatatcaagcaaagaaactcatatgccccctttcacttggtgtggaaaagattcatgcgtgcgtaaatcactgcatactgtacaggaaagagtacgcttctttagatgaatgtccaacatgcagtgcaagccggtacaagtcgaatagcaatactggcctagaaccctctgaagcaactgagggacgacagagaaaaatcccgcagcttgtgatgtggtaccttcctgtcaaagaccgcattaaacagatatactcaaacccgcgagatgtagaactaatgtgctggcatgaagaagggcacaagaaggatgggatgatttgacacccggcagatgctcgttagtggataaattttgatgctcagtatagagagtttgctaaagacccatggaacattagatttgccctgagtaccgatggagttaatccttttagagacgtgagcagctcacatagtacttggccagtgcttctcaccatgtataatcttcctacctggctttgtagaaagagaaaatacgtactactctgtatcctcatacagggaccccgtcagcctggtattgatattgacgtatttcttgaaccattgttggaagatatggctgatttatggaaagagggattgaaagtgtgggacgagtacttaagggaatacttcacagtgaaggccatcatcttcgtgaccattaacgattatccagcaatgttttcagtttcaggtcaaattaaaggtaaaacaggatgtgtgatctgcttgaatggaacgtactataggtatctcccgggttccaacaagcttgtgtacatgtggcaccggcggttcctacgcataaatcacaagtaccgcaagatgaaggcggagttcgatggtactgaagagactgatcctgcaccaaaacctacatcgggagaaaaggtgtgtgcaataacagagaaaattgtttgcgagtttggaaaaatgactaagaaaccatcaaaggggacaaagcgcaagaaacccgagaagaatacaaaacaaggggatagtaagaagcaagatgatagttcgaagccagatgataaactccctcccccattcaagaagcattccatattttttaagtacctcccgtactggaaagatctgaaggttcggcatgccatagacgtcatgcatctagagaagaatgtgtttgacaacatagttggaacattgttggacatgccgaaaaagactaaagatggtctgcaatcaaggatagacctagtcaagatgggaatcagggaagagttacaccctcaagaaggagaaaagaatggcgaagtatatcttccaccagcctgtttcacactgacacctgaggagaagaagtcattttgcaactcactccgtgatgtcagagtgcccataggtttctcatcaaacatcagtcgactagtttcaatgaaaaatttgtcggtatctggttataattcacacgactgccatgtcttgctcatcgtgtttcttgcaattgcaataagggccataaaaccggagcttttaaaggttgctatcacaaggttgtgctactttttcaacgcagtgtcacagaaggtcattagtctcgaagagttaggaaatctacgtacattcgcacatgagacacaataccaacttgagatgtgtttctctccgtcattttttgatatgatggagcacctcattgttcacatagtgccgcagatggttgcgcttggcccattgtacctccatcaaatgtggtcatacgagcgttacatggcggttctaaagggttacgtccgaaatcgtgcacatccagagggatcaatggttgagggttatagtactgaagaggttgtcgagtgttgtatcgattacctcaaagatggatatgcaattggagtacctgtgccccaacacgaaggcaggttgagtggcaggggaacgataggaaagaagagattcgtcacccatgatcacaaatcattccaagaagctcacttcagcgtgcttcatcagtttgctatcgttgagccgtacatcaatcaacatatcgaactaatacaagctaacaataagggtcgcaccaccgagtggataatgaaagaacacaagcgtctcttcatagattggttgcgagacctagacttacctgagggacaaactaccgatgaaataactatgaagcggttggcttgtgatccatcaactacagtaaattcttggcagggatatgacattaatggatactcgtttagcacaagagcccaagataataagacctgtacgcaaaacagcggtgtccgtgttttcgcaattgatgaagccggggaaaaacaatcatacttcgggtttattgaagaaatatgggaaatcgactatgggcacacaatgcaaatccctatatttaagtgccagtgggtaaaatacccgaacggggtcaatgttgataagttcggtcttactgttgttgacctggcgagtgtgggtcacaaggatgacccttgggtactcgccaatcgcgtggaacaagtgtttaatgtgaaggacccttcaaatttgaagaaagatatagtgctaccagggaaacaaaagatattgggagtggatggggttgaagatgtcgaagattacaaccaatacgatagtatgccactttatagtcagtttgtacagaagattaagaatgtcgagacatctactcaaaagaccgtgaagccttacatacgcacggacggtgtgggcaaaaatgttaaagggtaatgattgttgagtggcatgtaagcatctaagaagttagtagttatataatggtggtatgtaaggtgatgtgtgatcatatcgcaaattgacgaataattgtactcaacattttggtggtatgtaattagtttgtactaatttttatgtgtaattaccatttgtagtgtaaaaaatttgttaaaaaatttaaattagtaatatttgaaaagtgtaattatttttatgtgcaattacaatttttaccatttgtagtgtaaaaaatttgttaaaaaatttaaattagtaatatttttatgtgcaataaccatttatacatttgaaaagtaataatactaaggtttgtatattttgtaataatattaaggtttgtatattttggaataaatatattcaactctgtaccaattttcgcaggcgggcggtccgcctgcgaaaattgttgtacaaagtagggtttacatcttcgcagtcggacggcacgcttgcgaagatagtaaaaacgatcttcgcaggcggaccgcccgcttgcgaagatcgttgccctatataagggcaagcccgcggcgccaaaatttctaagtctaaaagggagaaagatgtgctaagtacggcgctgggtactactaagcatgggggaagggttcgaggtgtgtcgagcaagatgagttggaaggaagggttcaaaaatgacccaaacaagaagcgtgaagtgtacaaggataaacttagagacgaaggggctgcggagtttgaaaggcaaatgatggatttctgcgtcaagcacatgcttttgcctcgccccgaaaccaaagaacctgagccagattaccccttcgatgacctcaaggagaatacaccctgcagattgcacgttcccattggacgctccgggaaaactcttgaggccgctacagccattactatccctaggagaacatacaatgaagagttcatacctgatgcgtatgccaaggtgcagccgcaagtggtccacgaagggtttgagtcctacgacattgacttcccgactgcagatggtgtatccgtacttggggatgcggtcgatcttgtaattctctggcacaagaatgacatatcctttggattgggcaccgacgccacgcaaaaacctgtggtgcctaaaccggggttgggaaaacctccgagaccttctaagaggaaggtgactgataaggcagaggaacccgagatgcaaagggaaaatccagtgccggaagtgccaccggagattgcattgccagaggcagccatggagattgcaccgccggaggcagccatggagattccagtgccggatgtgcccatagagattacagtggcagaaccagaggtgcaatttgtggcatcagtcgggtcagaaatagaagaagtaccaggattggaatggtacggtacagagccaggaatatttgaagacccttctcctgcgaaagaccccgaggttcaagagaccacggtccctgagaaggccactaccagttctgaggtgccacgagtgcttaggagccacgactccaagtccaaagatgagaacaaggagaagttcatggtaaccgtctttagagggggtaaggaacgtgccaagctcaaagatgacgacccccagaaggctgctgaactagccgggccaacatatttcgcaaccgatgattgcccggaaaagtacgaacatgggaaagcattcttgccggaatgggcactgaaagaaggaccatgagagatgagaaggttacataccttctacatggaggccagcaagaaaggcttgggcaatataacagctcgatccccggctaattgttttggcgaagagggttacgtatggctagatttctcagatctccacgccatatatcgtcgggataagatggacgtcaactacgtcggtgtttggtgcatgtgagtatgagttttaattaattagatgaaaaatatgtacaatacaaatccatgtgattgttactaacaaacttcttctgtaggatgcaatacatggatgctaagaagaaaaaagaacccatcggcttcttggatctaactcagatctgccaaacacagcatacggtgaggctagcaccagggtctgaccagctgaagggcaagaatccaaaagagatagcagaatacaagaagggcttgcacaaggataaattgattactgtcgcacagtacattggacgagccttcttgcactttcaaaataagagagtcgtcatggccgcttataattttaagtaagtctggtacatttatcttgtacacatatgtcttattttagctggtactaactaactatactgttgttaatatgtagcgatcattatatctgtttactcatccaccctaaagacggaatcgtggtagtcttggaccctctcgattacagtcacaagcaatacaaagaatttctaacaatcttacagtagtaagtgagtatgactcttgcatttgtatatgaatgtattataaataaatatcctccttattgtgaaacggtacgacatccatacagtgcataccaatactacaagttcaagggtggagaatagacccgaacacgggagaagctgctagtacgtacctattggccggtaatactccactcacttaatgtattccaattgtttcactaattgcaaattttaactaattttttctatgatatgtactgaagtgtcacaagcaaccgcgaggaacggtcctttgcgggtattatgcgtgcgaattccttagggttaatggacggtacaggactaacgcagaggatgtaagtctctatactatgtactagacagcttcacatatttatgatactaatatatggattaacttcaatgcatgcagttgccaagattacaatgtcgaacaagctttaacgatacaggtaccacaaatgtccagcgtgatctgtgccacttcatccaccatgagtgttgtcatgtgaaaggagatttcttcgacccagagggtgccctagcggcaagtgatgaatttaaggatcttcgggagtggaacactgctatgccataatgtaactagatgacgttatttgaagtgacaaggtaaaaaaatattgtaatatatatattttggcaacacttttgagttatgcaatatatgtagatttctcagtaccaaatgtttgataatcttccaatatatgtatataataatctacctgcaataatttctattaaataatttaaaagtaatttacgggcaaattattattaaatttcaatattttctacctatcttcgcaggcggaagtttttttttttgcaggcggccgattcctattttcgcaggcggaccggactagccaacgtccacctgcgaaaattatcttcgcaggtggacggccgccccgcctgcgaagatcggcgattttcatagtcgttggcatacaggcggacggtcgccccgcctgcaaagacccttttcggccgcttgcgataatgcttttcctagtagtgtgcccttatccacctctttttccgatgggagcatcaccccatgcccgacgacgtgggtggctcccttatgccattcctaacccaatgactagaatgatatccatagcattaaataagcggtcacctagaattaaaaatgatatggcaaagaaataaataaggaaagagaggagaccatgtcttgcatgagacatggtttctatacaacattcaagacatcatatgaaataagtagcattaaatttaagtatggaatagtggtgtttgcattggaagagtagtgtctagtactagtgttagactattctcaacccaatgattagaatggtgtccatagcattaaataagctaccacctaggatgaaagatgatgtagcaagtgaataaattaggaaagagaaggaaaccaggtcttgtatgaaacatggtttatacacaacttccaatacatcatgtgagataagtagcattaaatttaagtatggaaaaatggtgtttgcattgaaagagtagtgctagtactagtttcttgatgatgaggacaaaacggcagggtggtgaaaaggagatcggcggtggcggtggggagggcagaggaggcagcaacggacaagccatgcatttgcatcgtttgttgcatacgtttgaaccaaattgtttcatctagcgatctgaccatgttatactttttttttagaattaaaacattctttcgctatttgttgaaacattgtttttatataggtgaaataacgtctgattttttggaaaccgttgtttcatacgttgtagcaaaatgtttcatgaggtgatttggttgtgttttagtttttttaagcgattgaaacattttcaatctacttagtgaaacattttcgatctacttggtggaacagcgcccgattttgtaaaaaaaaaaaagaaaaatcaggcgcccgatttgtaggagccttggtttctctaggcagggacgtggaaggatgttttttaaaaaaagtttctcgaaggtttcggaagaggtttttcgtatttgagttgcgaggtatggatgaaaaatcagacgaaccatgtttacgtgacatggcgttataattttggaagaaaggattcttctttcatgtatttaaattaaatacgctacatgtgtttatataagtttatacgtgctgaatatttcttacccggaggtactcatggtgttttctgtagtaagtccatctctcttcatcaggatgcttagttatttcaagcatgggatgatgtcccacgctttgctgtggaatatatgttagatattaatgaaatgatttggattgaaatattataaaaatgatttaaaaataatgatttagcatgtgtatgtatagttttataataaaataaattgtagatatagttactatatacttgcacgttaagctttgtatgaatgcgttgacgtggcatgcttgcatatagattttagaagtgctaataaatattatacttgcatgataacctttagatgtttagtacacattagctcaataaaaagaagaaatttgcgacctatatatagctctcacccttggttagaaaacggaaatttaatttagattgagtatgggtgaaatttaaggcactgcaagaatctcaaagtacaattaacggttttgatatgggtgaagtttacaacggttaccttaaaatcgtgactcataagttgttggaaattaattgctgcagtgcgcgagcatatacagtactacatccattccaaaacaagtgcagtcatatatatcggtgtccaacgtttaaccgtccatcttatttaaaaaatttattaaaacttttttaaaaaactattcacatataaagtactatttatattttatcatctaataataataaaattactaatcataaaattctttcaaataagacgagcggtcaaatgttggacttgaacagtgtgaggaagtacaaccaacagtgcaaggttctcagtatcctaatccgtatcctaatatcttacaatattacgatcctaccaagcgaaacgatcacgataccgatcatagtcttacctagtatcctaaatgtcataatatctcgattctactattcattaccatacattttacgaaatcttaggtagtatcccgattatataataagatggtttgaaaatatgtaaataatatgctgaagtttatataaaaatcggttaaatatatcaaaactaatgtggtttctcttgataaatatccctatttgcatggtatatattattactatattttttatatagaatagctatatgtaattaatacaaatattaattaaacttaaaaaaatctcatagtattcgatcatacgatacgatactactttgaacaaaacgatactacttagcatcccgatattgataaccttcctatagggtcgcaccatttctctaagcaactatgtgtccgtgtgcacacgcggccacgcgctgcgcacctaatgctactgttttgttagtatttatttaatttagtactgattttttttctcatcaatacaatcactacttattttaagttatctttaaccaagtaaatctatttaatttagtactgatttttttctcatcaacacaatcactacttattttaagttatctttaaccaagtaaatctagaacgtacgaattatctctttttaaaaaagatcaatagtgtacgtgaaactattgcaattacatcgatcaaaggtgtggcccattgcatattttcattggtggcagctggcagctaggccaccacagtccacccgtttcactgtgtgtgtgtgtgtgacgttaacacgctactattcccttctgcctaatcaccccactaattttattattgtgcatatataatataatatatgcactaattttattattgtgcatatataatataatatatgcgcgtgctgcgtgtcgtacagcgcatatataatactccctccgtccctaaaaatttgacatcgtttattttttaaaacatgtttaaccgtcatcttattaaatttttttgtgaatattattcaaaaacttaagtagtagtatatttaacaatgaatcaaatgatatgaaaagaattaataattacttaataaaatgaacaattaaatatgtttaaaaaagtcaacagtattaaatattcagggtacaattttcccattttattgcatctgtttcactgtgttgctcggccaaacgtacacacagttcgttatatatcgtgcaacaccggtgcatggcgaggaaaccatacatatagagagagagagagagcccgtgaggtgtggctggaatcgtcatggctggtcatgtcttcatgattcggcaagaatcggcgccgccggcgccaccgtggtggttcctctctctggtcttcctcggcgctgcctatgtcgccaccgtcaccctccgcctcctcgcctacctcgcgttctccctgcaccgtcagcccaaggacctccgcagccggtacggtgcgtgggcggtcattactgggccgacatccggcatgggccgggctatggcgctagagctcgctcgccgcggcctcaacctcgtgctcgtcggccgtgaccccgccaacctcgaggagatctccaacacggtcaggtctctccacggggtggagaccaagaccgtggtgttcgacctctcactcgtggcgactccccacggcgacgagccgctgcggcagctcagggagacggtggaggggctggatgtcggggtgttaatgaacaacgccggtgtgggggagccggctatggcgtacctacacgaggcggacgtggaggcgtgggtgagaatgatgcgggtgaacctgtgggcagtgacggaggtgacggcggcggtgctgccagggatggtggagcggggcaggggcgctgttgttaacatcggctcggcatcatcgcaggccatccctttccttccccctctgcaccatttactccgccaccaaacggcacgtacatgcaacaaacacacgtaacatgttactacacttttttatagtaaaggttacttactctcactgtctctctctctctctctcttcgtaagtattttaatatttaatttttgtttataaggatttatgtaatgcttgttccatcaatcacctttcttcccgtgttgctcttaaccaccatcacactcccaaccatccgtgacaaatccaaaatgtaaattgacggagtgctaccgtgctagtgtaaaaacatagtagtatgactgaagcagagatatattaattaatatgcgcatatgatcgaaaaaaaaaactttctccattttaatttatggctgtgttaaatatccacaaatatctgttatagtatacctagagtaagttctgtattctgcaagttcaggccctgaaaaaaagaagtagaaacagcgagacagctgcatcggtgccgtccgaacagtttctttactggtggctaattagacttattaatgattaattaggggtagggattatggctgttcgtttgtaccggttagaagtctatccctccagcacagaaaaagaaacagcttattgttgcataattaattaagtgttagctaaaactaacttgaaaaatggattaatatgatatttttaagtaatttttttatatattttttaaaaaatacaccgtttagtagtttgaaaagtgtacgcgtggaaaacgatatagattagttgggaacaagcacaaaagaacagtgatcggccactgccaaccatccaccattcaatgagcgttatcaaagtcattttttcctcaaccttcttcttacaaacctaaaaattgtttatatttgtcgtcttaattacacatggttgtatatatgtgggcatagagatttataagcctttcatataaaatgtatatatgtgtga

SEQ ID NO: 28155 - DNA, 11620 bp, Oryza sativa
  unsure (1)..(11620): unsure at all n locations
gaaattttgcaaccaaaaaaaccaagtgaagaaacacacaacaaatttacgcgatgcatccatccgatcatcttatctgcatgcaggcgccgttcttcgtggcgacgaggatggtggagaacctggcggaggcgaggcgcctctcgccgttcacggtcaccccgggcgcctacgcgcgcgcgcggcggtggggtggatcggccgcggcggcccgctttgcacgccgaacgtccggcaccggctgctgtggtgcgccgccgccgccgcgccggactccgtgctcgactggttcctcctgcgcagccacctggagcagaggacgacgttgtctcagcaaatcagagcgtcgggggcgccggcgccgtcgtgacagcaggaagttcattcttggcgcttcgtcttgcgttcatgaacaataatagtgggcagtagcattgtgatatactgctacatccccgttttatatactataagttgttttaatttttttatctaagttgaacttctttatattatttgatcaaatttatagaaaatataataatatattttcaacacaaagtaaagaaaaactatcaaaatatgttcaatgttagatgtaataaaactaattaatttcgtgctataagtgttgttatatttttctataagtttgattaaaatttcaaataaaaaataaaaaaatcattcgatttataatatatacggaaagattgcgtgcgtatgtccggatgctggtccatagggaaaaaccttgttacatgactattctcgtagtgtaaaaacgtgcatatatacaacataacgatcacacacttgtggactggccgtttgctagattattttggatctcattgaatgaagcgtttggatccgggcctagccttgcctagcaagaccagtcatttggaatcgtaacaaaatcctagctcctcaaggcgagctaccccataggggtgagaaaaggctagctcacgaggaagagccaaataggtacgcctccaacggtaaaatgcacgtaagaaaaaattgttgataaggccgaagcgatttactccaaaacctactaccttcttcaacaactagtcccccaatttcattgttctcttcctccactcttggccaaagaattggcctcgcaaatctctagttctctttgtccacccttggctggactatcgggctcacatatccggtcaattggcaatcatcctcctcttcgccttgtcgaactctcaggtatgctcatcatctccggcgcacatatataaatgcagtagagcccatacgtagtaaatcagagggcttcggcaaggccaactttatttgaggataaaagataagaatcaagttggttgggtatgttgctaggaggagcatatctaatactaattatgcatacacctagtagtattgatcatgttaatcgtattataacctagaagtacagatgttgggtacggaggattcataccaccgtttcaccaaacccgataccatttgcatgaatggataggctataaacccaagacagcaaacgaatgactattcaacttaagacactcttctctccgcactactgttgagagagcgtctgtcttacttaaactcttatactatacttacttaaactcttatactatcactacatgacgtgtcatgttgtgaatatataaactctataactttcaactacttacattaaacggctaagatcattgtttgtaatagttttgtaaaggaaaattagtacgtggagcggtgctcatctcaaattaaaagaagaaaaggaatcccaggcatgaggcatcagtgttcagtcagtcaggcacctcgacggcgagacggcgcggcgcttggcgtggtgatgatggtgtgatcgccggttaattcgtccacccgaatataatgccgccgtagtggagtactggaggaggcacgtccaaacgaacgaaccattattattcctttaaccgctcacgtgcgcgcgcaacccctttgtttccccacgcgtggcgctgatacgtaaccggcctgggcgccactatatatctgacgacgtcatcctccattctccaagcggcgctcgatcgccactcgccttcgatctgcttcggttttccactccaccactcgatcgccaccatggagccggttgtctcggtctcgcgcgtgcggcgccggtcgccgtcgtggttcacggtggacggcggcgtggcggaggagccgctgctcctgctcggggcaccggcggacggcgacgacggcggcgaccaggcgcgggcggcgctcctgcgcgtggaggagctcgagcacctcctcggcgacgtggcgcggaggctgtcgcggctggacgccaagcgcggcaggctcgagggccagatcgccgcggcgtcccgcggccgcaggggtggcggcgctcatcatcgccgtcacgggagcgctggaggaatatcggagtcggagggcgagggctacacgcggaagggcgcgggcgccgtccgcaagattctcagggcggcggccggcgacgtgaagaaggcgcgggagtggctggaggcggtggcggggaggctggaggcggcgctcgtcgacgcccgcgagcgcctcgcgctgcagcagatgctggcagccggagcgtagttccagcaaccgcggctatatattagtacttacttatcgaatgatactgcattagcgtatgtgtaatcccagctctgtgcttcttttaattagttttctgtttcatagactcttcgtcgtgcatgcatattcatcgacattgttgcattgtcactgtgacctctatggctctatgtaattaatgttattggttcctcgttttttaacttgttctgctcccgttccgagagttacttgttgtagtattatgcaatgtcaaattggtatattgtatatgtcaatataggaaggtgtttggttcaagagaaaaccaaggagaaaacaaaggaaaattttctattggaaaatctactgtttatgcgcttggaagaaaggaatatatgtcaatataggatgttttgtgggtataaaaaaattggtcttcgattgtgcgaccggagagcaagctattgtctgtaatggagttacatgcttgaaatggtagccaaaaatctcttgtttctcttcggatggcatagtttcgcttaggcttattgatgaatttaggtaaaattggttctataacatcaaaagttttcatttgttggttttgcaaaaccatagtttcgcttaggcttgttgatgataaaattggttctataacatcaaaagttttcattttggttttacaatacgaaatgtactgagcaatttaatagcaccaaagttgcatcccgatcatgattttagtttctctttctagagaaaggtatttttacccgggctttacatccaacaggatatatacaacctttttaaaattagaaacttagtatttcaaacaggaacttagccctcaaattaataacccaatctgaaattcgctcctacgaagatttgaactaaggatcttagggtgctactcaggtcgctgtaacttagtcctgattttagttttgtggccggtgccgatgaaaaaagtatacttcttactactactattactattctagcgtgtatgacagactagttcctctaaggctggatggattcagtatgttgtttgtctcagtttttgcatgttgggattgtccaacacctatttttattcctactgtactcttggctagatgtgctacaacacagacagacaggagaagtattactcatcttccattgtctaagaaaaaggaacggagggatgcaaaatatagtgggattattcctataaagtacttttgcgcacaaaaacatccgttagaagccagtgttttctcttcttacgctaaagagtgagatgagagagaaaattcctacactatagatcttttggaaaacatgattttgaaaatgtaggaacaagaaaaacattttccacgaatatgatggaagtgaatccatgggatagattttgaaaaaaaaaaactcgtcgttcggtagcactataggaaaaacatatgaagtttgagagacggagagaaaacattataggtcttgtctcttcgtaatttttcttcaagattcatatgaaatgagcaattccataggaatttcaaaagatcgtgtgaaggtattagtccactttacacccttcaactattacatttgtctaaaatacaccatcaaacttcaaaattaaaccgggtatctaatacccctcaattattaaaaccattagacttacccccccccccctcgttccaaaccaggcaattttggtttacgtggcatctgacgtggcagtccagttagcgaaaaaatataaaaaaactataggggcccatctgtcagttgctaaaatatctctctttctcctcttcctctctctctctcaatctcatatttcccctcttgatcccgtttctcgagtgacgacacacaacggcacagaagcgccgagcgccaccgccgctgccagagtcctccctctggaccaccgccaccgagatcctccgcgagactgccgccaccgatcgatgtcctcctgagtcccgaggtacaccacccgatttcgaccagcaacagagaccaacgagaagaggacggatgccgctggattttgtcctgctcctccctgcatcaagtatgagacccgccacccctgagaacctccaccgatccatcgcctctaggtgccgctgctccacccctacactgccgcggtgctacctcacgaatctactcgaggcttggctggcaacgattcctcatccttgagtaaacggcgatggcaggggagtggcttggccctctccgtctcaacctcctccttcgagctcgcggtgaaaggggattttggactttatgccatcttcccaacgcctcattcccaaatgccatcctcctgaacgtcctcgctaatttgccactaggccccataaaattgttgattctatgccattttcttcccattttgatgccacatcagcagcggacgtggaatctcgatggcgaattggccgtcttgcccctggtgtgtgtggacaaaaaaaaaagcgagcagcagccgtctccaaataagccacagcaaacaaataagattctcagcgaagaaataaagcagggattttggatcttgccacgatgggcactcagacagaaccatggcttcaacaaaccctagaccatcagatctaaaaaaaacaagtgaatccggagaaaaaagtgagggaaacagatgccaaactaaaccaaaagaggggaagatggtggatctatcgatctcatgtatgtgattggtgtcacggtttggccgccgtcgccagtcggtggattcatcagctgctactcgcgtttttttagggtggcggaatgagacgacgagaaacgacacgtttttctgttcacgcgtgccaaggggtaccggtgaggtggagtcaaaattagaggataatggcatagaatcaacaattttgtggggcctagtggcatattagcgaggacgttcaggagggtggcatttgggaatgaggcgttggggaagatggcataaagtccaaaatccccagtgaaagtagctcggctaactgcgagcccgccaaggaagtggcgtaggtggcatcaacctagcggtggaggcggtataggcgacgtcaagatggcggtggaggaggcgcaagtgacagcaagctggctgtggaagcatgcgagcgacagcaaagattgcgctggagacccaaggtagcacgtgcaaagtatatagggagggttgaagatggcaaactaggggatagctgacatgtaaaaaaaaatgttgccatgaaaacctcctggttttgataattgaggggtgttcgatacctggttttgaagtttgaggtttgaagggtatttagataaatgtaatagttgagaggtgtaaaatggacttgtacgttttgtgaacctcattattttgttccaagggattctaattttccttctaattgctatgttatcttccaagccttctaaacaaggtcctaggaatgttgtatgggcctaaaaataggcccacggatactaaacatcatgctcccctaaaaagcccaccaaatgagtagtctcccattctgacccttcctcccgtcgccgacgccctaaaccccgcaagaaacaccacacctcgccgccggcgacccaccggagagcgggcaagccagcctcccgcgccgcccaccccatggcgtcccgccggtcgctccatctcctcactgcctcccgcggcatcttctccaccccgcacctcgcctccctcggctggttcgacaagatcaagagcaccttcaccggcaagaagcccgacgaggccaccgacccctccgccaacttcaccctactccgtgagtgagctctccggacgcatatgccctgttctcttctcttctcttctcttggtggcggcgtgggtgatggccctcctgattcggcttcttgtttggttttttggggggagattcttgcagagttcgcggattcgatggagaaggcgaggaagctggggacgttcaagaacttcgtgatggggcggtgcagcgaggccaccgtcgtcaacgccttcgagaagcactccgccgtcctccgctacctcggcaccatcgaccccaccggcgaggtaggcaaggatcgattgcattcgattttttgcgttgcgttgcgtggtggttgtgttgattgtgttgctttgcagaaactcaagaacagcgacaagatcggtgccaccaagcactgcaactgcacgattgcggatgtggagcacatactggccaagtacacatgggctaaggaggctcagaagaagatagtaaagctcaaagaagaagggaagccgttgccgaagaacttcaatgaggtaattcctggtcttgaaagaccaaaggtgttattaatctagttgttcactacacattttagagatgcctgttatgaccgttgaaaggaacataattgggaacagataggaattgggaagaaatataatagattgagaaaatttgatgtatttgtctatttgagaaatataaacctaaaagcataaggtattaaagtcaatatcatggcccacatatgatggtactactgcgctctgtgatttttttcaatggcactaagcaaattggccccctaggatttctgtatgccaaaatatgaatgaggtcagtgcagagatatcattttctctagtgtttaccatgtatctgtgtagaatcctaatttgtgatcaaagtggcaaaagctactttcaattgttgtaaatgattttctgaacaatatttaaggagagagtaaaaaatgtggtatgtgtttcgattaaaagacatgatagaagttagtgattcatattacttcttacatatattagatatcggtattacaggatgctcgattttgaatgttggatttcagcttgtccaaattattgtcatcttgaatgcgacattatgccatataatctttcagtcatattgaatcattttaatcatatcatgcgtgtaggtgaaaaacctaatgggttctacaccactggacgttggcagatctaatctggaaaagagtggacagataagtagaaatgctatgtgcccctgtggttctaagaaacgatataaaaagtaagatgcttctgagcttgattctgttggtaacagtgtttgcattgtggtgctgctattctttgattggctatatttccccggttccttgattggctatatttcctcattgctctgactgcaatagtatcttttacaattataatgaggacaattgttctatttagtatacacatggctcttgctatttggagtatttagcaaaagatagatcaagattaatggatttaaactttccaatatgtgcattgtcctgtaaattttaacctattgccaatcttgaatagaaagatacatgtctcaatcctatatgctacaaaattggaagctaccacaatgtttgtgcatttcatctaaatgggttgttgcactatttatctattaaggaaataaaaactaagaatgtaataactctaatggtgcaaaccagatttagttttatatatttatagtgtatagtgtatttctcgcccatattgttttgacatttcccttttgctgccttgaatttgaaggtgctgtggagcttcttgaagtgaagaccatgttttcctttgtgctgaccacatgaaatattttgattagccatgatcaagaagagcattcctctctttttttttcacttcagcagcaatgcagatcatcctgccacaaacctgacattgaaatatgtaaagcaccataactgaggtttgcatgactgagttttttttttgccaaaattgcattacatctaagccggctttgttgttaaatttgcttgtttatataagaagtcatggaaatatccatcacattctgcgtagaaagcctgaactttgttcaagcaacgcccgtagatcaattttttttttggtttatgggtacattactaagtcgagagatgcactatacatgatgtatcctgaagctggtcattccgtttgtttgggaaagtagcatgtgaatactgatgcaattcaggacccttcattgacattcctaagtcctatagaatatggaaaaattttgaaaatatattttttttcattggtgttacatcaatatacacgtttaaaagaaatttatgaaagtataccgttgttgcaaggcggtgccacgagatcgcaagattcgccatggtctcgcagattgagggcatcagaccgcgcgaccgctcgaccttgcgcggtaagtgcgctagaccgcgatagagaattcaaactagcgcgattaatacattactcattagcaattaattaattaatatcatttctataattagcattattagttataaataattgctaattaggataattagttactaatcattctaaagcggtgtcgctgtttgccccttcgagacttgggtggtggttggatccaggtactcacatacgatgacggtatatttgtgctagaaaaattacatcccggatattctgaaaaaataaatgaacagtatattttcaaatttaatttctatagaatattgcagctctacgatagcagacagaaaagacaatgccccacagaaattttaatcatgcaaaacttttctttgctccaaggtaattttaaacatacaaaacttatcttctctcaaaatatgccagctacagtgtcattcgctccttaggggggagaggatatctagttatctagataggggaatcactgaattggcagttgacccaaccagaaaccgcaaaacatgttctagacttcctagtcctatcttcacttggtaggccgatcccatgtcgtctctgatgtgaggctgttcccgtagtacacctgctttgtagattcatccaggtatgcctgccaacaatggaaaagtcagcacttccattttaacgaacgtaaatgttaaataagcaaggctatcatggcacgatactggagcagagaatacgtgaacttggtcctcaagactttcttttagtgtgtatttgaattgtcatcagaaaatcaagttgcatgctggattttattctagacgtatctctagtcattggaaggacactgggatctgaaggaaggttgttaccacgaatatgctccagaggttggagctcggtgctttacccatgctactaacaagccagtctttgtgcaactgaacttcaactgtaatcacatctctggtgaagagattgatgaggtgaaggatgttctgagtggtaaaaactcgaattagcttgttagattaactagctcctatcttgttctcgaattagcttcaaaatgtttcgcttgccaggttgaattttcttcaatttactccatttaatataagttgagctcaactagtcacaatagaaacagcagtaaaaattgtactaacctgccatccagaaggaagacccttgcagagctctgcaagatcaggttgtcctttatgcagatcggtgacactcactggtgcagaaatagtctcgctatttgcctccttttttgcttccgctctcctgcgtttcacacgatcacgcctgcacaaaatatttgctcaaactgaaaaaccccaaatatatgcaacggaaaaacccacgtactccctcaaaacattggtagttgggttcccaattcccagttagtcaacagttttccattgcatacctaaatctatagcattttgttgtagaaaacttaaaacttgccatattataaactaaacagttcaccaaaaaaaaagcataaaggacatgtaatcttaatttgtacaatggtggcatgattcaaggtctacccacaacttatgtcaaggcaaatcaacaactatttttagacatcccatctaaatagttgaaaagatatcggaatccaaaaagcttttaaagttcgaattgagacatgtccaatcatttctccaataccagagtataagatatataggcatatggccaagttccagaaaccagctggaggtctaattgggcatctccgagatggtttccagctgtttcaacaaaacactccatattgaatccaacaaactccaaaggaaactaactagcccaaagcagaagttcagttttttggcagtcatcaaaccagctatcactggtagcaaccacagaacattgctcaactggcagaggtttggccgcacgaatcagacattacctatacctatttcaagttggaataaaatccttatttgttgtgtttgggtcaagaggtgagttgggttgcactcatccatgtttttggaatgggatgcccccatccatccatccatcccaaacagaggcaaagcatgtgttttgattgaagtgatgggatgggtcgggtcgtgaatccacttgtcagggtgtttggtttggggacaggtgagatgggatgattcctgaaagggaatattccctctagatctaggtcagcttcatacctcgaaaactgctacaccgtccaatagtccaatttctcaaaaaaataggatcattccatcccttgtgccaaacacatggatgggaccatcccatcccataaaaacagggatgggtctaatccatgccacctcatccccaaaccaaaacattaagcatgtgtttggttccagggatggagtgggttgggttgggttgggtcgaacccatttttcaaggtgtttggtttgaggataggtgggataggatgatccctaaaaagaaatattctcctaagatccgggttggattggtccctcaaaaattggcggaccaatccatcccacttttctgtctcattgacatgtgggtcatccccgaaaactaggatcattttccatccctcatgccaaacgaatagatggaatgatcccgtcctataaagaaggatgagtccaacccatgaaccataccacctcatccccaaaccaaacacatnnnnnnnnnnnnnnnnnnnnnnnnnnnnnnnnnnnnnnnnnnnnnnnnnnnnnnnnn

SEQ ID NO: 28156 - DNA, 2077 bp, Oryza sativa
acctgacccatcccatcacttcaaccaattatttgcccctaactgtcacatgacatggatggatccaatgaaacatcaagggcaaataagagatcacatgaagttgacaggggcaaataaggtcatcctttacatcatctatttactaatctaattacattagtttgctatacctccaaaaaatgttcatacataactttttttgtagtcatacacatgcaaccaaagtgaagtaccaaaccctcaaaagcaggcagctaaaacatattaagctagtgtacattacaaagaacaaatgattatcatatgaaaaatacaaacagatatcagatatggtaatactgcaaacacaagataaaacaaaatagccatgacagcagtcagaagtaatatgtggtaggtcttaactagtattctggtaagttaatgaaggtattaaaatcaaactatcatatagtaaggaaacaataccagtcaccaccaaggggaacaaaattggcattttcctgagcttctccgctggctatctgttgcttgcgccactcctgaaacaaatggaaggaacataaatgaattggcaacttcaaagatatttcatgtatgtgatgtcaggcgaaagagaagtttacatcaatatccttttgacgctttctttctaatgcgtccaaagcactttctggctcttcatcctcctcatcacgaagctcctccttagcagctttccactattataagaaaatacacaagcagttgtgttagcaaagtgaaattggtggaggaataagtatatgcacatcaatactcacctcattttatgccttaccatgtaaacagattgatctgcctttaaactaagaaatggtgaaatgagaaaaataaatcaggtagcacatagttaatatgttttcagaatctttttcagcataacctctatttgacagaaggaaataaacaagtttaagctgctctagttctttgttggaagaggcagttgaggacttcacaatctccatacacttcatcaggtatatatacataaacaattagcaattacacatgttgtgaacagatatgatgcttggaaacagttataggaggctcatcgtagagagctaccttatccaccagacttgaaaccttcttattagacctcagtgatgttgcaacagaaacagttcgcttcttgctacgaacaactgcaaaacacagcaaaaggttaaacaatgttttccatgtaggaaccataaacaagatagtatattagtttttttatgaggaataacagaattacctttgctctgacttgtggtacttgtagaagcctgtgcagaacttccctgtatggatgctgatgctgatgttgctcccacaggttggctcaaagatgcaagttttgcctccttggatatgatgttgtcagactccctggaatgcaaactactattcgcaggagcaagattggaagagcttgttgtgttatctaatacactgctagaagtggcagagactgatgccgcgtagtatccagaaggctcagctgcttctccagtggcagccatagtgactgaaggatagctatagtaagaaacaggtactggagcaatagatgtggcatcaacaggaatagatatgccacttgcagatactggtgcatagtaaccattctggtgtgcttgaacgacatgaggctcactcgtttgcatataatagctggcatgtgtaccttctgtacctgcagcagcatagtactccattccaggaactgtatagaccaagtttgcttgatcgacataggactgtggaattgtttcagtagaaacagatgacacagcaggttcttcaggaggaggtggaggagctggttcattctcaggtggtggaggtggaatccattcatcttctggtggtggtggaggaatgtcgctatcctctaggggtgcagctgaaccgtccaacaataacaaagccggtgactgaacttgctctgatggaggatattccttaataggcgtggaattcgagtgcttatgctcttcaacattgtcatcgtcaacctccatatccacatccatatctt

SEQ ID NO: 28157 - DNA, 3641 bp, Oryza sativa
  unsure (1)..(3641): unsure at all n locations
tagctatagtaagaaactaggtactggagcaatagatgtggcatcaacagaaatagatatgccacttgcagatactggtgcatagtaaccattctggtgtgcttgaacgacatgaggctcactcgtttgcatataatagctggcatgtgtaccttctgtacctgcagcagcatagtactccattccaggaactgtatagaccaagtttgcttgatcgacataggactgtggaattgtttcagtagaaacagatgacacagcaggttcttcagaagaaggtgaaggagctggttcattctcaggtggtggaggtggaatccattcatcttctggtggtggtggaggaatgtcgctatcctctaggggtgcagctgaaccgtccaacaataacaaagccggtgactgaacttgctctgatggaggatattccttaataggcgtggaattcgagtgcttatgctcttcaacattgtcatcgtcaacctccatatccacatccatatcttcatcattgtcggattcaatttttgatgggactgttgtggtatcattttcttctgatttctgaatggatgatgttgaaaatggctcctcatttttaacatttccatccatcataacgtcagtgctcacctcagatttcaaaccctcaccattggagggtggcatcatcacttcagcttcattaggtgttttgtgttctgtgtctgctttctctggatgtctaggttcagtggtagagtaactagtttccaatttggaaactgagaattctagttgcttaaggtgtacctcagcatgcaaccacaatggaagcaaagaagatccatacgatgaaagtgcattgcagtctgatattcgtatctcaatttctctttttagcaattcaacattgtaaatggaaccatgcaacctacaacagaagcatgacaaaagtttagttatacagttcaaggtgtggaaaaatgcttgaaagaggaagtaaatggcagaaaaataataacaagcacctttctagcggcttcaatctttgcagcaattcctcgccatatcttgcaagctgcaaaggatcaatgtccatcgattcatgactagtgacagctccagcataagcataagcatcatgagtaggctgtcccattcccaaagtagcataagccactgagccatttagcacagatatatcacttggataagcttccacggcattgtgggtaagggcatgtgcttgggcctccatagagtagtctacatgagtaggagcagatgcagaagtgacactgtcagctgcaatttcagaagctaatacattaggaatctcccaagaggtttctccagtaactgtgttccaatagtaacactggttgctctgctcatgcattatagtcttccaattcccaccaatgtcaccaacaatttgcatcccagatgagtcaggaatagcttcagttgctgttgcagtcccatcttccagagttggctttatggcaacaacattttcttcagcaatatttccagtgcacttcttatcatcagcttcagttaactcttgttggacattagcagaaccagccagatcactttgtgcatcaccttcattcctagtcaagtccccacgttcatgagtaatctgaaacaagcaaagtagtgttaccatgaggccaggtgtgttcaaactcttcaataataaaatcaattctcaagccaaagagatatagttgacaacattgcttcctatagtggctagtgtacaggaaaacaatattgctaagaataggccaagggcctgtttggcatggcttctcctggattcttgcggaaaatagagtttgcaaactgaacaatgtaatttaatcatccaacggtagactcaaatgtgtgaacaaaatgtctcgccctaacagcatttgggcccagctccaactccaagatttgttggagctagagatatcgaactccaagtctccaacaatactagagagtagctgtaccaaacagggcggcttgttggccaagcaagccccccccccccccaacaacacacacacacaacaaaagctagcttattataagccatttcataggctccagcttatttgttgctttatatagtacaaaactagcataagcttaagttcaagagcccataagataaaccaaagctgtagatcgacccaaagaaatggataaagagaagccaaaatgaaaggtagaattaccttatcacctgcatctgcaggattagcctctgtttcatcattgggttgatctgctgcttcctcttcctcttcatcatcactatattgcccaagcaacgctagaggattctcttcttatctggaaataagaatggatcagtaaaattgcaatagcttgcatgtggcaatctgcattgcactttattctgaagtatatatgaagatacacagtattcgagtataatagaagtcaaacaagtggtatatataggttaaaactatgttacatgcagtatatcagcctggcaataatataacaaccaggttaggagatgaattatagagaaagagacatacgaaccgaggaggcaacaatcacattctgatccgcacgcttagaggctgccaaaagagaaattacccataggcatttactcaattttgacagtagcagcccggtttgaagaatttactcaatgttccttgcaggccggaaccctacatgtgcctcaaccatatatgtggagcatatatatgcttgtacaaaaattccaaatttccaccaaatttaggttccacaggcatgtcttctttacaaatcccttggaaggaaactgatgaaacccacctgaagaagatggtgaagtgggaaccccagtttgttggtcatggttttcccctcgctctccctctttcgaaggtgttccccctgcaaaataccgtagcagcagtcagcttttcatcaaaaatatctatcccaaaatatatcagaatgcctctggaggcatgctaatttaatatctcttacatattaggtcgctatactgttactacttacaagcacgtattgctaccctaattacccctttcatcgttaaaaaactaggaagagtatccaagaactacacctctactatataaacgttgatttaatttgtttatcgaccttccttcccttaaccaaacctaaacttttatttgctctgactgctatatgaggtttctgccccctcccatttcacatgttcaaaatttggttagttcaatataaattcacctctgccttcaccaccgaaccttttcattgcccaagctatcgccgcaacccaaccctatttattcttttttaaggcaaaaacatcagaagcaccatttaagttatatttatgtgtttatgtgcagcttttatacatgattttgtgttatctaggttcagtgcagtttcacttgtccccgtccaacgtatttattgtcgttccttggatgttgacacttatcttctcttctcttcctagtgtttaaacatgatgataatccatatttttgtttcagatttggccagttcagaagatgtgctggatatatttatttccaaatgtggcaannnnnnnnnnnnnnnnnnnnnnnnnnnnnnnnnnnnnnnnnnnnnnnnnnnnnnnnnnn

SEQ ID NO: 28158 - DNA, 991 bp, Oryza sativa
cccatccgcacggatcagacagccctcaggttgagttcaggattagcttcgagcagtgggggatggaccgatccacgcaccaaacgataataagtaaccacaagacaaaaaacaatctcgtgctgcccgaatcaatcaagctcgatcgaaaagcgtagcccgcctacaaatctagcactagtcacgaatcaaccgctctcaaccatcagctattccctaaaatcaatcaggcgagcgagagactaatcacgaacgcacgccgcgatcgatcagaaagcgaacgagatcgcccccccccccccccagatttttcgagaggccgtaggacgactcaccgggggagggatcgaggaagaggtcgagcttcaccctgcggccgcccgcggccgccttggccgcaaggcggcgctccttcctcctccccatcgcgcggcgcagcgggcgggcgagcgagttttctctctcctgttttctttttcctcctcccctagggttagggtttcggaggccgtgagatggggaggaggcgaagacgaagaacgaaagggaggggtctcgtgctctctcgtgtttggaaaggagaggaaagcgaagcggggtagggcggcgaggcggtttcgatgtgcgcgaatcgtaaagcatggggtatatatatgggcttcagagtccagaagaactcgcttatcgttgggcctagtagtagggaataagttcacttgacgtccctcgacttcatgtcgagtctgtctaaagtccctaatcgcaataccagaaatttctacccctcaattattacaaactgtgcaaaaaaaaaaaaagtcccaaggcagtattgacccaatttttccaggtttcgctgacatggcatacagtgggcaccacatgtctgtgtcatctcttctcttctctttcttttctttttctttttcttcttctcttttctatcatctttcctttcgtctcctctattctcttcttcagcgagactgag

SEQ ID NO: 28159 - DNA, 601 bp, Oryza sativa
  unsure (1)..(601): unsure at all n locations
agggccccgcgtttgcacgatataaatatgtgtgtacaagtaaatggcgcagcactgtgaagagcgacttggaacggttcctcgccgagttgctaaccaacaaaaactggcggaatgcaaattaaagcatgggagattctataatgcacaggaagtaataatttcgcggcgtgattaggcaccaaggaagctgctgtagatcgttaatgtgacagtgaaattaattagattaaacgtgctgctctccggtgtttggccggaacggcgcatgacgcggaccaccgaaacttggggatgcagtcggcactcgcactggtgcactgtcacacaacacgtgatggaataaacagggccaacaacttacctccctagtacagatctacacattattcctgatgaactatccatgtcggattaatgactacagcagatgacccatcactgatagaatgtcaactttgttggatcctagtctaacacgtctcggataacatttgatgggtcacaaccatgctccgtcatgtataacaagtcatccgtaacgggtgtagtgagatgattnnnnnnnnnnnnnnnnnnnnnnnnnnnnnnnnnnnnnnnn

SEQ ID NO: 28160 - DNA, 247 bp, Oryza sativa
cattaatatgacaactttcctgtctgagcgttcaagaagtgatactatattattttctatttctgagatattcaaattgaattgaagatcaccaattgattcttctgggttattttcatctaaatactcctttgcgacaagcctacactttcttaaaatgtcaccttgtgcaaaattccattttttcaaatgttcattcaacaatgtttctgatgatatttgagatgacaatttgtaatgagatgat

SEQ ID NO: 28161 - DNA, 621 bp, Oryza sativa
ctgaagtcattaaccatcttcagatactgaagaacacaagaacaccgttcaattagtctgatggcaaaacaaatatatttgcccaaactgctagctattattcaaaattgccgagattaatatgcttttatatatactattagaatgcacaaaagtaatttttgtggggaatattagtaagacacaaacaaagataattagcattaattagtataccgtttagtggcggcgtagacggagtagagtgggaaggaagggatggcctccgtggagccggagccgatgttgacgacggcgcccctcccccgcgccaccatccccggcagcaccgccgccgtcacctccgtcaccgcccacaggttcacccgtatcatcctcacccacgcctccgccttcgcctcgtgcaggtacaccgcgcacggccgcgccacgcccgcgttgttcaccaccaccccgacgtccagccccgccaccgcctcccgcagccgccgcaccgcctcgtccccctccgcggtggacgccagggccaggtcgaacaccacgctcctggtctccacgccttcgtcgcccagcttggagatggcctccgagacgtcgcggagcttggccgggtcgcggccg

SEQ ID NO: 28162 - DNA, 7258 bp, Oryza sativa
  unsure (1)..(7258): unsure at all n locations
tggtaaaataaaaaattttgggaatcacatcggatatttgaccggatattagaaggggtttttgacacgaatgaaaaaactaatttcataactcgcctgaaaaccgagagacgaatcttttgaacctaattaatccgtcattagcacatgtgggttactgtagcacttatggctaatcatggactaattatgctcaaaagattcatctcgcgatttacatgcaaactggcaattagtttttctttttatctaatatttaatgctccatacgtacgtttaaagattcgatgtgatgtttttggagctaaacatgcccttaaggaaaagtagaggaattctaaaggatttggatccattgaaaaatttccctacatggtttttagggaatataggaattgcttctccaaaatccaaatttttttagggaatataggaattgcttctctaaaattctttgaaattcctatgaaattgctcactttgaaggaattttagaaaaaaaaactaacataaggcttgaccacatgttttctcatccttatgactcaaagttcctttacttttcttatggtattatctagggctgggcacttagcacttagtttatatggttttctcggttcggtttcttaagtttgctgaaagttcggttttcaagaaatacgaaccgaatttgctaagaaaaaaaaggaactaaaaccgagcaaaacaaatcgaactacttcggtttggccttttcggtttacccaaggggcatttaaattttttccacttttaaatgtggcaattaggcatttgccacttgctgtctataacatgtgggtcctcatgtgttaatgacatatgattccagtgataaatctttaattaccatttataagagtgtctaataggtaattattcctaaattggggattgaattgattaatcctacatgaagatacagatgcgttcagtttttatgggcttatcggtttctagcaacatcaaaccgacaagggtgtgtttagttcacaccaaacttttccccaactcccaatttttcatcacattcaaaactttcctacacacataaactcctaacttttttccaaactaccaactttcctcaaatttctctccaatttcagaaactaaacacagccaagtttggaaaaaggaaaacgaaagaccgagaaaacccgactgttcgggttggatcggtgctcggttttcgagaagtaattgtacccacctctagtacttcctccatttcaaattgtaagtcattctatcatttcccacttaatgaatctagatagatatatatatctagatttattaacattaatatgaatatggaaaatgctaaaatgacttacattgtaaaacgaaaggagtattatcaaacaataattattcaaaatcctattaaatatatttcatgtaggatttattgacatgatatcctattcgtatgatttttctcgtgtgcttttaaatcatacgttttaaagtagccctaaatttgatcgaccggttatttctagtcatccccattttgagaagcgaacagatgaaagcgttcgtcaaaccaccagcaatacatgaaaaaattgttttctaaaaacttaaacaagagtacaatatatacctgacattgcacgtcgattcctttgctcttgtattccacgtaaaggctcctcgagaactcagcaacgtacctgcagcgtaagtgaaagtacaagaagaaaaaaaaaattaaaaccagctagcatatggaattgtggatacagaacattgaatccaattagagcagtatactggacactccaattatatcgagtagtactagctagtactatatttaatacatcattattaagcgagtgtactccatatatcaggatatgatgcattgctcgtcaaatgatttaaatccaacattaattagtctgatggcattgggcagatactgaagtcattaaccatcttcagatactgaagaacacaagaacaccgttcaattagtctgatggcaaaacaaatatatttgcccaaactgctagctattattcaaaattgccgagattaatatgcttttatatatactattagaatgcacaaaagtaatttttgtggggaatattagtaagacacaaacaaagataattagcattaattagtataccgtttagtggcggcgtagacggagtagagtgggaaggaagggatggcctccgtggagccggagccgatgttgacgacggcgccccttccccgcgccaccatccccggcagcaccgccgccgtcaccttcgtcaccgccacaggttcacccgtattattctacccacgcctccgccttcgnctcgtgcaggtacaccgngcacggtcgcgccacgcccgcgttgttaccaccaccccgacgttcagccccgtcaccgtcttccgcagccgtcgcaccgncttcgtcccctccgcggtggacgccagggccaggtcaaacaccacgctcctggtctccacgctttcgtcgcccagcttggagatgacctacgagacgtcgcggagcttgacggagtcgcgcccgacgagaacaaggttgagggccccgcgggcgagctcaagctccacggagcgcccgatgccggacgttggccccgtgatgacggcccaggcactgtatcgtcgacgtaggtcgcgcggtcggcgcagtcagagtcagaggtggtaggcaagtcgcaagtctgagtgccgcgccgtgaatggcgctgccgatgaccaacgcgacgaaggcccacgccggctgctgctgccggaggacggcgtcggcgccggcgacggcggcgctgccacccatcctcactctcgccgcggattgaattgagtagccgcctggatgttggatctgcctaagctggagtagttagcaacggcaatataaaggcaaagctggatatgctggagcgaacgagcgagattaatcagtacagtacgctacattatccagtgaatagtgaattagcacggtggtttttactgtttctatactgcggctacaatgaaaaactgcaaaaacactgttcttcactgtagcaccagactcattttgggtgtgtctagttcgcgttaaaattgaaaatttgattgaaattggaacaatgtgacaaaaaaaaattgaaagtttgtgtgtagaaaaattttaatgtgatggaaaagttggaagtttgaaaaaaagtttggaactaaacaagggctttactgtaattccctgccgttcgcttgcaaagttagaggagccggatccctttccaataattgggttagcgaatggtgacggctgagtttgtttaaggccctctttagttcccaaaagaaaaacttttcacccgtcacattaaatgtttgacatatgtatagagtactaatgtggaaaaaacaattatatagtttgcgtgtaaatcgtgagtcgaatcttttaagcctaattgcgtcatgattttataatgtggtgtaacagtaaatatttgctaatgacagattaattagccttaataaattcgtctcgcagtttcctgacggaatccgtaatttgttttattattacactacgtttaatacttcaaatgtatgtctgtatatccgatgtgacaatcaaactcaaaacttttccccaactaaacaaggcctaagtttgtaagataaaaatgatcatgctctattaatacatagtacaagacaaagatagtgtcctctttattaaaaaaacaaagagaaaaggaaaattttggtttttttagctgtttcggcatcaaactctatttttttaaaaaaatatgtatatatccaactgcaactatgtggatttatgtttgcctcttatccctctcttgctaataagtaatcttccgcacgaaaaacggagcggtccgttagtgcgtgattaattaagtattagttattttttaaaaaaaataggaaaatacgatttttttaagcaactttcgtatagaaatttttttaaaaagcgcactgtttagcagtttgaaaagtgtgcgcgcggaacatgagggagaggggttggaacactaagcaaataacacagcctaatttttttaacaccgagcaaataacacatctccacgcctcatatccacgctggattcaaagtttgtttgttagattatattggtttaattttttttatctcatccaaaatagggtcaaaatggttctccaaatgttattaatataatcgaggatccaaattcatagatccaagaagctacaaatatccagtttcaagtaatcttggatctaaatttgtgactaacagaaccttaaataatttcagctagattcgtggggtaaaaaaaattaaagaaaaaagtatgaatcatcccccacctccctgaataattacgacagtacaaattaccctcgaaccacaaaaacagacatttgataccctaaactattgaaactggacaaattacccccttgactcaatccggagtggttttgctcctacatggcatacacgtggcaccaaggtggcaatccaatcataaaaaataataaaaaactatgggcccacttgtcatgtactcctacctcacccccccccctctctctctcttttctctctctgccatagaggagcatggcgggcgcgcggggaaggcgggcggcgactgcgaacgtgaagcacgggtgtcggtgacggcatccgtggcggcgacacgcgagatggagctgcgcaggaggcggacgacaacgaggagggtcgtcaccgctgctcctcccttgcccctctccttctctttcgactccctcccatttcctgcagtgcgtcggtggtggttgtccgggtggagaaggcggtggcggcccaggcggagaaggcggcgatgtcaacagtggtccggaaagagaaggttgcggcagggaagggtgggcggcaggtgtgcgtgcaagcgatcgccgcctccgctgctgaccactcggtccgcctcctccccgcgcctccgccacggccgccgacgtgcacacgaccgccccttctgccactccccgcctggcctgccacagccccatcccatgcactccaccacgctgtgcgtgccaccatgagcgctagcgtctgcgccgaccgtctgcccccgtgccgccgctgcacgcaagagagagaggaagaggggaagagtagtgtgaccagtgtatcctaaatttttttaataaataaaatgctgactggattgccacgcgtatttcacgtagaataaaaccgctctagattagatcgggggggtaattcgtccggtattaaaagttaagggtgagcaatgtatggtttttgggttaagggggtaattcggtcgaccgcgatagttcagggggtaattcgtactttttttcaaaaataaaaaggcaataactatcatacctcatagcccctttgaaataaagaatttctggaggaacattggatcctattgaaaattttacgattttgcgttttaaataaaacgttagacaattggaaagactctatgtcgaaattattaagaaaaaggtgagcatatccagggtcaaacacgggttgcgtggagcacaacggctgcacctcgccatctccatggttcttcgccggtcactatggatttgttacttcaccctatgtttttcatttagttaaaaatattattagttgcaaaacatacgcgaaaaaattaggacgtacgctgctgcggtaatcagttggcctaaaacactatttttcagggaatcattagcctaaatactctattttcattgctttctagatccacaattaaaaaaagcaaagcccataagcccaatcagccactccctcccactccacacagctcacaaaccaagcagctcactcaccaggtagtctttcatctcctctacattatattttctttaaatctgttatccgctttccatggaccactgagattttgtttgaactggaatgtgaaatcaatgagattgaagtcatgtttgctaattgataaccaaaatataaaacaaataaattcaaaagttttaatcaatgtccaaacaattattcaataattggttggtcatatttaccgagcaagccattttgttgaaaaatgagcaacaataatgtaatcgcatgtttttatgctatgaaaatatctcatgagatattcttgctatctatttcactcgaattatttagagtattctttagaaatttagacctgctatgtatttatgtggatgtaggctgctagaatcagcctgcaaattctcgtaggcacactcaatatggaatttcttgtccgccactggcaagcggcgcagacaataggaatgtaaaccattttcattatcttaaatattcataaaacaagcaattgataattgtcaaaattgtgaatttatttatgctatagaattagttagttttgccaataattggctctatgctttttgcttaagttttcgttatatgaaattattatataagatcgacttctaatttctaacatgtgtattggcatgtgcccatgagcccatcgctatagactgcacacaattcacatttgttcgtgcgtgcactgaacctgccttgggaaggatgtagaggcaaaagaaaggctcatgtacctattttttaaaataatattattttaatgaaaatcacagaaatgatggctggccggaattttttcgccaaaatagaaccctgccgaatagcagttcgacatgatcctattgaacagcggaggagggatgggaggaagctttcgacaggccctgtcaatcagcagcagtttgacaaggtccacatctggtagtgtgcaagacctgtcgaattgtggttgctcgacaggcccaacaatcaaccctatcgaactggcatcttgacagggccctttatatgttccactcattttcattgaggccatgtaaacataaacatgcaatcgatatagtgactatctcacattatgtacaaatgtcatatggcaatgaacattatctattatctctgttctaaaatataagggatttcagtgatacaaatgcatagtaaacatctcttttatattttgagacagaggtagtaagacaatatttcttaactcccgtgactaacactttccgctctaccctttacttctctccgcacagtgacggattgatgtgaccgtgacaactgtgatcaaaattaacattttcctcttaaaaaagcaaaatatatactacatccgcc

SEQ ID NO: 28163 - DNA, 12677 bp, Oryza sativa
cagtgacccacgtccctctgactttacgtcagaggagcgcgatccgatgacacctgcggcttcgaaagatggctcgctgctgcaagtggagccgcaggcggtaccagttcaacacgaaatccggggtggatctcatccccaggagctgcactcggtgcgccatgttgggcacgcacatccgcccgtggccgatcgaccgcaccgccgcacgggcgtactcctccggggtcaccacgaactgcgacagaaagatatccttcatggctctcgatatcatgttcgtctccaccaggcatggcacctgcaggagataggggaagaaaagtcataatagtattgttcattgggtctagcttagttaatttagtttcattgatctttaggttgtatcactttatataggcactttttttcaggtagccacagctggttagattgcgtaaaattaaacaagatctaggatgactattgatatgtgacatgcgagaaaaaaatattcactcgagaaatgaaaatccatgtcctaatgctaacctggcattgcacatcgattccctttctcttgtactccacggagaggcctcttgagaactcaccaacatatctgattcaacaagaattgaaccaaacaatcctttagtatcaattaacaagaaaagaacgcgaatatgcatgtgtgggtacgtacgctttggtgccggcgtagacggagtagagcgggaaggaggggagagcctccgctgacgccgagccgatgttgacgacagcacccctgcccctcatcaccatccccggcagcaccgccgccgtcaccttcgttagggctagcatgttcacccgtatcatcctcattaatggctccacctccacctcatgcaggaacatcgcgccgggctttgccacgccggcattgttcaccaccaccccaacgtccagcccctccaccgtctcccttagcgccgccatcgccttctcacctgcgcaccggatatggagaagacgatggatctcatgaaccatgagtctatgacacaccatgaacgcaaccacaaatattaacttatgttatactttgaaacaagggtggagctaaaacgaaatggagagaggtgccactcgcttgctttactctactttagaccaaattttgactgatacgagtgtctgagtttggattgagggtacacatatgataaaaatagatgaactatagctaaaaaaaatttcttgaccgggttactgagcaacctggccccccacctctcctacctagctatatctgcccctacttcgaaacaaatttttcaaaatttcgccccctactggcaagtacatatccgaaattttcggtgtttttcaaattattgtaaatttggtcaaattttatttaaattcattaaaaatttgttaaattttcaaataattttggacaaaaaatgtacagagatttctgaaattttgctggaaaaacacaagtgtgtaccccatcaaccttgcacggtggagacgagggagaagtcaaagaccacggtcttggtgcgcacgccgtggtggaagtggacccgggcgatggcgccggcgacgtcgcggagcttggcggggtcacggccgacgaggacgacgttgaggccgcgccccgcgagctccagcgccatggcacggccgatgcctgacgtcggcccggtgacgacggcccacgagccgtaccggcggcggaggtcccccctgggacgggcgcgcaggccgaacgtgagggtggcgacgagtcggaggacgtcggcggcgacatggacggcgccgagggaggccagcaggatgagccatatcggcatggccataatgttggagagcaattaaccagctcgctcttaattgtttcctttatttagcttattaatcgtagttgttttctgcgagtgcagtcaagccaaaacttccatctgtatatgtgtacaatgatgcgcttatgagttgtgataatcatgcattgttagtgcatcagcaactgtctaagttttaacaaccaaccaattgtacagtatatgggagtgagtgacagttgcagcagatgtcactgtatatctgttgttgatgcttcaacaccaggcgttcacatttttttaataaatccgttccttaagtaaatatctacttcaaaattccatatacactttattgacatgaaagattaagtaaatatctaccagcatgccgtattgtttggaatttaaattaatacatataagatattttagagaaaaaagttgggacctcaacatcaggggttatatgtcaagtcaaaatatctggtgtttctgtagcttcaaccataacatctatttttctgaaaaaaaactcttttaattaaatttgacagaactaccgtattttcaaagaattgtcacataagcatagatttgagtgccaatacaccaaaactacaggttttcactgaatccacaacattgaagatatatgctttgtttttcatctctaaaatatgttgttttaaagataaatttgcgactaaacatgtagttttgcaatattatagcttatttatatatgtaggtttgtgatatatttgatgctaaatattgtagtaaatcaaaaggaactgaataacgtagattgtagtatcatctatcaccacacaaaacttgtaatgaatgaaggcgcatacctctttgagagcttaacactttccatttagttcttgttgtcctttcaaatctagatgtggcatgatgctatatatgaccgtatgtttcatatgctaaagttctcatttagattggaatttatggtgtgtatgagagtatggaaaatataaggaaaatgatattagccattaattaatgattaattgagtattaattattttaatacttaaaaagattaatataattttttaaagcaactttcatacatattttttttaaaaaaaataccgtttagtagttcggtgatgtgcgcgtgaaaaaagagactttctcttaatccactactatcgaacacaaccggaagggttttgtgcttgcacaatttgtaaaacgctttaataaatttatgtatcaagaacaatctcaaaaaaaatatcatagctaaagaaaatggaaaagttttcttttttttcttacaaaagatcactcaaggtattaaccttgtactatacaaacatgctccatttttcacagaaaaatcaagaaatatatatatatatatatatatatatatatatatatatatattattaacaaaaatatatatatatatatatatattattaacaaaaatacaatggatcaatttcatttaaaaaatattaaatttttggcaagattattttttctaggaaaaaaatccatctttctcaactttaatttttttattgaagctcaaaaggccgaaaatacatttttagcccatgaactttactcggagtctgtttttcactctatgattagaaagttgttatttttcaccttaagctttcaaaaccaaacagaaacaacctacgacatatttttaatagtaaatttcacttcgggccaccttttattaccgatgttacattttggaccaccctttaagcaatattttcactttggactgggtaaacctgcctttgttttactttggaccacccgactctcttctcaagcatatgaacgatctcgattacatcgtctcctactcgtcaatgaactgccacagctatatgtaagactatttcttcgacatattacaagttggatgtagatggataaaagagcaagggtggtccaaagtgaaataaaggaaaaaatacccagtccaaagtgaaaacattagtcctaaggtggtccaaagcgaaacatcggtaataaaaggtggtccaaagcaaaacatcggtaattgttttgtttaaaacagaggtgttttcctggttgatactcttattgtgtgttttctgttgatgcagatgtcacattaattaggtccataaccataaaccatatgtttttgaagttcatgttggtgaaatacattggcatagcaatcaaaatcaccatgaaatgagttacaggatcttgcatatgtccggtcctaaaaagttccagatgaaaaatgacccctttttttttttgcttcatggtgaaaaatggacttcaagcaaagtataagggccaaaaatatacacatatttttaaaaagtgacccgtgttatttgtatttctttgtttttattttttttctggattttctaaatttgatggcagtagaaaaagtggcccgcgaacgtccgcgtactagactagacgcccccgtttctcgagagatgagaggagatttgagattcaaggagtgaagcatagggggtgggttcatacttaaactttaatgattcacgataaagataattttggaaggtttattatttgtgacgtaggacttctttcaaaaatgaattgcaatttagaccagattttattgccctagcagtatattggaccaacacttatatttttcacttttatgtaggatttgttaccaaaactagcaatctgtctaaagtgatgggattttttttctcgaaaacacaatacagttacgcttcatttcattaagaagaagagacaatgtacagctgagtcatcaaagggcccctctagaatcaccaaaacaaaagaacatcacacaacatgacacggagtgacttaagctctagcaatacaccaaacagaaccctttctagccacagcatgcaaaatagcagaaatgcttggggaggcactgttgaaatcattacggtgcttccataatgcacatgccactaggataaccaatttagtccaaagcgtaagaaaacatagtccaaaatgaaaagtcgtgctaatgcatgaccgaatatgcaccttgataaaaaaaaaaacgcttcaagttacattccctcgtcacttaaagaatcgctgaaggtaagtaatttttttacacatatagagaagggaagggatgagcaaaacttaagacaagcttatgtttttcattactctgtatatagaagacacacaaacggacaccactacacaccagcaaacctgcgggtgtgcttcatgctctcttaatacacataccccactaaagagacgaaaattagtagaaaaaagaagaggtctgaagtgctaaagatactactccctctgtttagtgtaaatatgtaaaaatgtaagtcatgctcaaaacacctttaatacttgcaaagttttttaataagatgaatgattaacgtttatctaaaggtagacgacataattattaaaatggaggtagtagttggagagtttacactaaggtgctagcagaagagcggtttcattttcaccaacgtattaagaaaaaaaacatcatacacaaggaaaggacagctttatttccacaatatgaccttcagatacataagtacgacaaaccttttcaccccgtattgatcttagtctaaacagcaacaagcatgagtaggaggggtgtcacaatctctctatcgttgatcagtgctacatacaaaaatattgcaagaaaaatgaaggatatatgatcaagtagttgtcatcctactcaggttaccggccaaaacagctcgttactgatgacaagagactcgaggagataaatttcaatccactggaacccccaggaaagtaggatatggtgtagtaagcaagagatagaacctgtaacagaaggagatgaaggttactcacgaagatatggcctatatgcttcatggcattgtttatgtgaagggatgaggtaggagggatgggcatcatactatcaaagaactatagatcaccccatccaactcaaacatttaaagtattgaagaaatggagaaaatattatccatttaaagcatgatttccactagtagcctgttcttagagacacagaagtatgcttactatcccctagactagaataactataaaatttaaagataaagacaagtcaaaaagatttattcagaggaaggacgcacctgaaggacagagaatatcactgagaggaaatagctgtgaagaaacattgacacataaatggtaccaaccatgcatccaataagtgcccctgtaaatggtagcctctgaagagaacaggcagattattttattaaatcaactatacgattaattttaaaaacacaggagcacaaagatatcaccctgcaaactatttaacaagtttgagccaggagaagcagccattcaaaaatattaaaacaataagataaatagttcttgaatcgtcataagatttctattttatccacaattttgcattgatgacccttgcataatgtttacaggcctacatgcgagatttggagtttttcatctagatgaggatatgtaaatttgtagtacaggtaaaaaaaaacaatacctacaacaactctccttgatgacttggagatataagaattatatacttcattgcatatatggcatgttcgaagcatctatcaagaaaaagaaatgttcttatgggctttgcagttgtgtgaatgtgctaaacaatctaatcagggaattgcacttaagtcaaactgtacgcatctgtctcaattgtttgcaagccaaaagatggtgagaaaccagttatatttgataacaaactgcagagcacaatatcctgattaacattgctgccgctaccacccctaacctgagcacctgatccacacagcttatgcaagaggcagcagaagtagcaccctgtgactatgaggctatgagccaaggcctccgactaaagggagagggggaaaagtgagtggactgacaaagggcgcattagtcatgaggtagctgcaaattcatggtggagtggaggaagaacctgactatgtcaaaaaaatgtagcaaccacagcaatactaactggccatggacaggaaaaagaactgttgaattattcataaaagtttttcccgttttgttggggatgcagaataaggtgctgcctctagcacttccatccactgtattctggctaagtggctaacgttttagtagaactggtataagcaaaaaccttacatttaactcattgaaatcagaaaccttttagggaaaaagacttctagttctatccagcttattaagatgcatggaagtttagaaatcattttaaatttgagccaaaatatattccttcacaggttccatatcaagttttccttttagattgagccaatatattgtctcattcatatgaagtaaaaaggatgacaacatgtcttcttcagttgcacctgattggaaaagccaaacgaacagaagaggctaagcagaagcagccaagttaacatcatattcttgcatgttgttcagctcaagtgccaatgaggcagtgagcactcactcgaaagatcaaggatcactctctgccatgacaatgttctcaactaatactgttcacatttcttttggacgtgctcaaattagtagcgtacaccatacagattcttcattttgctagatgttttcttcccttttttccttcttttgggtcttagggtactcggattcttgcattaaagacttgtgatagttagaaaatctaggcttgaatgcttgatgctacatggatattggagtatttttaaatggcttctaaagaaaatttctgtgttgcttgctgagtatagttcaggagacaaaagaataaaacatctggaggtgcaggtgccaaaaggtcaatgagttagaaacgttgttgaggtcaatgagtaaacattcaagaggtgaaccaagaaccagaagaagagctaaaggtccatttctatgctttctaatctgtgatttttttctgcattcataggctagagtactcatgcaacccatatggagaacaggagaataaaaagggaatttataaccgctacctccacacgaaaattccatccaagtacaaaatccaaaagaagtgcaccccatgatggaaggaatacagacttaaagcatgtaggtcccttgatgataaggaaaaaatagcttcgtttttggggtcctattctgaggagtaaatgatggtctgatgattaccgagggattaaaaagaacctcatgaaagggacgtttcgtaggtgcctcttgttccataaagaaaagctagtatgcacaatatattttttcctttcataagtttacaaggtcctattttggaaaggatcatagacaaatcaattcatatatggaatctggattacaaccatccaagaggaactaagaaaaaagagcagcagtattgtctttttctagtcaattcatccaggttttgccttctgtctctttttttttcaagttgcactgttttaactcgtaagtacatttggccgttagaatccatactgttctgtctaaacattgctttagttcctacacttcatcgtatacatggaattaattacggacaaccccatccaaacaaacctacagtgtttctctaatctagcagagaaaatttaaaacaccatacaggtagtaagttatgcacagagtagttgtttgtgctaaaagaactctttagatgcatggaagatagatgatctacagctgggctgaggtgcgggtggtggtggggtttttcttctctttttctatggctggtggcaagaatatttatattactgtttagtatttacctccaatgttgtttgataataatgcgaatgacaacctttggctatatacacagaacactcattgtgcttgagagttaacagcaaaatttgtgagcaaatattgcagctccaaaacgttaaggccctctttgtttaggcttataagccagcttatgagccaaaaaagtctaagcataaacaaataggcagtttttcatttggctttttgaaaaccataagccactctacactattaagccaaaagctgagttgagaagctttttttggcttttgtgaggtagaggtatgactccaacattaaacttacgactttctatccattggcttataaatcatataagttaaaaagctgagttaaaagcctaagcctaaacaaagaggccctaagccaattcgaccaaatttgcggtgtcaaattgggtgttggattgtctctactcccaaaattgagatatagcactacagaacaatttaacaatcaccaaaacaatttacagcgagaagaataataataatagcagctgtacctccatggaggtcatgtgggcgaactggctggcgggtcctttgagcgcgaagatggatgcgatgatgagcccgcagccgagcgtgaagcagatggcgaacttctgcggcatgatcaccatgacggggaggaagagcgcgaacgcgatgaagacgaagaagatgccggtggcgaggaagagtccgaagtacatgagcgccttccccgacgggaagctgctcgtcgcgctctggaagctccccggcagctcccgcacgcccttggtcaccctgcatcggagaggggcgatcgcttgagatctcgatcagatctggcggcgcgaggaggaggagaggaaaggagaggggtgggtggggttacacgctgaaggtgccggagacggtgtcgttggcggagcggacggcggcctcgatgtcgaaagggagaggggaggaggaggaggcgtcggggcgggaggcggcgtaggagttccagtcggcgaggagggacggctgcgactcgccggcggaggcggcgggggcggcggggccgccggtgaaccaggcctgcgccgtcttgtgcatcgcgatccgcgaggaggtgcgcgccggcggcgaggcggggaggaggcgcgcggcggggcgacgcggaggcggaggtggtgggagttaggagtagttagtacaagaacaagaagaagatgaaaacgaatggactcgtcggtggttttcttttcttaacgaagaggtttctcctactcttcgttttccttcgagtctaatctttcatcgatttttttatagtaatgttaatgcaaattataaaaattgtaacggtctattaattatgaaaataaaacaaacaatctctaaaaagaaaaaaatatacgcagagaaattccaaacaatatttatgagtaaattgaatggttaagcattatggtagtaagtattttgtactacctccgtcccaaaataattgtatttctatgattcaaactttgtcccaaaataattgtaattctagagtactaattgccccatcaatcatctcatttaaatttatctctattataccctcaaccatctttccactctcacataaacactatttaatgaggggcaccatagtctttcttctcaaaccttaatatatgctaaacaacatataattatagttatcttgggacagaggtagtataaaagttttagcccgtgtaacggtgctaggtattgtactcctctaaacaatttaaacaactcattattgatgaactatttagaagcttcttaataagcttgttataccatttatatatataattaggaagaaagcccgcacacatgtgcgggcaatttatttactgtttataaaaagaatactaaaagaagccctatctcaccatattcattataagaccaacttttgagtttggatgtggacacccatttctgggtttgaatatagaagaagtgggtttgtttttgggacggagggagtagaccatagatgttaacagttgacatactaaatgatattgtcttaaaatatggatgtcattttaatagatagaattacatctatacctaaaaataaacccaatgtgtcattaataaaaaaaagttcatctctacttcataccatgtctcacatgtatccaaatctatatataaatatttaaaaatactgcttctaccaattaataagaaaaaaatcatatatgaatacccctctaaaagctgggtgaagccgattgtagccgctaaggctttttccttcgatgccttgactcatggtcccgcattgatatagtcgtgctcctcaagaaaagtgtggagtataattttgtaaaggattgtattcgtaaataggtcagttgagctctattgtcaacaataaccttttactcggaccacctcaactcaacaatgcgtactcctgccatagttatttcaacatagccggttgagatccacgcttgttgcccttttgggtatgagtgaaagaaaatggaggtgatgaaaatagtttttctaatatcttgagtcgatttattgtatagagtagatataatataatttgtttatggtgttaattgatagtacaaatataattttctctttaaaagttagcagagttgataattcgattctacttcaaaaaaaaactaatagattctgtggtgaggaccacgtaaaaaatattaacataattgtgatcctttgctaacatacgagttaatttgggtttagatttttttttcttgtttatacatttattcacctatgctttgttcacggtgattaatatttgatggaatttatcaaaactatttgtgctaattgttaacacaatttggatgagaacgacgttgagaaaggggatataatgtagttaagtgtatgttttttttcgaatagtagtctctcgtatagattttgttttttctttttcttttaatgaatatttgtctatcatagggatagggtgtacatatgtgtactcatgcatttatatgagcttatgaaattgccttttacatcggtcagcaacgggttgcgtgaggcggtgccatggcgtggcttcttttacttcctcgctaggagtggttgctacgtatatgctcaatttgggaaaaaccttatagcaagaaaaagaaaagtaccaaatgggacagatcatatacacactctgtttttttctttttatatacgctgcatacgtatgtacataggagttgtgtatgtatgtatggacggattagacggcctttaggatagaggaactactgtcatatatctaatttaatggttgaaaataatggatcgccaattttgagtgcaaatcgatttatagatgttttgctttttatatttttttcttagattctcgctaattagagggtcgcgtgacatcttataagcatttataggagtgtagtgatatcttataagtgtttatataggagtgtaggaatgctattactcatagccgcaatctacttgtagtcaactattgtttgcggtggattggttgcatactctacttaactatcatttgttgaccgttatgcacttagtattgcgctttatctttgtgcttgatgacacacgtgctcattagacggattcctcataactaatatgaaatatgacttggcaattagtggatagtggcttgtatataaaacttacaaacatgggatcagggaggacatacaattgatattttaggctattattgaccaattatattgtaaactacataatatgtgttttattacttaagtaataaatttaagagtgtgttctaaagtgtttataggattagatactccctaacttgtagcgaacacatttctcgaacggctaaatggtgcattgcatggtgcatgttattcaaatactttctatatataagtttcttttaaaaaaatttcatttttttaatatttaatactcaattaatcttgtggtaataatc

SEQ ID NO: 28164 - DNA, 1466 bp, Oryza sativa
  unsure (1)..(1466): unsure at all n locations
gaacggctaaatggtgcattgcatggtgcatgttattcaaatactttctatatataagtttcttttaaaaaaatttcatttttttaatatttaatactcaattaatcttgtggtaataatctatatcatttcgtgtgcatggataagctcacttaatgagctagatcgaacgaagcctaagtaggacattaaaaacatggacatgatatcaaaataatatagttgacctttaatttctaataatatataaataaataaaacttatactatatgaaaatacgttcatgataaattttgtaatattattttgatgtaacattattttttttatagtagggagtgagtaattttaggaattaatgttactcacaactggagtttttttttttgaaaatacaaatctaattcaacaaaacatgttattaagtgatatacaattatataactatataatgtatattattcatttatttagattatggatatttcgatgacatgagtatagtacaatacaactgaaaaaaacttatatttgtacaactataagctggaactattaattggtttttatctcatgtgagtgaaaaaaggaaaaaagaggatggacgtggggcactttgtgagaagtacatactcctatgcactcctaagaactatatgggctggaaattatgtattttgttttttatgttaattagtgagaaagaaaaaaaaagaaaatgaggggcatggggcccacgtacaaaatatgtacgtgcatgcacgtacgcgtatcgatgtacgggagctgctatggctttttgaagatatatatagttggtttcttcagctacatctaacggttaaaaataatggatccaccagattaaatgaaaatcaatggttggatgttttgtcttttttttcttataatttctctaaatttctctaatttataagagcgacacatggcggtgtaggagtgtttgtagggtgccacatggcggtttgggagcgtttataggaagtttaatttacttttagtagtatataatagatagatagatgtgttgtggggttaatatttggtcttgctagtgtagataacatctttatcaaaatcaagataggaaggtatatctaattaaaaatctcattaatgaaaaaggacagctcatatttgtatcttatttttttaaggacaaagctttaacctggtatgacctaagaagaaaatgggatgccatccatgtcgtaatggtcatccatgcatcttttcccctgactctaattctaagttatacccatagatattattatatatcggatgttttttatctagggatattactatatgcccgacatccgactaaaacgtatagatggttaaaatatttcaatannnnnnnnnnnnnnnnnnnnnnnnnnnnnnnnnnnnnnnnnnnnnnnnnnnnnnnnnnnnnnnnnnnnggtaccgagctcgaatt

SEQ ID NO: 28165 - DNA, 686 bp, Oryza sativa
  unsure (1)..(686): unsure at all n locations
tcgtatttaaatcctcccaaaaccttaatttgttccgaatgagtccttagttaaaacttgacgcccagccagctgcaaggcctcctgcttgagccaccccaaacaccacggtccacgggcttggtctgtacgacttactgtacgctgtcatcgcgaggtcaccacggatcgtgccggaagctgaagattttccggagattaatggacagcgtcgagctgaatgtaattaagagcatcatcaacggaatgtgtataatctatcccaaaattatatcattgggttttctaaattgaaaatagaaagagaaaaacttctttctataagtgaaagcctaaatttaatccttaaaaactaaaaatggaccctcttattgaacaaccaaccaaatatttgtttttccactgacccgtgtaaaaaaaatatcgcttctccaagtgcgcgatcttctctccccgtgtacaaagagaaaaacctcacggaaaatagggatttgggtcgctctccctcaaatgaagagcgaagaatatggagatggagttttcaaaaaagaaaaatagtatcaagataggattttttttcaccaaaattctaaaaaattaggatcgatgatactccctcggtcccattttgnnnnnnnnnnnnnnnnnnnnnnnnnnnnnnnnnnnnnnnnnnnnnnnnnnnnnnn

SEQ ID NO: 28166 - DNA, 558 bp, Oryza sativa
actaaagatattttggaaagggactcaaatactaaatattttcatttggtagcaaatggtaagcataggaaaacaaggatttataagctacaggattgtgattgggtaatttatggtgatgcgaatttaaaggcgcatatcaccacttattataaaggtctttttggctgtcttgaagtttcttctttaacgttagatgaaagccaaataactgatattccacaagtttctcaattagaaaataatgctttagtacaagatttattttttgagaaggaaattaaagatacgatttttcaaatggaacataataaagctctgagtccggatgaattcctagctgagttttatcaggttttttggaattttattaagtccgatttggttgatttatttaatgattttcatagtggtagtttacctctttagtctcttaactttggttactgcccaagtgcaaagaggccttgaaaattcaaacatataggcctatttgtttacttaatgtcttaatgttagtttgaaaatttttactacagttgctacaaatagaatttc

SEQ ID NO: 28167 - DNA, 637 bp, Oryza sativa
  unsure (1)..(637): unsure at all n locations
nnnnnnnnnnnnnnnnnnnnnnnnnnnnnnnnnnnnnnnnnnnnnnnnnnnnnnnnnnnnnnnnnacgtcctccgactcgtcgccaccctcacgttcggcctgcgcgcccgtcccaggggggacctccgccgccggtacggctcgtgggccgtcgtcaccgggccgacgtcaggcatcggccgtgccatggcgctggagctcgcggggcgcggcctcaacgtcgtcctcgtcggccgtgaccccgccaagctccgcgacgtcgccggcgccatcgcccggtcccactcccaccacggcgtgcgcaccaagaccgtggtcttcgacttctccctcgtctccaccgtgcaaggttgatgggttacacacttgtttttttccagcaaaatttcagaaatctctgtaatttttttgtccaaaattatttgaaaatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28168 - DNA, 615 bp, Oryza sativa
ccgtacttggggatgcggtcgatcttgtaattctctggcacaagaatgacatatcctttggattgggcaccgacgccacgcaaaaacctgtggtgcctaaaccggggttgggaaaacctccgagaccttctaagaggaaggtgactgataaggcagaggaacccgagatgcaaagggaaaatccagtgccggaagtgccaccggagattgcattgccagaggcagccatggagattgcaccgccggaggcagccatggagattccagtgccggatgtgcccatagagattacagtggcagaaccagaggtgcaatttgtggcatcagtcgggtcagaaatagaagaagtaccaggattggaatgggacggtacagagccagaaatatttgaagacccttctcctgcgaaagaccccgaggttcaagagaccacggtccctgagaaggccactaccagttctgaggtgccacgagtgcttaggagccacgactccaagtccaaagatgagaacaaggagaagttcatggtaaccgtctttagagggggtaaggaacgtgccaagctcaaagatgacgacccccagaaggctgctgaactagccgggccaacatatt

SEQ ID NO: 28169 - DNA, 383 bp, Oryza sativa
agactacgatgttagtatgcacaattgataccacatttagtagtacatagataatacaacagggttgttcttattaaaaaaatacaacacggttgtgaattgttccaaaataaaaaaggtagtagcctcaaccacgccggctggccctcgacgcgaccgcgcggcctccgccgcctcgaccacgcctgcggccggcattgcctcgcgcacagtagctgggcacgcgcccgcccacggccggcgcccgtgccttgtgcccgccggctccggcttgcgcgcgcccagggccgcggcctccgaccgcgcgcacgccgccaccgccgccggttcgtacccgccgcctccgccccctcgatccgcagcctccgggccgcgcgtacgct

SEQ ID NO: 28170 - DNA, 649 bp, Oryza sativa
agctcggtacccgtacaacgtatgtattgtcgttccttggatgttgacacttatcttctcttctgttcttatgggctttgcagctgtgtgaatgtgctaaacaatctaatcagggaattgcacttaagtcaaactgtacgcatctgtctcaattgtttgcaagccaaaagatggtgagaaaccagttatatttgataacaaactgcagagcacaatatcctgattaacattgctgccgctaccacccctaacctgagcacctgatccacacagcttatgcaagaggcagcagaagtagcaccctgtgactatgaggctatgagccaaggcctccgactaaagggagagggggaaaagtgagtggactgacaaagggcgcattagtcatgaggtagctgcaaattcatggtggagtggaggaagaacctgactatgtcaaaaaaatgtagccaccacagcaatactaactggccatggacaggaaaaagaactgttgaattattcataaaagtttttcccgttttgttggggatgcaaataggtgctgcctctacacttccatccactgtattctggctaagtggctaacgttttaagtagaactggtataagcaaaaaccttacatttaactcattgaatcagaaacct

SEQ ID NO: 28171 - DNA, 1980 bp, Oryza sativa
cttagccgcgtagccgccgcttcgccgcgacgccgccgctctccgccgccggtcggttgccgccggccgccgtctcgcgcctgtgccgcatgcgcaccgcgccatcgcgcgccatggccgccgggccggtttgcgccggcccgcgcgcgctggccgcgagctcccgccgccgtgtcggggccgtcggttcggccgccgcgtgtgcgccgcgtcggcgccacgtgtgcaccacgtggtgcgccgctcctccccggatcgtggaccccgtccgccgtggaccgccctccccgagtcacagccatgtggggcccgcatgtcggctccgccccttctctctccccgggatttatttattgcgcaataattcaattaaggatttttctgtttattgtaaaaacacaatgaatcttctaaaattcataactaattcatccgagctccgtttaagcccattcaagtctcagtaaatcaagaaaaatgcgtagaatccattaaaaatggttttgttctctgtttcagtagtcttatagcctgtttgtattgtttgccttgtatgtcgcttagattccagctctcccgacgctccggtgtacttcgaaatagtcgtcgaggttcctccagctgcagagcaaggcaagtcatgcttgtcacttgaacatgttgatcctatattgcaaatgctctattgtttttcttcaaatactgcattgttttataatattactatgggatgtttacctattgtcatagccatgctatttttgtaccatgcttagccatgcttagttcaactagcacacaatgggggaaaatcatattaatgtatagacgataggtcctaatgttaatgactggattagtgccaccgttctggtgttgcataattaaaatatattaaatggtgggctgtgggtgcatggttttgctagtcgcgcctatggcacttaaggaccggttcgcgggaaaccctggaagaattcctcgtacttaccacaagccagcgtgggcaacgactgggcttgtagtgtagctttcctctagttgacgcatccaggcaagggtgggcgtgatggagcggggcgggccctgcgacggcctctgtcgcttccggattcacctaggcacgaaaggggactgcccactcccatgcgaggagtgggggtgaaacatgaggtgtggtgtgcttggttaaagggggttatgcgagggtcctgtcacggcctctttccggtatgtcgtggtggcatgtcggcacatggaaacgtgtcgtggggctgtgtcttgtgggtacagttgtacacctctgatcagagtaaacctattcgaatagccatgcccgcggttatgggcgctcaaccagattcaccgtgattagattcaccctagactagtctaatggaattgaataatataggtggatggttgggcctgttgcaacgcggtgtagcattgaacagtggatggttaatattgattaattattacaactgtttaattctctcaacttctgtttataaatgctcgctttatgcaaatgaaccactctagctctccttgataattccctgcatcatacctctattccggtatgacttgctgagtacagtgggtagtactcagtcttgctctattttccccaaaccccagagtttgagtatgcgtcagatggtggcttctccgaggagtaggcttcgttcgtgccgtcgaggatgcctgtggagtggtgatcccgctgcggttcaagtcaaggcttagctccagttatcttttagttttccactgcatttatgtaagacttttataatgtttgtaagacgtggatctgtatgtcaactttgtcgtttgtgtacccccggccggtcctggacagggattttaatacatattctacttggaattctattcgggaatttctgggcgtgacagggtcccagctcgtcccaagccaacccaggccaaccgttccacattttagttgtt

SEQ ID NO: 28172 - DNA, 13895 bp, Oryza sativa
tatctctctcttttctatccacttagcttagataatatatatgagaatgagtagttaatgcttgtgggtcactctacccttggattaacttaaccaatgcttagaatatgattatcaaaagtaatatataaattattagtcaagttctctctacatgatcttcccacgggataaaataaatgcgatacccttggaatactctcgggtgaaatgctaaaatggtatatccgtgcgcttgcggatgaactctgtaaccataatataccaaaagtatttctgctccattgctaggaattatatttctagtaatggcgttaagaaataccaacaagcatttctggccccgttgccggggaagattcatactagagattacatgaactaatattttatatatacctatgtataatcattttcctttgcaggctaaccatggttgttttcacttttattatgaaacacagggtagtgaaatagtgcttgactggtttcaacttgccggaaaacttcaaagaaaatccagaagctttcttccggaacgtcagaccgcgagtcgctgctccacagagaactctaccgacagagaaatcagtcgtaccagcgccaccaaccttcaagaatatggctaacaagactctccgggagttcgctactccctttgctgacaatgtggccattgggccgcaggtcaacataggggacgtatatttgacttgaagttcagcctatcacgatggcgcaggctagtccgttctgtggcaagcctaatgaggatgccaatgctcatctgcaacaattcctggagatctgtagcacgtacaccatcaagggcgtaagtcccgacgccgtcaggctgcgactgcccttctcgtgagagcgaagtagtggttctatgccaaccgtcctgctgtcaatacctgggataaatgctctacgacattcctctcgaaattcttctcgatgggcaaaaccaatgcccttcgtggaaggatttcaagttttcagcagacaagggacgaatctattccggaagcatgggaacgtctgcaggagtacgtggcctcctgtcctcatcatgggatggacgactggctgatcctgcagaacttttataatggactcaccctgatgtcccgcgatcacctagacgcggcagctgggggagctttcttctctaaaatggttcaaggagccgttgatttaatagagaagatggtctccaatatgggttggagcaaggaacgactctagacccgtcagcgaggcatgcacaccgtcaaggagacggaactgcttgctgccaagttagaccttctcatgaaacgattggacgaccatgagaaatggccacaaggcactgtcaaggccttggactctcacgtcatgtgtgaggtcttcggcggcacgggtcattctgggatgactgcccgaaaacccgagaggaggtgacgtacatgggcaacaacaacgggtaccgtccacaaggaggtcaggggtggacccaaccatgcccatattatcaaggaggtaacaacaacggtaacttttctatccagccctccttgaaggatctcgtttttgcacaagctaaaaccactgatgcgttaagcaaaaagcttgtggccaatgataagatcctagaaaacattaatgtcaagttagatggctttgcctccacttttcaaaactagctgagctttaataaaatgatagaaacacagctagctcagttggcatccttagtccctgcaaatgaaactgggaggattccgggggaacccgactcctccattgaaaatgtcaaggcgatcacgacgaggggtggtaagtccacacgtgatccgccgtatcctaaccctgcaggaactaatgggatatcaaaagaagcgctatctaatgactcggttgacaaggaagttcagccagaaaagacagtgccgcaggagtactgcgacacacggttgctgccgttccctcaacggagtaggaaaccgtcagtggatgagcaattcgctcgttttgttgaagtaatccagaagatccacatcaacgtgccgttgttggacgccatgtaagtgccaacatacgccagttatctcaaggacatactcaacaacaagagaccgctcccaacaacggaggtggtcaagctgatggaacaatgcaacaacctgatactccacaagctcccggagaagaagaaagatccagggtgtcctacgatcacttgctcgattggggcacaacagttcgaccaggccttgtgcaacctttgagccggtgtcagcgtcatgccaaaagacgtcttcgacaagctcaacttcacggtattggcaccaacaccaatgcgccttcaactgccttcaacgccgctcatcctggggcgcccttttcttagcaccgcaagagccaacattgacgtgggaacggggagtatccgtttccacatcaatgggaaggaagagaagtttgagtttcaaccgaggacgaaacaatgttccatggtcaggataaagtacgggctgaacccacagaatattcaagaggtcgaagtggagccacccaaaacggacagcctggtgaaattcatgcagaatttcctggagctggaaacaacgatgcccaggaactgttattggaagacaccggtaaaaccacccacaccggcaagaagctagagcagccggctcagaagaagctgccgtccgcaccaaaaccaaagaaggtgtgtagggagaagccaaagacgcccgctccatcacctccggagacgggtagaaaatccgcaaactgaactggaaggaggtacagtcttgcacgtcggactttaaatgacgcgacctttgccaacaggtaaattggtatgcatccgcatatttgctttcaacaatttggatttttacatgtttgaatttcaaagttgcatttaggatttttgaattttgaggaaattcttcaaattaatttttcagagcaaaccaaaagaaaatttccaacgaaaattcaccatgccacgaccacactgactgttggaatccaacggccgaaagtggggccggttgggcccaccgtaggttcggtcgaaccggccaggaaacggttacctgccacttttggcagggtaacggctagtgggacccacatgtcatttctgaccgttgtgggtaccctataaaagccagccagccgagagagggaattctaccccatttcaacacattttctttccctctccaaagtttgctctcaagttcattaaagctttgatagtttccctcaaattcaaatacttagttgcatatatacaagttgctttggtgaaactaaccggcgggtgaaattcttctcatttctaacccctgccgagctagttcgttcttgctccaatgtgcaaaatgagaaggcgattgtcacgtctgttcaaggggtccggctcttcatcaagtcatcatgacgagtctagcactcgttcatcagctgatgtctcgatggaagacgccgaagctctgcgacgactcctaaacgaaactgacctcgaccttgtcaatgatcgggagagacaagcctactacatgctgagcgaccgggagtatgctcacacgcgagaatactctccggagctgctgaaaaatataggtatggatgttgaatgtcgttctatttggaaagcggttagttggcagagatttgctgtggtagatgagcctggttctcgtttgcttactttgcaatttctgtgcagtttgaaagaaatagaagatggaatttcctttcgctttttccgtaagaagtacacagttacatggaaaggcttaagtactgtcacgaccggaattaacccaacaggcattccattcgtgcgtgtattattccttgtcctaggaggcaaggtacaccaaaagttgatacaatttagagtttaacaagcggaagcctaaatagttaatttattacatgggcgacggaggcccagcacacacgaagataaacagaaaacagcggaagactagggttacgaccagaggcacttgacggcaggcacaagctagacaccaaagccttcatcttccaggaactcctcttctgggttggggaaaaattgagcaagattgagtacaaccacagtactcagcaagacacacccacggatgcagaataaatgcaaaggagtacaagggagttataataaaggggttagggtttgcagtaaacagcatttaaaagacttttagttgctcagggccatttggtaaaaacgatcctagagctactcaatgttattaatcaaggccgtgaacccgcacgaacctgccttaacccaaggcctacgataattcagaccgaactggcaacccgtcctaggttccagctcgtcccaagccaacccaggccaccatttccatattttagttgttaagcaagttttaagaattaaaccactaacttgggtacattgctaggcttgcccataaccgagggcgcggctatttgaatatgttatactctgatcagaggtgtacagctttacccacaaagacacatctttctcacgtgtaaccacgtgccacataccaccacggcatacgggcgaaaaacgtgacatagttcccaacccatcctagccataaacaagagtaccgacccaaccctaactacggccgggattcccgagacaggtaaccaaggttgagcctctagcagcaggacactggcccggtgccatgacatctcgactaccgggacgcagctcgtgtagccttcatttgccctagagatgtccatcgggccccgacttcgtccatctccatccgtgtacctttgtttatgaccagactgagccacaaactaaaccttacccactagatatgtggaagtacggtagagctttgcaacagaggcccgaagaccggtccttatggtggccgaggtgctactatcaaaaccatgcacctcgagtccagcctaaaaccattttgagggttttgaatagagggggaggtgtgtgtccatttcaaaataatccaaccattccataatgtccaaatgatatgagtattcccaaagtctaaggttataaaaccacctattgttgcctaattaatcagcgaagcatctacctaaattcatactagtggaatcatgaatagaaaacccactagttgggtttttattttcctagggtgaacaaggtaataataacaatagcaataataataaggtcataacaaaggtaaaaaggcatggctaaataaaacagtgataacgcgggaatttaaataaagcgataatgcagtaatttaaaccaaaataattttataaactgggattcaatatgttcaaggatgatgtgacttgccttgctcgctttcccaaacgtcgtcttcaacctccacgtagagcggatcttccgaagctgcagcgtctacacgaccaacaggaagaaaaaggcttttactctaataaactccatataacaagctggaacaaagcataaaaatgggttcttgacttcttaaggaaaaattagagacttgaacggtccaattccgagttcaaacgaccaagttatggccatttgaagtttatatgctctttaagtgaatatttacgaatttcttcatttaaattttaattaaaaatatggtttattgcgtcagccgaggggagggggcacgcaggccgggtccacaggagtggtgggcccaacgcggcagcctctcggtccacggtggaccgggtgcacccgcgggctcaccagccaatgccgtgggtcccatgcgtcagccgcacccgaaggaacgggtggctgatggccaggccccacgcggcggccacacggcgcgcccggaggcggccacgttggcgcggtcggcgggaggctgcgcccgcacccctatggtcgccgacggcggccataggcgcggcggagcggcggccaagagaggggaagggaagggggaaagaggcggcggtccacggctcaccccgggtcaagggagcgacggaggaggtggccggcgaggagggaggcggtggcgcagctcaggttgatggggacggcggtgtttcggcggtcggcgagctcggcgaggcggtggacggggtcgccgccggtgcgaaaaacccggaggggacgacgccgaggcgggggacggtcccggcgagcggataagcccggccggaggtcgacggcgacggcggagagagaggacgacggggcgagctcgattccgatggggagaaagggcggcgagtggcggaaacagacgagggaggtgcggggagggtttatatagggttgggagtgagagagcgcggccaacggggaaggaaacagccgcgggagacccgccgccattaattgtgccggcgggattagggggtgcttccatccgaaataaagagagaaagagagaggggaaaatggggggaaagggagagggaatcggggggaatatttccccccattcaattttgaacgggaacggcggagcgcggcgcatttggcggcagcgcggcctaggcgcgggcggagggagcggcgcatgcggagggaggaaggggatgacgggtgggccccacctgtcagcgagggtggtgggtgggcccgcctgtcggcgtctgcgcgcgaggggaaagggagagggctgagtgggccgcggggagagaagagagaggagggagatgggctggattcggcccaagagagggtaggaggatttttagtgtttttctttttataaaaccttttcaactttgtttatttcttgaaaattattatttgtgctctgaaaattccactaaaatttatttacaccttttaggcttttaggaaatatacaaaaatcctccaagcctaatttgacttttaactttgcacattttaatttttggaggctttcactaggattttaattattctaggcataatttaaaggatatattttagggtcgttttgggacgtgacaaacctatcccccttaaatggaatctcgatcccgagattcggaagaactggcgaagaggtcgggatgggctgccttcagctagtcttcacgctcccaagtagcttcttcctcggcgtggttgctccactagagcttgcaaaaacggattacccgattcctggtcatgcgctctattgtgtccagaatcttcaccggcttctccacgtaggtcaagtcttcgcgaacttcaatctgttctgaatcggcctgctcggacggcactcgaagacatttcttgagctgcgacacgtggaacacatcgtgcacattgcctaaggatgcgggcagctccaactggtaagcaacttctccgcgtcgagcgatgatgcggaaaggccccacatacctaggtgcgagctttccttttgtctgaaacctgtgcactccccgtaatggcgtgacccgaagatacacaaaatcgtccactgcgaattccagattacggcgtcggttatctgcataactcttctgccgagactgtgccacctttaggttatcccgaatggttctgactttagcttcagcctctctcagaatatcagtcccgaacacttggctttccccaacttggtcccataacagtggagtccggcatttgcgtccatacaacgcttcataaggtgccatttgtacgctggcttggtagctgttattgtaggagaactcggcataggggagactcttatcccaggacttcccaaaatctagaacacaggcgcggagcatgtcttctaggacctgattcagatgcttggtctgtccatctgtctacgggtgataagcggtgctgaaattcaatcgggtacccaactcatcttggagcttcttccagaagtgagaggtgaattggcttcccctatcagatacaattttcttaggaacaccatggagactcacgatcctagcgaagtaaagttcagctaatttgttccctccataggtggtcttcacagaaatgaaccgagccaccttggttaatcgatccacgactacccatatataatcatatccgccttggtttttggaaatccggtgatgaaatccatcccaatttcatcccatttccattctggtacttgtagaggttggaggagtccggctggtcgttcgtgctctgcattgacacgctgacacacatcacaaagggccacgaactcggcaatttccctcttcatactaacccaccaatattgctctttcaagtctaagtacatcttcgtactgccagggtggatggaataaggactttcatgagcttcctgaagtatcaactgtttaagttccttgttgtccggaacgcatacacgatttccgttccataaggttccgtgttcatcttctgtgaagccagcggctttaccttgtttcatattcttgaggatcccatgcatatccggatcattcttctgagcctcgcgtatttgatcaagcaaggtaggctttgcttccagtgcagccaagaatccatggctaacgatacttaggtttagggcttccaactgttggttcagttccggtggaatgccacggacgcaaagagtactgcaatggccttgtcgactcagtgcgtcggcgaccacgttggccttaccagggtgataatggattcccacatcatagtctttgatgagctgtaaccatcttctctgccgaagattcagatccgacggggtgaagatgtatttcaaactcttatgatcggtgtatatttcgcaacgatttccaatgagataatgccgctagattttcagagcatggaccacagtggacaactccaaatcatgggtaggatagttgccttcatggggtcgtagctggcgtgaagcataagctaccacatgaccttcttgtattaacacacaccccaatccttggcgcgaagcgtcacagtacaccaagaaatccttgcgagtatccggtaagattaacactggcgaggaaaccaacttttctttgagagtttgaaatgctctctcacactgcggactccacacaaattcttcttcattcttcagcaactgcgtcatgggcctggcaattttggagaaattctcgatgaacctccgatagtaccctgccaaacccaagaaactgcggacctgggtgaccgtcttgggttgcttccaatcggtgacggctatcactgtttcgggatccacagcaactcctttagcagatatcacatgccctaagaacttcatttcggacaaccagaattcacacttgctgagcttggcatacaactgatgttcccggagctttcccaataccagacggagatgctgctgatggtcttcctctgactgtgagtacaccagtatgttgtcaataatgaccacaacgaacttatccaggtattccatgaacaccttgttcattaaattcatgaagaaggcaggagcgttggtcagaccgaacgacatcactataaattcatacagcccgtaccgcgtggtgaatgcggtcttagggatatcttcttcacggatacgcaactggtgatatccggaacggagatcaatcttggaaaagacagtggcacctttaagctgatcgaacagatcatcgatccggggaagagggtacttgtttttgatagtgacttcattgagagctcggtagtcaacacacatcctctttgtcttgtctttcttttcgacaaaaatcacgggggcaccccagggggaagtgctcggccgtatataccccttctctttcaactcttccaactgcttcttgacttcggccaattcacttgctgccatacggtagggtcgcttgtacaggggagtggttcctggagcaagatctattctgaactcaatctcctgattgggcggcatactgggtagctcttccggaaacacatcaccgaactcactgacaacgggtatttctgtcagtcctagttgatgaagtactgaactgccggtgggagttgggggtgcaaagaaaacaaccggttgatcaggcttccggtacatagtgacagtacgccttgcgcaatccactactccttagaatcgggtcaaccaattcatcccgaggatcacatccaagtccttggtgtcaagaaggatcagatccgaggggaaaggaattccctggatctctataggtacggccgggctataatactttgctgtcatagcccctctaggggtggtgatgagcagagagttcctaagcctttctacccccagctgatttctccccacgaattgcacaaatataaatgagtgggaagctccagagtcaaacaaaatggtagcggggatggaatgaatgaggaacataccaatgatgacatctggagttgcctgcacatcctctgcagtaacgtggttcacacgaccccgtgtggcatccttaccaccgttgttgcggcgaggaggagcttggccttcctggcgcctcggcttcgggcatttatccgcaaagtgcacgggctcgaagcagttgaagcacagatgctgctaaccttgaacatccctgcgaccttgaccaggctgcacggccggtgcaggaggacggggtgcacggttcccttgctgattctgctactgctgcggctgtgggacgcgtaccacgaattgaggtcgtggcgcggggcgaggttgctgctgctgctgctgtgaggaggatccccctggatagggattgttgtagcggatcctttggttagccacctgttgattacgaaaattcgccaagcgacgtttgtgtaactccagttccttgtgcttggcttccaggcggatgctcttggccactaggcgctggaaatcaaggtaatccccgaagaccagacaaacagaaagttcagagtccattcctgccagaaacttctcctgcttttcttcatcttcacgaacatcctctggggcgtaccgagccaagttattgaactcatgcaaatactccataacagagcggttgccttgcttcaactcccgaaattccctcttcttaagggccacgactccagctggcacatgggtcctccggaaagcggcggtgaagcgggcccaggtgataggctgtccttctggctgcatagcctggaagtggtcccaccatagtgatgcgggcccctgcagctgatgggttgcgaagataactttctcctcatcattagactagacggtgtcgaacttttttccaatggcatgcaaccagtccaaggcatcaacggggttattggagctagagaaggtaggcgggcggatgcggaggaactcggcaagcttggagtgctgcgggggtggtggtggtggtggagcattgtgttgcggcggattctggatgtggtggaggaaagcagccatcatgttggcctgctgggcgaggatttgggtgaggatggggttggtgtcaggtggcggtggtggtggcaaagggggaggtggaggtgggctgccatggttgttgtggttgctgccttcggggtgactgccctcaccggtagcaacgcttgtcctggttgtcaccatctgaaaacactaggagctgatgattaaaaataaccacccacgactaccataattcttgagtttatttctgctattaaattggttcattaaggttcaagctgcttatgcaaataaaataaagacaggctccgacatagttataccacacaccggtataaccatgccccacacgactctgcaagaaaacaaacgaaaagaacacacgcgcgggcctactaactgctcgtctacttctgcgacgggccggggcggaaggtgagtaacagcacatcctccgtgctactaacgccagaggctccctcctcctgaggaaccaagggcgcgggcttggcgcaaggagtctccacgaagcaagtccacgccaaggactgacgaacaagctcaggcctggaggtactcttgcgggcggtgatcttctggctgcggcagacacggcggcgcttggggcggcaggcctgtccttgagcaatcttgagctgatacagctacgctccatggcgtccaagtccttcttcagctgcaaattctcctgacgcagctacaggatcttcatgttgttctcgaccagcccacggtgcaccatatgatggaagtcgatgcgggccgtgacgtacgcctccaccatgcgcaccaggtgcatgatggtagcgtcatcctccgagccagcatccctgaacatggcgtagtcgcgggctcctccacgacgagggtggtagcggtagggcgagtgctgcaactcgcccggatagcgttggtgaatagtgcatggcgaggagcgcggcgttctggcaagcggcggggaaagagtctccacccgcggtgactgccaacgaagtcctctcgggagagccggtgaggatcaccgcagtgacctcccaagcggcgcggggaagcttcttgccctggtagtccactccatgcggatatcccaggacaatgcacatgccccacagttacaaagcgaagccagtcagatccagaccacgacggttgaggttgtcggccatctataaacaaaggcaaaagaaaaattttaaagatcaactttttgatgataaatgaagcagcaagacagggagagactaaaggattttcggaaataagagaagatttttatttcagaatactgctaaggcttgggatctaaggctcgtcctagggtcaaggaggctctgataccaacttttctcgaccggaattaacccaacaggcattccatttgtgcgtgtattattccttgtcccaggaggcaaggtacaccaaaagttgatacaattcagagtttaacaagtggaagcgtaaatagttaatttattacatgggcgacgaaggcccagcacacacgaagataaacggaaaacaacggaagactagggcgacgaccacaggcacttgacggcaggcacaagctagacaccaaagccttcatcttccaggaactcctcttctgggttggggaaaaattgagcaagagtgagtacaaccacagtactcagcaagacacacccacggatgcagaataaatgcaaaggagtacaagggagttataataaaggggttagggtttgcagtaaatagcacttaaaagacttttagttgctcagggccatttggtaaagacgatcctagagctactcaatgttattaatcaaggccgtgaacctgcacgaacctgccttaacccaaggcctacgatgattcagaccgaactggcaacccgacctgggtctgtcacaccctaaagttctttcccaagcctaaattgaagttataaatggtctcaagagaataccagtgtaaggcaagagtaaaccttaataaattaatgcaaataataatcggatttggcatgtggaatttttcttgagttctacatgtcgaaatatgctaacaagatttttaagtggaattttcagagctctagaaataattttaaccttttaaaaatgagcacaagcaatatttaatcccaggaaaatcctttttccttctttttcctttttcttttctctttccttcatttgggccgccggcccattctcctttccccccttcttcccgctggaccggccgataggccgaggcccagccgagccggctgcctccctcctctcccccggggtcgctgacaggtggggcccccctgtcgggcccgtccccttcctccagccggcgccgcaggcgccaccgcaaccgccgccgcgcccacgctcccaccttctccgggccacgtcggccacgcccgcgcatgcgccgcatctcccgcacccactctccctctctctccacctccacctccccacgtcggccggcgaaatcgggccactcccggctgttcccgacctccccacccctataaaatccatccccgcatcctcctcccctcttttcctt

SEQ ID NO: 28173 - DNA, 1317 bp, Oryza sativa
ctgggtgagtactggcaaacctgaaggagttcttactgctgaacagcagaagcaattcgaggaagccactactctctttgtgggatgcattcttagcgttcttggcgatcgtctggccgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaactttaagaagcagaagaagaacaagaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcataagttttccattgtcaaaggttctaagtgccatagttgtgtgcaatcgaagca

SEQ ID NO: 28174 - DNA, 2665 bp, Oryza sativa
ctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaatcatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccgggcatgcatgttggtacaattatggagtctcgtgatgctaccttctttgagagctttttcccaatgaaggatacacatagtggttcgaaccaaccctctggaataattcccagttcaatcacaccaccagaacaaactgaacatacacatgaacttgtctctgaggaggatgtcagtgaagctcctcgaaggagtaagagacaaaggaccgctaagtcttttggggatgatttcactatgtacctcggggatgacactcctaagtcaatttcagaagcatatgcatctcctgatgcagactactggaaagaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggctcggcttgttgctaagggctatactcagaaagaaggcgaagatttctttgacacttactcacctgttgctagattgaccacaattcgtgtgctactttccctagcagcctcacatggtcttctcgttcatcaaaaggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagtcattctgtgcttgtatgttgacgacatactgatatttgggacaaactttgaggtgataaatgaggttaaatcattcttgtctcaaaattttgatatgaaagatttgggagtagctgatgttatcttaaacattaagctaattagaggtgagaatgggattacactcttgcaatcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggcgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccaatctatgtgatcggagatctcgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctag

SEQ ID NO: 28175 - DNA, 1789 bp, Oryza sativa
ccctgagcagatgcagcctccttttgcagttttggtttgttgcaaattcggattcatttttgttttggaaacgttccgaaagatccggtgcgtgcaaacagcgttccgaaagatccggtgcgtgcaaacggcgtggagtccgaataagttacgcgcgacttatccggttcggttacgcgcagtagagatcgtgcgggcgccctgatcaagcgacccttctttatataaaccgacctgccgtcttcacgcaacatacgcaaaatcaatctagggtttgcttcctactctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcattcatgctagttttcatctgtaatgtcatgatttatttatggaatagattaaatcattatatgtctataatctcaacagcaaacactagtaatacaagtagcttacttctatcacatataggaaagacagccacacgtgatatttgcagatggggagaagagacacattctataattttcacttgaaaataagacatgacaagtcaacaatagtttatttttaggttctgattttcaagtcaacaatagataactaggccgcactttgccacggatacagtgaactgcataaggaagaacatgtttgcacatagaaagtaaaatgtgtgaaaaggaagatatctataaagacaatctaaacattaacacctatcagctaagaaagttaattatatgtgactgaatacggctaacaaccatcctgatgcttccaaaaccttaaaaaaacactactgctaacaaccatcctgatgcatgtcaccaaatcctttaaaaaacaacactaaaaatagcactgcgctaaaaggctgtaatccacgaatatagaagcctaccaatacttggtcccattgttatcaatatactcaaaacaactattctaacattgatgatgtactcaaaaccgttcctccaaactggtgtggtgccaaaaaggtttatctagagagtatccctttgctgcagacaccgtgaagagcataacagacaaacatgaacgcatcaagacaacaaaatgtgagtagagaaatatttatccagagacatcctaagtattatcatgtaagagactaagagctaataagttacatgtgccttaatactgtacatacagcttgttagtataatgtgaatataacaaaacctaaataaacaatacctggcccataagtctggaatccaaagtcaaatatagcagcttgccatggtaggagaaccatcgatatactcaaaacaaatctaaaaatatgcaagtacatgaatagcatccaaaaattcagttgaattctatactactccaaaaggtgtgaatctagaagtgcaagttagataaagtaagaaaaaaccaaaatagctttgatttatcacttgtcaagttatcagttcatatctatttctaaaagctatcaaacaaaatagaaaatgcataagcaaaccatgcagtaaa

SEQ ID NO: 28176 - DNA, 612 bp, Oryza sativa
atttgctccaagaattgcatctctccagttccaactctggtaaggaggatctaagggctgcatgttctgatcttgaaatgattagaaggctgaagaaagaggctgagtttcttgaggcttcctttcgagcaaaaacagaatttcttgaggtgagcttaattatcatacaaccttttactagcctgcatttcatctggaaaaggaattactacaagtatgtggacactttaatttctccatcataggactcaggagagtgcattccaataactgcaatggctattaagggccagctatttctcaataatagaaacaacatcctcaatgactgaaataacaattgtcacatgtatagattagatggccctagacccaagcaacacaaccatgctgatgaccaggggccacactacatgggctatggatgattacctagtccaaacacttatgattatttcttgcttaatctgattaaaatccagatatatttttaaatagggcagcattaaccacgcaacgagccacatatcttatctccttatcttaaccaactatacatgttctgcatccagctgcctcatgcttcctaagctcctgttgggctgttcatgg

SEQ ID NO: 28177 - DNA, 284 bp, Oryza sativa
tgaatgtgggaaatgctagaatgacttacattgtgaaacagagggagtatcagattgtagatcttgcattttttttacccttgcataaggtaaatgtggacagtcctgctttagaaaccatgctaaagtaacttcatcattctacagttaaggtatttacataatcaggcaacaacaacaagaagtcaagaaggtaataagactgatgagtgtctgacatgaatatgatcgataggagtctaaccagtgtctcgtgaaagctctcaaccaaggagcgagaaaaa

SEQ ID NO: 28178 - DNA, 1119 bp, Oryza sativa
ctcctgtttttacataaagagaaacaaatcaaggttaacctatttggaccaatgttttattaaacatagtatgattatagatgtatataacattatctttaaccagtgccttccctgacagtggtgctagaaatgcttgttggtatttcttacgctcacaaataaatccgcaagcgcacggataccgttgtagcacttcaccaatgagtattcccgaaagtgccgcatttatatttcagcagcaaaaacagaggtgtaaagacatagtttatatcaatctataattaactcactatagtctagacctggttagtattatgattaaggggtattatgacacacataagattcatctctaattaattaatatagtggaaaagacataagagaactatgatccaaccgttattccatattaatcatgttatatatatatacttaacacaatattggtatttattaccagggttaaacctttcggtttggccgatttgatcggacctcaccgaaatgctgaaatttcgaatagaatttagttgaatttgaacaaatattaccaaaattcatgaaaaaatttaaaaatttaaaacttttggccgaagtaatatcgtttcggtcagcgcaaggaggagcaaaggcagcagcggtcggcgagcttctcgccggcgctggcagtgaacggcggggtttcatgaggtgcagccaaaagtggatttgtagagtggaggattgtgaagctaatggtggtggtcttgtgcatagtggtgccaaaatcagtgtcagcggcggcggtgagcttcggcatgctagtcagcttcgcactaagtcactgccatgtggaccccacatatacaagagataggatagctgacatgtgagcccaagggtatttttggcatttcacgtgatttctctctcctcttcaactgtaaattattgttttagtcggcgcggtgtccattggcaaaataccacgattatggatgtttccctcaaaagttagttttggcagtgtcctaaggctaaaactacacaatagcagtgtcctgtaacaaaatttcctaaaaaaaaaagcaccatcgctcaaaaaccaatagtggcagcttggaaaaaggccct

SEQ ID NO: 28179 - DNA, 32601 bp, Oryza sativa
  unsure (1)..(32601): unsure at all n locations
aggggtgaggatatcaaagagaggagagagagatggggagaggagaagagatgaaaatttttgaaagggtgaggagggaaagaattgttaatgtgaaaaactttgaatcaaattttatgatattaaatgaatttttatgaaaaagttgtcaaaataaagttgtagaactcgttaagatctaccaattttattttggtcatttctcgataactcatcaatatctataacttttgttttggtcattttgctatgactttatttcaataatttgaatttgaatttcaaattgtgacatcttcaaacaacattttcaaatattgaaacaaagtcatatagcaaaatgaccaaaacaaaagttatagatcttgataagttatacaactttgttattggtaatttttttatttgaaatcatttactactcgaaaaattatttgaattgagaggagagaggcaaaatagacttctcggtaagggaggaacaaaagggctgggccggcagcccgaagagggctgggccggcagcccgaagagggaggaggagggagagagaggttataggctgagagagggagaaagtaatacttgggccgaaaaaggcccaaggacagagagaggaattttaatttgctttctatttattttaacaggttaaatgaactttgtggtattaaaattagttattgagcttcgaaaatttacgaaaaattttagagaattatttagaccacgtagaatattacaaaaatatttccggccatgatttttaaaggaatattttagtttccccattaattcacttgattaaattgctttaacttttaatatatttttttagaaatgcattatataaatttatgacgtttgctttgtgccccttatgacaaattaatattcgtcacgatgtcccattgaaatactttatgacgatttctagttggtattaacgacgaacacctttttttcatcactaagccaccccatctcatacttatcatcataaaatggaatgtgctagtgacgaatagctccgtcgtcacgaggaattcgtcacagaaggtcatatttcttgtagtggttaattcttttttatttaatcaaccgatatataactttgtttgataacttagttgatcactaatggatttgaatatatgtggtctagtagagaagcacttgacagaagagataatatcattgaatcgactattcatagtattattattcaacgaccttattatataacctccatagcacatagtgatcagacccatctgatctcaaagctggcatccccagtgttgatagtaggcccaatgggcacattggaagcagagtgagccgagtattcatggagagtcttctgagttcgggtgccgagagcctgattttcggaggaatgacacgaggtcggactcttctggcaagtttctctagattatcaacgaagtttatccacagatcaaaaccggtcatacactacctgtttttacataaagagaaaacaaatcaaggttaacctatttggaccaatgttttattaaacatagtatgattatagatgtatataacattatctttaaccagtgccttccctgacagtggtgctagaaatgcttgttggtatttcttacgctcacaaataaatccgcaagcgcacggataccgttgtagcacttcaccaatgagtattcccgaaagtgccgcatttatatttcagcagcaaaaacagagagtgtaaagacatagtttatatcaatctataattaactcactatagtctagacctggttagtattatgattaaggggtattatagacacacataaagatttcatcctctaacttaattaaatatagttggaaaagacaataagagaactatgaacccaacccgttattctcatattaatcactgtcatatattatataccttaacaacaatagttggtatttattaaccagaggttaaaacctttcgggcttggaccaatttgatcgcgaccctcaccgaaaatgcttaaaaattttcgaaataaaaaaaaatcctacttgaatttgaacaaatattaccaaaaatcatgaaaaaaattaaaaatttaaactttttggccaaagtaatatcgtttgggtcagcgcaaggaggagcaaaagcagcaacggtcggcgagcttctcgcagacgctgacagtgaacggcggggtttcatgaggtgcagccaaaagtgnatttgtagagtgaagnattgtnaagctaatggtggtggtcttgtgcatagtggtgccaaaatcagtgtcagcgtcgcaggtgagcttcggcatgctagtcagcttggggggggcccccccaaaatttcttttttaaaaaaaggggtttcccaacacttgggccccccatttggtttggggggagacacccccccaccataatcccaagagataggatagctgacatgtgagcccaagggtattttgggcatttcacgtgatttctctctcctcttcaactgtaaattattgttttagtcggcgcggtgtccatggccaaaataccacgattatggatgttcccccaaaagttagttttggcagtgtcctaaggctaaaactacacaatagcagtgtcctgtaacaaaatttcctaaaaaaaaaagcaccatcgctcaaaaaccaatagtggcagcttgaaaagggccctgcagttcttcacactaacatatgtgaaacgactggcgcaattattggtccattctaagcatttaagcaaggaagaacttaaaggttactagtaatcgtgcacgtgcaatgcacgtttttcacaatatatattccatcaatctaatattttgcagactcaatatatagccaaaaccgattcatttcgatccatagaagaatgaagaatcaaagcttcctgaaatttacattcaggctgaaaaggggggaaacaaaactgtactgtatgcaaacagagtacattgcacaaggatccatgtaaggaagaaataaatcattggaaaaatggaagaaacctatcgtcatttgaatatctatacaaatgacaatgaaagaaattagaaattctcatagcacaaccaaagcacagggaattttgaaatatcgaagaaatacaaaaactgatagtactgagttttgaactaatgagaatgtattataaatctgcatgcattccatatatcttgaaaatgaagttggatccttcatcaagaccaacttaaatttattatacaatttggggccttcagtttaaactttgcattgaattctattgaattcttcctgcaactgaacacaattcatggatcaaacataagaaataaatatatttttttagggataaacggcaggagctctgccaatttcattataggagaagaagataaaaagagtttttacaggctatggatacaagaggaaaccatagaaccccccacaaaacaagaagaaacggatgggaggattttcaggaaatgcatagcaaccaagaagaggaactgggtactactcatctagattatgagctccctcataggctttgcatatggcgatgatggagtcaacgacttgcggtactgtgctgtaggcaccgttgaagatccttgcgtttcgttgaagccaaattccccaggctgtgtagatgaagaggccatcaaaacttctcccttgatccctgatcatttctcttctgcacgctgtccaccagctaagcatatccccattgaaggaggaagccataggcatgtgaagcccggctttctgctagatggatctctagacctgctttgtaaaggtgcaatccatgagtagatgagtggccgtctctggctccactccacagagtgggcaaatgcggctgttatcccagccgcggagaaggagcttgtccgctgtaagaatcttcctatggatcatgagccaaccgaagaatttacatttattttcagtcttagctttccagaaaaaatccgacctattatcttgaatacttccaacgaattgtatcttgtaggcggagtttgccgagtatgtcccgttagaagaccatctccaagtgaccgtgtcatctgttccctcctgtagttccacccgtaagaaataaatatataatttcagtaggctatccaatccgtttacatgtaacagatatgtcatagatattatgttatagttcaatatgatgctatcaagccctgaagagtctgactctacatgccccattgttaatggaacatactactaagaaaagttgcttttggtccataaaatcttgtattgtctatgggaccttggatttatttctatccataaatttaagtgaagcaagcatctttttatggctcctttttacctggtgaggctctcaacaatcaagaatcaatttaatttaacaacaatgatataaaaatggatggttcagctgtaaaaaaaactcagtttatcatttaataaggaaaatctactgcaaaaaatattacaataacaatgtaaataaatatgcaaatataaaagatacaatgccaccaatgttcatttcttttaatcagggattttctacttaaatcagctaataatcactttaaatgatcacatttgctgaaaagggaagctaactactggaaaataaatcaatgatatatctcaaaataaataggagcaaattttctctccacactaagttcgatgactcatgttgcgtgtgatagttgaaactgatcatataaaactatgcatacttttttttacctctataactactcatgtgtgcatatgtaaaagggaatagatccattaagtagccccaagggttattacatgcacctagcttaaatgcgcatgccttatgttaaacaaatgaatggcagtgaaatgtatcaaacagtgagcatcaatgttcataggaatcaaataggatagtcaatgtaccatactattagcaatcaataagtgaagccagaaggggatttctcaggggacaagcatctaagttcagaacaaatggttgcgatggatgggaaccaagagcaattgtgacctcgagattgcgatggtggcagaaacgtagaaaagtgaggcggtcaatgcaactcctcatgaatttgcataggtgtacgttaatagatcccttgatatcctattcaaatagagtgttagtatatagtatattagctttaaactgatccacccaatgggttttgcgaatgtcaagcatggctgcaagcaatggaagcaagagatgtagaatcagttgtagcatgtccaacatgcaggaataaagcttatgaaagtcttcatgactcagagaggcaactaagcagaacaaacattttgtaccttatctttgagttcaactgatccatcatgtttatgcgggaatcaagcaggtgcaaatgtatgtttagctgcttgcagcataattatcgaccaaaatgcaaatcaatggtgcaccaacacggcaatgaacaaagttccctactcacctcagtacctcacagtgtccaagagcctcttttaaagccattatatcaagcatcaaaagcacatccacaatttctaattgcaatgatacaaatttgtgtgtcacgataaattaacgaattccaacagcaaacaacagtacatactgcagggaaactggatattactgaccttaagtgcatccaaatcagatcccactttcgaggctttgatatttactcatggagaagcaagatcatcactgcacgcaacaaaacaaaacaatcccagttgaatcaggcaaaactggctgtaattagggagacagttcaccaaatgctatcgagtatcaagagaaagagacagagacagagacagagtggatggatggacgcaccgacaagggcagcatgcgccactgaattactactccgtgtcctccaacacgcgcttcatggcaccgagctccgccgcgcacggaggtcatgagtcttatgaccactcacaagcctatcgagcctgaaaccgcccccattgcctctccgcggcgccacaagcttcctcctcaccgtcgtcactgagtaggcctgatccagtggccccacggtgcctcagaggttggatatatacatggatctgatggagaagaaggccaaacgggtctggtggtggaggagactggtggattcgatgggagcttgggggaggtgccagccattactgatttggggaggtggtctcccaacggagcgatggtgaccaaggcgcagcggcatctcatcaacatcgtttccagaagagaagcgataggatgcacgccatttgctgcctgtgaccctagctccacctccgtgcctgcgtgatgatctcgagggcaccctacactgacgctagcttcttgttgcccacctcgtcggtcgccgctgcatctgtgggcggctcacaccgcgcctcgagaagcagcgctaggctattagcaggagcgagggggctcacgtcatctggggaagatggagaaacgacagtgttattgcgagcggcggcggtgttaacgcgaggaggatggcacatcgagcgaaaatagcggtggagatagaatggggcctgcgatgtgggtggacggcagggattagggctcagggcaatgtagatgcagatgaacggtagggatttcataagttgatttggcctgtaggattggaagaggtgaactcctcatttttatattagtatagatatagattggtaataataaaaccatgagcattaatctttccaaggcaatggactccatcaaaacctacatttatcaatggaacagtactccgaatattagcttaagttaaagttcattgagcaatgagcttatacaaaatacgattgcaagaaagtcactgaaatgcattagtaccaagacatggatcgtgctgctattgcttacaaataataacaacatattgaatatgcttcttataagcaccagattgttgaggtagtgaagtgtatccttaaaactatgtaggcatcagttcaaaaatggcaggtaactggtaacgctgcctcgttgtttgatagtgcagagatcaagtgagcattcttgttttttctagttgttttgccttcttgttgtctaaaggagcattcgattctttccttcgatgatctattttagagattgtgtaaagcaaacaattccaaactgtcataacgtttgagtggcgagagagagagagagattcaactacatatgaggcatgtaaatatttggataaccttaaacaatgtggagaagacattgataagtaggataaatcagatatcaatgatgacatatacaacatctgagatttaattatgagtatcggtcaggattcaggtcatgatataatcttgggctcctagaagaaaaaaaatataatgaatgcctcacaaaatggtagctagcaaaagcatgcttgtacaaactcctaaatgaatcatgtggcaactttatcaatagcttaggcattgtatggtctaattttgttccattcattacacaaatattggcatgctactttctaactgcacacacaaattctaaggcctacagtactgccaaataaacgttccagtttattaagttagggctttacaacacgaatggcgagcactatgagttactaacaaacatatatttatgtaatgcataaagacatcacttactatttctggttggtgtggtgattgattttgtttaattgctcatgtagcaaaacgaaattgacggctccaacaggtgcaagtttgcaacgtatacacaattgtggagacaaatagcgatgagtggctcactcttgtcataccttgtattgttgccccaaagaaaaccttaatacttcctccatttcacaatgtaagtcattgtagcattttccatatttatattgatgttaatgaatctagatagatatatatgtctagatttattaacatcaatatgaatgtgggaaatgctagaatgacttacattgtgaaacagagggagtatcagattgtagatcttgcattttttttacccttgcataaggtaaatgtggacagtcctgctttagaaaccatgctaaagtaacttcatcattctacagttaaggtatttacataatcaggcaacaacaacaagaagtcaagaaggtaataagactgatgagtgtatgacatgaatatgatcgataggagtctaaccagtgtctcgtgaaagctctcaaccaaggagcgagaaaaatctccccaccgctctggcccctcttcctcctcggctccggtggctcgccccggtgatgggagaaagagaggtcgggtcctccttgtagttagtggggcgggttttcccgtagtccaagttaatcttgttttttaaggttcagtggaaaagcttaagaggtggttaagttccctccgtggcccagttttcagggggaaaacccgggggcccctttggggggcctttccggggtttgggcccaccctttttccaatcacaagggggtccccaattaacttgggttgcccgggcaacattttttttccgggaagcaagttcaaaagcagaacctttttcattgccataagttgggactcttcatcaagcagttgggttttgcatgttgtaccaaagaagctttaacctctacacaacagaggccctgtttgggtatgtgttcttggtttgttctactgcaactgcttgtggtttctttgtttccgccgtcagagtgatcgatttggctgcttcacatggaggatttgcaacaacgttgactttccttgttattttttacagtgttattttgcggtggagctgaacttttctttgattgccaaggccctaacctcctatgtgaggcccttgttggatcatgctaaggctagatctgctgcagctctctgtggacaccccgagtattataccatccagtgtccaacgcgaccaccacatactattggagaagtgggatccatacacgcataaatagccactcgtcctcaatgtgtccatgatcgtggttgacaaccttctgttataataatcgaaatgtcgagtagtgagcgcaagacataaccgtaagatagcttgccagtccaccacgtcatatgcttgtcaaccactcgaaggtggcgaccaaaagcataccccagtgactcgatccaaagtgctatccccaattatctcaagcgatcaaaacccgttactcatgcttagctagtccccaggaatgcgactagcctcacactttcatcgcaagcaattaataaacatagcaagtaccataatagggttaaagtgcagcgaggtacatgacacataaaagggtccgaggtcccaacatacaacacataaatatagcagcggaagtctcaattagagttcataagcaaaagataaaaccggtggtgccacaactccactagggcaaaccaaccgagcaagagccaagctgcaagagatcactcattgccctcgccgccctcggcagagcaatgaccacacaagaaacataactcataaccagaatcctctcctgaaattgcaaacatcgggttaagtacaagattgtactcgcaagtcttacccaaaattatatatacataagggagagagaagtatgcaagctttctagcctatagtgggtctctaggttcaacatttgcataaagctaattttattgagcaattaatgagtaaaataagcaaggacaagtaaatctagcatcattttaatttatggacagcaagtatataattctgaaatgtataagcaaatgagcccaaaacggcgctctcatcatcaaccatggactaccaaagtccataccaacatggcacaacatgccaacaccaccatcaaacataatcccatccataataatccacatttgatgctaacataactgactaacacatcaagcattgtccataactaaggacgcggctattcgaatagattatactctgaccagaggtgtacaactggacccacacgaaatgaacaaagatcaaatgctacacaccccgtcgagtgcggtacacaagtgattcaagctcattacatgccctttcttagccccaccccaaccacctataccacgctggggttctcgatgactcagtcacgtgcgtgcgtgatgtgaccaaggcgggcgcgccacgcgggaggcacccccgaccaaacctaggcacccgaggccctccaaaggctacctgcctcacgactctccaacgtggtataaatgatcacagtagaactagtaagaacaagctggtcccaaataaggcatgtggtaagtacgaagggtgcttaaatagatgtcaaaatgttcggtccttaatgacctagacggggctacttgcatcaggggaaaccaacctcccatcatcgccctatcacccgtccaagtccaacatatttcatcaaccattatttagtgtaagtgctcaagttttatgcccaataatgcaagttgtttatataccacaattaatagcactgtccatccctatagttctattagcactaagcatggctaagcattaatgaataagaaatcccaagtaatcccaaccagtggtaataggatataaggacagcaataacacaagaactaaatgcataaataggttctacacatacaccataaaccaacaatattcatatctaggcaatgcaagcatatatatacgtatagattgcaaccaaatcatttctagagaaagtataggttctatatgcttaggtgcttgccttgctgctgagggtagtcactatcctccttgggatatggctcgttactctccggaatctccgaatctatcgaaaagaagcaatatgcgaataagagccaaataaacatgcatatgcaaaatgatcgataaattatgaaataaatacagtgggtagataatcaccagattatcacttatggtttgggagatatgaaaatgacaagctctcaggtgctgaaaatggcaattctgtaaatattaacgtttcctttagtacattacaagtaaaattcatttcaaaccaaaatttcataataatgattatttttagagtaaagtacatcactcacagctcctaagaaaaattatttcacagctatatgtgttgtcattatttatttatggatcttacaagttagaaacataggaatgctaaataaactcctaaacatgatttaagaggtagtttttccaaaaacaacaccataacagcaaagagtactaaaatataagctcaacaaaattggtttcacaattttagcttttaccaataatttcttacgaatttcataagagctagaccacacaagggatacatatagctatttatatttttactgggaaaaccagtacaaaagttggtcatttttattttacaacattgaagatcacgtttttcttaatccacagaaatttggttcagctcaaacagagttcagatgaattttctacgaaaaatttggttagggcagcagtaaatattgctagcttttccaacatttgagatggcttttcgtggtggcattcttttacaggacctgtaggttgaactattacatgtggatatgaaattagcaacatgctagatggttcagcaaaagcttgtttgtagctaaaaaaaaaggttctagttagtgtgggaaccacaatacccaaagacgagctcggttcacttcacaatctaatagaggtccaatgggtgcagtggatagacatgcatgagagcactctaaacctacaagatatgagttaacacattcctacagaatgtgacacacacaaaagaaaaggccgtaccaagagagtaaaccgaagaatctcagggttgtcctgcaatggagagggacgagttgcagctaccacttgcctccaaatcttgaatcgatgacctatggaatgcactagagatgaccaacacaatggagaacctcataggggagccatggatggagagggaaactcataaatcaatggaaataagttctccctgctgctgtaacctcataggctgcaagtggcttgttcttccttcttctcgatctctctcacgaatccatgcatgtgggagattttcggatggatgaggagcttagagtgatgggggtttagtggtgtgacatgcagggatggatccaaagtgtttggaggagatttgatgggaagaagtgagctgggagctcagcttgcaagaaagaaaagatcagacaagggagaaagaaaggggaagaagatgaaagagtttccatagctgcttgtcatatggagctgagttgggtgcacgacctggaggtgggatggggcttgttggagagccgaagtcagtgacaagtggggccaagtcgagctggacccatggggcagataaaggaaagttagaaacataggtacacattaaaaatagtgaattttcaggaattttcactctctcattcatgggtaattagtttgacctagctacacgagtgtcaaaaatgtgtgttcaggtgtggagatagattgagttacctagtttccatttttcaaagttacactcaaaaattcaagatattttaattctagcaaaaaggtaaaaagtggtatgctgagaactaaattgaattttaaagaggtcaaaacggagagctaaaattccacaaaatttatatttgttggtgataaataacctagtatttgaataaattattaaacatgtatacttctgttcaagttattgttcaaatagaagtggtttcaattttaccgattagagttaattttgttatcgcgtatgattaatttgcaatatagtaaatatgcaatctaaaggacaacaaatgcacttctaaatacctggttatgagcctagggctgttacatctccatgcttgtattcctcaccgtcgtcttgaacatcatcgaggctatcgttgtggccacagcttgaagacagacttgaatacttgatcgcttttttgatcttttattttgtccttccatgcttaaatctggacctctatgtaattcacccttgcttaaggagctgttatgcaacactagttgtacatccagttctcaaataaataaatatggagtctgttgcctctttgtcttaaaaacaaagaaggtaataagactaaaactatggaggcagtaaactaaccttgcaaaagaggttcagtaaatctatacctatactaatcgggcacttttttggagctctcacgttaatcaggaagatcaagccattgattaaacaaaccataatatgtcaaccgttgattacaatctaatccaagttccacgcggtgggtcttttaaagcccatgtaacctatattgtcaagcccatcgatatgatccattcacgcacgcattctttttcctttttctttcgaacgtgggtatttgtttctttttctaaaccgatgagtccatccatatttactgagatcgatctgatcagatgcagtggaagatacgggagggcacggcatgggcatcgcgccggccggcagcggcaaacgacggagaaaggcaggaggaaacagtacatacaagcacatcgtacgccagttatgttctgctcgctcggccccggcaaaggcgaatatatcaacgttatcggatctagcagcacacaatcactaaggcgaggttgacgtgcggccggtgagcgccggaaaagcacacaacgtcagccgaatgctaattggtggtttctccattggtaagggttgattctaacttctaatttccagttcaattctctttacatgcatacttctcatctgggacagcgtccaataggaattaatctacatcatcaccatactgtatatatttttgatgttcagatgttgattcagcatcaacaagttcgctagcacctgacaagccaatccatggtcatcgtaccataataattcatagaagtcttccatctatttgctttgacaaatccgctggcatttaggaagatccatagtggtcgccgcatgtactattcatgtaagtattccatcaatttgcatagtctaactttttatctgtatttgatctacttttaccattcttcatatattcactctctccttaaatataagcgatttcaagagattaggaatgaaggaaaaatgaagataaagtttaaaaaggggtgaaggggcagtagaacgatggttagggataagattgatcgaaaaatattaaatgagaggtggctttacaaagttctactcttaaatccttatatttgtggatagaatttgaagtctaggatcaaaaatatttgtggatgaagggagtatatttgttttaaaatgtatttttttcctatgtgatatgaatttgctacccttattattatattgttaaaaacttttttcatatttatgttcaaaaatatgttcggactttcctaaactatccccgcaaaaaaaaactctccgtatattatttagttgattttttttataatggaatgtaacattccggcctttactcaaagagctacagccaattattacagaactcacacagaaagtttacgatagcaaaaacaaagctaagcaaacacaaactaattgacaccaacagaagaaaaagatcccctaactactgaaatctattagagaacctccacccgatattggcaaatagatgcataattatattatttagttgattcatcagaaattttgtgttatacaggtggtcatgcaaaggcaaagggcatggaaaaaaacaatagttatgcatgtgcagtttttttcgataataatgcatgggtggaaaatagtaatagatatgcatgcgttgcttcagtaatatacatgcatgcatgaaaaagacaaatggtgtgcagtgaaacatggtttattttcgtccctattttccaaaaccatggaaaaaagaataattccatgcattttgctgatcctactttatcctaacatggcacacaatgaaaaattattggacacggaaccaatccatattaacattatggtaggacagtacagcagagttcttgatttggctcctagaactaatccattaatatttatacgtagtacatggtttcctcttactatatgttaatactatatgttatttgattttgatcctttattatgccatgttctcacgataaataagtatatatatgtgtatcatcctatatcactataatctgttgcatgcttcatccagttgaacaatttatgttttcattgatattcattacttcagaaaaatacatcattcctccaacaaattcagatgaagtacttttcttttaatcaatgttgagggataaacatgactaaaattgttttatgtattattaatctaataatagtatattgggacattgtattaagaaaatatgccattggaagtcatactcaaaatgaattaaaaaatatgaattttatcgttttaagtattctattgattaggaatcaatatttaacaatgtatatttcataaaaactcttattttaatataatctaagagccattgtaattagaaaagcccatatatttatacataactaaaattttaatatttatgatgatataaataaagagcccgtgcaacgcatgggttgatggctagttagtaataatctgtaacagacaaacaacaagactacaattggtgtccattgttggtgcttctatgttgcctgcttgccctgggctttgtagtgcccatccccatggcaggcacactgcacacaccacacgcgaggctaataacaatcgagcgggcgaggaaattaggaaaacacaaggcccctagtcctaacggcatgcatcgcacgcgaggccaactgcagcggatctgtcgatgaaggccataagggtattgactctgagcggatgagctgcacatgaaccaaccgctacattgtcttcggcaccggtgataggggtgaatgaagcggcggcggcgggtgggtggaggaaggggtgctagggattaagaggagcaaagcaaatgctaggtccgaggaggccggcgggacacgcaggtgggagggagaaggggcgacggggagctccgtactcctcggagtcggaggaggagggagccatgggtgggaggggaaggagagatgcggaggggtctgcgtccaccgatcccacaacttggtaaggccgtgcaaagctgagacacggacggatagatgggttccagatgtgggatcgaacgacccaaaaaaaagatcctggtaactaccgtcgtacaaaatcttgcttagtgatgcgccgcaaactaattggtcagccggagctaaaatctgctctagctggctggctgcggcaaagctaggactaggctgccttcggaaccctgtgttccagactgtgcgtacgaaaaacggagtggtctattagcgtatcattaattaagtatttgtaatttttttttcaaaaatggatcaatatgattttttaaacaactttcgtataaagactttcttttttgcaaaaaacacaccgtttaggagtttaaaaagtgtgcgcgcaagaaacgagaaggagaagttgggaacacatggttccgagcgcaagcctaagggtgattagatgacctactgcttatttattttcattcatacaaccgtttcatgaaatttggcatatgttgtctaggattcttcaagtcattacaatatgtagaagtgtaaagtgaacattattaattttgccctactaattatgtctttcatagttcaatagttcatggttgtgacactattctgctgtatcctttctttgttggattgtttcttcatattgccagaaatggcaacaaagaaatgagaagcaatgatgcttgaaggagcaatacattttaaggcttatgcatccataatgttatatttttagtcaggacatcattctaaaaatatttttctgagtaattgactagagtacgaggagtcaagagaatatcacggaatgaatctctactacttaaaattccgtagtgcttgtggtgagtttggtatcctcccatagtgcttgtggtgagtttgggatcctcccaccaaatcaacgctcagatgccccatccgcgctcgcatcgcgctgcatccgcgctccgtcgcacgcgcggcccctcccctttctccgccctccgtcgcggccgccttccaacccacgcttcccgctcccttcgccgccggccccactgatcgcgcgcctccgcccctcgcgccgatctcctccgcgggcccctccgcccatcgcaacgatctactctgcgccgcccccatccctcccctaaccatcgtcgaccccctccccttccaacctcgccggccatccgcccgtcgctcaatgcccgtcggagatcgccggccgccggttcccctaaccgccgcaatcgaccccataccggcgccgctgcacatcctgatcaccgggcaggcgcctttcatccctcggccggtctgcgtcgcctcgccatcaggtattgcttggttacatcagatgatccttctttagtattgataggtgcagacttgcagcgtttggttggactgaacattttgtacctttcaggagcaagaggttgaggtgtcgagcgcggagagagaggcacccaggctgacctcgctggtggcgacctggtggtctgtgtgacctgcaagtgtggtgtccacaaggagttcggcttcgaccattcccactgatcaaattagccagtccccttattccatcctcactgtcaatgtcaatttgttcttgcaaccggacatcaggcataggtatgttctatgctttgtacaaatctgctaaaaaattacttcacaattaatacaaattcagttgtcggggtttttcccccccccaaagggaagacaccaatccccccaaaaaatcttggggcccttaaacccccaaaaaaaaaactttgtgaaatgattattttggattcatggacaagcagtctttgtaatatatatttttgctgacatggcacaacgaaatgttgttgcaaatcacagaggtagttttacaaatccaaaaaaaagtaagtttggacacattgcatcccatgactgaatttctttgaaaaatgactaggcaatgaagatttaatcacagtgctgcctatatatgataccgttccctttgtgagatattctcaattcgcagactgtaaagaacagttgaagaactaatcttaaaatgaacttcgataactattattcatatgatttatagcgtaattctacttatttcaaatgcaattattacattcagttgataattgtttataatggtcgatttgctcggatacattatttaatttctgttcatttcagaatgttccaactattgaggaaggtcaacgacaggttgagttttgatctaagcattacaagatccttgcgtgtaagtatcatatgctcacaacccttttaatttagtaggatattgtggatgctcagacctttgtgttcaatttaaagattcttggactgtttcctggaatataatggataagatgtaggctcatatcttattctgtttgagaattcaaaattttgattgctcagatgtatgccaatgcatgtacatcttttttttaggggaaagcactgtaggggaaactcccacagttaaaggatattattaaggtataaaaataataaagtattacacctggtttaacaggaggttaatgtacatctttgtattatgaaagaatctattatcctactttgatcgcattttaacgctataatcactaaggaaattggacacactacatgactgagcatctgagacacacatgaatctgtagattaatagatcaatcctttatattcacaaaaaaagtgttctactacccttagatatgcataatagcattttttttccagtatgcctggcattttctgttttacgcatgtgacaaataaataattatttatactaaaaatcaatgggtattggtaattaatgttgtctctttaagtgatttactgacgtgcctatctatctccttaacgatacttttgctacgtgattttacttcctttatttactgaatgtttactacttggtggtggagagtttatttcctttaggtcagagattttattttcatgaaacaaaggtcactagggcttcggtggctagagaacttgtcaaacatgcccgacttacatgtttccagatatagagtttagtacctaattggatagagagctgaatggaatgctataaatggtcaagtccaatgatatgttttgatgaacatatgttacccttaaattcaaaagccgtgttacggaaaaaataaactatgtacaatgcagatattgtggtctacttactcgaaatatttcgttggatgatagttgggattgaaaagtagtattttcactcaatatttgttgcatgtgatctgaatctttactacttaaaaaacttgtagtggtggtggtgagtcctgaaagattgaagggctgatatccatccgaggatcctcccgcacaatcaacgatccagactccttcggatagcgctccaccgtattattccgtgtgtattcgttgttgttcctccgcctactctctctcaaacaaccactctctcctcaatgctaccccctgccgctccaagctgccacaggcctgtcgctcacctgtcgttccccatccacaccgccgctgtcgcatccccgttgctcacctgccgttccccatccacgacgccacccgggcctcccagctgcaccctccacacccccccgccccccccccccccaaaaaaaaaaataaaaaaccatttggacgaaggccagtgcacccaaattaccaacatcgcagattgaaaaatctgaccaatcaagctagcgctaccagtttgcagtagtgtttcagatgatatttcactaccatgataaatgcagtttctgtactattaaaactattttgttttcaatatagtaagctcaattcacataaaatgtcttgaatttatatggatgtttgattgttctgcttttgtaacatggtttctcatcaaatggcttcagcagctcacgaagtagcagaattacctttgctgatcttgctggttcaatgaacttgatcacgggttgggacttgggagttggcgactgaggcgcatgcagggcagcggcaatgaccaagtgttgggcgctctattaaggactgcaggttgtggcagtactgcagcagccagtgctttggtggggaggtcataattgttttgtagtatggctcttacggctgtccatttcatgtttatccaatttcagctcaaaatatttatttttatgcctatttcgtgctacatttgtccctcttttaatttttagattttactaatcatcttagctgttcgcttgatctgggaacaaggggatctgtgtaatatagggaacgagcaaggggacctgtgtaactgtgttggaggtcgtgggcttcgatacaaaattaattgggttgcagttggattcatcattggataaatgatctgattaattagttgtatcagtaattgttccaaagtacctgcacatttctatgttttctttactatttcatctctgcagagtgggaattgaaagattgcaatttaagatatttcatttgtgtttcaggtcctaatctttgcttacatctaagaaatttctaatgagaggaagattctcatttcaggtcctcatcctgttattcacccttcatgccaattcatgccaagctggtttacaatgcttacctgatcaaatttgcccatgttcagtaagggaacaatatgaatgcatcatgttggtcaaatatacttaggtaactgaatttttgtggttttctttcaggtggaaaatttttgacatagtagtgcctgcaatcaaatttgatgatcaaagtgcatgcaggcaggcagggttcctgacctgggcaatcaattgagggaaattaaaacttgcgagagttccattttgagttaatagaaaaaaaaggatattttttctatttaaattgacattttccatgagctaaacgtgaagtagcttgattgaatgcaagatctgattggcagtatcacgcacgtaatgcttatcgagattgttgatcttgcttgatgagagcttttgataacaaagctttgctgggcatattaatcaccagaccagtttgattgtttcacgttggtgcttgcgtcctaccagtattatgtactgaataatgtttctttgctatgtccttcactgatttactgattttggtaaattgaggcttctactgcgctcgatcttatcaaataattaagcatgtagcgtatgtggaatgaaattggtgggtaattaatgcccaaaccttacatgggtgctgctgccctgatgtgccagggagaagaaattgaggcagttatatatggtcaagatcagctaattaattagcaaatgcgattagcacccttgtggaattattatttttgttcttccctatacgtgaacgtctcgacgcatgttacaagttcgttttgctaactcaagtattggcattagcactaaagcggcattattttatttcctaccatgattgatgttttatacaataattttcgtttttctcgttacttaatactatttggaaactataaaatgtgatacaagtattatgtatgtattaaaattttcatatagtaagcatagcatatgcttgatatttatttaacatcattttactttcctcccgttgcaacgcacgggtaaccaactagtggtagaaagtaattgtagtagtgtgaagatatctatataaattttaaattttgactttgttcacgtataaatgtgtcaactaaaaagaaatttgcggggtcacattaaaaattaattaatgactgtcgcattcatatcatgccccaaaaatcttattgctttcatttatactttgtagatttttttttctatggttgtatcatataataataattcggtatgtgaataggtatgtgttatttatagaaaattctgggatatgttcactgcatacttcggctaacttaactactattaacaatcctccctactaaaatgtatatgcacgtttctttctttttataaggttataatgtatattatacgtggtctgtcactctgtcatacaaaaactactaccttcgtctcaaattaattgttttttaaggttgtttggcatattttaaggtttagaacaaaaagactacaatacccttataaaatattttatggttaaggatataagggtggttgaggggtagaataggaagaaatttgaatgggatatgattgatgggacaagtagtatttaggagtgacgagtattgtgaatttatagaaaattctggaatatgttcgctgcatacttcgaccaacttaactattattatcaatcctccctgctaaaatgtatatacacatttctttatttttataaggttataatgtgcattgtacgtggactgtcactttgtcatactaaaaactactacttttgtctcaaattaattgttttttaaggttgtttggcatattttaaggtttagaaaaagactacaatacccttataaaatattttatggttaaggatagaagggtggttgagggatagaatatgaagaaatttgaatgagatataattgatggaacaagtagtatttaggagtgacgagtattgtgggataaaatttgaatggtagaaagacaactaatttaggatggtgcatttgtgaaagccagtttccggagcagaaaaaaggaaagcccaatcacgcagagccgcttgttgctccgtgctattttttcgtttctggattccctattcttgtcccgtcccattcctttttcccttttccttgctgtcttcctcctgacgtgtcatcgtcggccttgctgcccatgacgcgatcaagaaacgccaccgcccctccgttcttccagagatcgaatcttgggggatcgagctagttggggttagcggtgtggaagggtcgaaaatccttggagacattggattggattgcagtggggcggacggcggtgggcggggcttcttgtaggctgggctgtaccagagaggagccaagacggcggcgataacggcggcaccggtggcgacggcgccgtcgccgtcggagggtgggggaggcgggtgcctggattgtctgcaggatgtggttcgggcgctgtcgatggggacatgccttacgacggcggagcagcgggccatggaggtgccggctgcgtcggtgaagggaggagggggcaggaggagtgacgaggaggcgcccggcaggatcgcgggtaacggcgcggggaatgtggcctgcctgttcactcggcaggggaagaagggcaccaaccaggatgccatggtcgcgtgggaggtatctggaccccaagatctcgaatccctttcttcttttgttcactgctcgtccacttttcagttgtaaacgtgagcttttttctttgtttaattggcaaacggatctaacttgcatggattacttgtaagttcagcagatttcttctttccttatctttttttttgcggggaaaggttcagcagatttcgtagtattacctatgtgtagtggcaattgagttgattctttctaacgaaaaagaaaatttctgatgcctcaataatttacaagaaaatttaaactgttgtttgcctttgtaatttttcaaatgaacattttttatgttaccaagcgatgaaggtaaatctacattatctttgtttgctgtagtttatcgatttgtttctgttattttacgttgttcactaatacaaatagcttgtttataatatttttggccctcaacttatatttctgatgtaatggtctatgcctgataaaatgctcgcagaaagggcagcaacaaaatgttacttatctggtaccattggtgagctgtatatataaatcaaatgaatggcgttattttgaattctaccttttctttctaacaactccaagtcccaacttttgctctctaacctttaaatggattaattacatgttctctaagtatcatgaatgagtgtctccttcaacacttctgttacatctttcttatgtcttctcattatgtgtactattaacaccctgtgaacactatggaacaatggacagaactataacggaagatcagacacggtattttgtggagtttttgatggccacggtccacatggccatctcattgctaggaaagtaagagatattctcccttcgagactctgtgatttgatatatgaagactgtggggatagtccaaccagcaattcagatgtctcaactctggaagagaatttatctccgtatgcagatgcagagtgcagatctcccacattggctggacaaaaagaacatcaagaattcttcaacgcaatgaaagaatctttcagaaaggcttttaaaaatgtggataaggagctcaaattacaacggaacattgatagcatttgcagtggaactactgcagttactttaatcaagcaagtaagcagtttcctctttttgatgtaacaaaatatatttactattacttaagaatttcatatgcagactatctaaaatcgtgtctatgccatcagggtcatgatcttattgttgggaatctaggtgactctagagctgtattaggcaccagagatcagaacgataagttggttgctcatcagttgactgttgacctgaaacctgatcatccaagtaatctctttcactcctaactttaagttactttaatcttctgtattttctcttctaagacatgatgcattgagcaagttcaacttggatgtttttatggtgatattaggctaaagtgttcccttgcatttcctttttccaagataaatattgagcaaaaagtatacactgtctttgatttatttgagtgttcaacctgccacgctgccaatgaaaagaatctcaacccaccttggtagactcactgcagactttttcttatagcagcaacactaagaccattagccccgttgatagatctcaacaactcatatgttgtttagcacatgcaaatcagcttaatattatgcaatgtgtgaacacttggcttaattttatgctccctcctgtctagtgtttacccctcagatgctagataggtcgccgggtggtagtcgtgctgcgccttgtacaatgcttagtagtgaaaacttggcttttctagatgctgcccttgttccatttctatacattccagataggtccttctcaaatactagacaccacaaagtacaacagtagcatttgcacaatgaaagcaaaatagttgacaccatcaatggagaatagaggcagcatgttcagtgactcagaagcctccagcagggtctgataggactatggtacacattgacatcccttacagtggccttactgtgatcctagtggaaaaaaccagatcatacctgcggtttaaccaaaaagaaccggaaccagctcattgattcaattgtgtccaaagatcattcgtgcatttgtaccagtttacaccgcctggtttcgaggtatgcaaagcattaaactgggactagttggactggctggagagagaagagtgtaaggctgaacaaaggtctatttataccttaaggcccaagggtgtgatttgacccttggtctagaggtttaagtcagtcaccctttaccatgacttaatcaggaaccggtgaactgacagcttggccggttcatcttctccagatggcatggatgtcaagaaagatgaccgctgtcttgttattgccatttctattagttatctaaaaataccatattaactttttttatgaaatgttgtattggcatacccatattgctgaaggaaacattctgttgctagggatctaccaagagtaaaagtttacattttgtaccgatattttaatagcgaatcttgtgttacaagattaaatcactgtaactgctatttgccattaaagtcatctgtaagagcatctccaagagttccctaatgccagctccaaaagataaattttaggaatctagtctaaaaccatgtctccaagagatgcccaaagaaggtcccaatatttaccgacaccctaaaccagaaccgatctgaaccaattttggacacctccacgcactcccaattgatgaaatcgggaggtttttgctgctcgcgccttttcttcccctgtcgtgccctgacgcgagatggccaagccctggccttgccccccacaacgtgccttgcagacttgtcaatgacctcgccgtctgctgccgcagctgctaggtacgcgcaagatcaccctcctgcacagcatagctgagcagctagcgtgccattggttggcagcacccagctccgatctccctcttactggaaaaatggaaagacaaaaggttgaagcaggatctacttaagatgatgtggcatattattattgcaaaccaaatttaggcgcactcttggagtcggaggtgatttttgggcccaatttcttttcggatggtcccaatccaagatttttaggagttaaattttaggatgctctaactaccaattaatggtgtgtatgtatggtcagttactaataatttaaaacaaaaaagataaaatgatctcttccataggtattttgctacctacagtactttgttttgtacctgcttgtgctaaactgataatgtgtaaatatgatattgagtaaatcgcatactagaccaccattttttgccatggttgcagtttggactaggggctaaccactcttttcactttgagctaggaatacttgcaaggtgttgtttttttttctcctcctagacctgttcttcctctcccctgctctctctctctctctctcatgttcttcctcccactcctctctctcctgttttggtttgagcctcaacgtgatggtgagcatctcctgtttgcgtcagctcatgggatgaaacttctgccccaccatgatggtggacagaaaggggaaggagaactcaaggaagaagaacacaggtccagagtgcaacttcttacaagaattcctagcccaaagtgagaagagtgggtagcccctatttcaagctgaaattattatggtaaaagaagatgctaaaatgcaatttactctatgatatttgtacctttagatagtcgttggcagtaagcacaattatcgtgaatcatcatattatgttcataatatcatattgataacgttaagcctgtgaaatagaatgtaaccagtgcagcatctttaacatgctgacttgtcatgggccttgggccaggagactgaggcccatgaccaagcccaagaggaaggcgtggtcaaccagggtacacgtgttgtgagcatgaaggacaataggcacacactattaccatgtcagaggaggtttccagagctaggggattatattagattggattattaggtgccagtctgtataagggtactcggcaaatgtataagatcgagcaatgaagaacaatctataaattgcccagttcatcacctcagcttatattcctcctcaaatccctagcagctgaatgcactactatcctcccagtagagtttattgccaatgaaaccttgcccggccgtaacatggttttattagaatgaaagacaccaaaatacgatatgaagactgaataagttgatgaagtgaatcaatgcttaagaagatgcaagcatagaataagaatataaggtggtaacaactgtaattgatgttgttcatcgcacataaggatggaatgatatatggtagaaaaacagagtatgttcaacttaaatcacatattttaattaattttacagtgagtgattactgcttatgttttgcccatcctcattagtcgtttttctctgtatgatctgtaaactgtagtagtagatttaccatcttcaggagatgcaatcttcagcactcattcttcaagaaagaaattcaagaattcaaacaccgattataaattcaaagctatctactgtgactcgtattcttgttaccctatgtttataaacttttgttctcttggacagatgatttaaaattaaattatcatgcacaaagattgtgcagtagttagcttgtttctttccatgttatgtatcaattcctttcacagcaagttctgtgttgtatggttatttgatgtattatatcttgttgactcatcatccatcagaacagctattctgatgagactatggttctgtgcttctactttagctatatgttttgcatgtacttttacatcttagttatcaaaaataaactctaggacatcttgctaggccagcacatttttcttgtgaatttttttcagccgttagtctgttgggaattgtcaccttgctccagtctaaataaatacaattttgagcataatcttgaaaataataacataatgatattctttccaggggaggctaggaggatcagacggtgtaatgggagggtctttgctcatcaggatgaaccagatgtggctcgcctttggcttcctaattgcaactctcctggactggcaatggcccgagcttttggtgacttttgtctaaaggattttgggttgatctcagtacctgatgtcacctataggcaaattactgaaaaagacgagtttattgtcctggcgacagatggggtaggtaacaaaaaatgattaacaattattttctaagtggcttcttcaaagagaagaaatagttcttaatcaaaatatgtacttcccaatttaaaatcgttggactgttttgtcttggctggctctgatacactattattttacattgcctacaggtgtgggatgttctctccaaccaggaagtggtggatgttgttgcctcatgctctggtcgtttcgctgcagctcgttctgttgttgatttagcaaatgagacttggaggttcaaatacccaacctcaaaaactgatgattgtgcagtggtctgtcttttcctgaacaagtatgaagttaccggtggtttatcagggcaacctggatatagtccaaggatgcctgccctatcaggtattacccggcccaatagtaaaagggttactcctgacgacgtcgatgatggtagtgactcaaacgtaagcggagatgagaggtccttggatggtttcactcgattgaacacattgttggcactaccaaagtttggtgacacaagtccaactaagaaatgagttggtaagcagatgagttttgcaggtgctttggacaagagagcatatcggctatattagcatgtccggtgagctcccgttctgatccagcttacgatagctaagaatgagtagggttgttttttttttttcatcctaactcccatttggttacgagttgacaattacgcagcaagcatttggagtcttaactcttatttagtcgagagtagacttaacctttttgtatagctgctcatcgattttctgtcttattgtatgtacttggcgattatatgtggacaaatcctactcattcttatggtaatttcgtttgtcggattatgacagttggaaccttttgctcaaaaggttcgtatgcgtttctaaaaaaagggggttcgtatgctctagtcgcatgcaactatgcaagccggagaaggtctaaaaggccaacgataggggtaaaggataaattccttatatatgaaacggatgtaattacacagctagttctagctggtttgtctaatacaagagacaccttccacctatacttcaaatataattttctcttaaactactcatccgatctacgatccgattacactgttgtatttgtaacaactaaatctttataagaagatctcacatgattatattttgatgaaaaataataaattacttttataatatatctaaattatttttagatttcactaaattacttcttagacatattaaagtaaattcaataaaacctaaaagtaatttacatatatatatatatatatatatatatatatatatatatatattatataagtaagtgttaaaaaagaagttataaagaaagtaactttaattaatgcctttctttattgaacaaattgtcatatatataagttacttttagatttgattcaaatacttcctatacattcataatgctttgaggtgattacttttattattgtttttagttaattccataatttgtgctgattaatttaatttcagatagagttatgtttttatctctacaatggatttacttcaaataacatgccaaagttgcctccgttttgttctaagttacttctataatatatgtaaattacttttagattttactgaatttatttttatatgtttaagaagtaacttagtgaaatctaaaagtaatttagacatatcataaaagtaatttgtgatttttcatcaaaatataatcatctgagatcttattgtaaagattaattgttacgaacataacggtgtaatcggattgtaaatcggatgagtaatttataagaaaattttatttgaagcatagatgataggaatattttccctacttacttaatagattagattcttcaagttaacacatatctgaattgctgctgataggggtcgctcgttatgactaaatcgagagtgctatcaatttaaattttgcgatatgaaacttggaaattacgttgaattcagaaatgttagtaggatatttgtccatgtacaaattatttttactcaaggtggtgtggacaaatctcaagcgtctttttttaatctaatattagtttttaggtgtccattatttttatttgtcgtttatcctcagtccatccaaaatagatatgcaagtggacaacagtttcattagaagcataacaaaccaccacttgctagtttatttcctatgtaaaaaaaaaagaagaggaaactaccaatctagcgcctggttccctaaaaaaattgacagccacggtggaatggatttcaaaaatggagatcacgatcgttgtctttttcctcttgagcagcaggccagcgctggcagagccagaactggttcggccaaaccatggtttcagtcgaaccgttctggtcgccaggctagccaggctcaggcaaggtgctgggctggactaagtccaagtatagctcagtagacacataggatacatattaaaattgaccaactctataaagtctgcatcctgccccaacccctttactggttctaggaaaactttaaaacgatggccatttaccttaaaaatactaccttcgtatccgccagcttgaccgctccgtgtggcaaaatatgtagccataggatacattttacggttgcaatcctctgatagaaggccctcccccaccctgatccagggggggccgccctccctcgccccgatcttcctctgtctcctgaagcggtgcctcccgctggcttcagtcgtcaagctcggtggcggccatatccgaccgccatgagctcgtcggtaggccgatccagctgccatcagcagcaccagtataccctgggacgatccggccaccatcaacaacaccaacatcatcttagctttctttgatggatgtggtaactttctgaaccaaaaactaacccaggactacctaccattattgataatcattctttttggagctttagtgatctttaaatgaaataatccaaatttagccgaaccataattttctatgcaggatcttagatagaaagaataaaaaaaatatttgcttcattgtcctaccatggaaattaatttagatagaaggtaacgattacaatatgcattttgtactaagcttaagaattgatttttcatacaatattggtgattgaataattgcttttacaaagagatggcatgaggcatgtcattttttcttttgtggttacctaatgtttttctgcatgaacatatacaattggttgagcatcttgaaaatatggatctcaatcgtatcctttttacttttaaaattttaaaatcaattcaggtgcaccttgctagcagctagcttcaaattggcaagttcaacatgtgtttttagttagtttgttaatggagtttttgttattttcatatttaatccagtatacctatactcatcaaactaggatatatatggtctttgttcccattatgctgcatcctttctcccatggattaatttgatggtaacttagctttactgcatggtttgcttatgcattttctattttgtttgatagcttttagaaatagatatgaactgataacttgacaagtgataaatcaaagctattttggtcttttcctactttatctaacttgcacttctagattcacaccttttggagtagtatagaattcaactgaatttttggatgctattcatgtacttgcatatttttagatttgttttgagtatatcgatggttctcctaccatggcaagctgctatatctgactttggattcagacttatgggcccaggtattggttatttacgttttgctataatcacattatactaacaagctgtatgtccagta

SEQ ID NO: 28180 - DNA, 943 bp, Oryza sativa
acataggatacatattaaaattgaccaactctataaagtctgcatcctgccccaacccctttactggttctaggaaaactttaaaacgatggccatttaccttaaaaatactaccttcgttatcctgcagcttgaccgctccgtgtggcaaaatatgtagacataggatacatattaaaattgaccaactctataaaatctgcatcctgccccaacccctttactggttctaggaaaacttttaaacgatggccatttaccttaaaaatgctaccttcgttatcctgcagcttgaccgctccgtgtggcaaatatcgatgacggtgtacggttctagccatttgctccgaaatttcccgtgaccgaagagctttgccctagagctgaactacaacaccttgtttcctggttcaaactcgttgactttgattcacctgtcatgccatccactggtggagaaaccatctttggtcggtctggcaaattccacaatagtcccggtttcaaaaagaaccgggactaaagattatttttagtctcggttataaagattttaatctttagtcaccaactgggactacatggcctgtcaaaggcatgttagggggctgaggatcttaccactttagccctggttggtaacaccaaacgggagtaaagatcatttagatctttattcccggttggtgttattacaatgactaaagatatatctttagtcccggttaaaaactccaaccgggagtaaatatttctctcccacatctaatcggttaagtcgcagaccaacttcctcctcatcagattctcctcctatctatgagatatagctccttgctgtgctctcctgcccttcctcctcctcccctctcctcctcacatccgacgccggcgtcggcgggcgccggggccacgaccagcgtggtgggcgccggggccgcgc

SEQ ID NO: 28181 - DNA, 35503 bp, Oryza sativa
  unsure (1)..(35503): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaggctgcaggaatacgtcaccacccgtcctcatcatgagatggccgagtggctcatcctgcagagtttcttcaacggattaaccccctcgtcctgggatcacctggatgctgctgctggagggacattcttctcaagaacagttatatgccaaccgattgagaagatgctctcaaataaggggtggagcaaggaacgactccaaacccgtcaatgcgacatgtacaccgtcaagtggacggaaatgctagccgctcagttggatctccttatgaggagactggacaacaatgagaaggacgccgagcagggtaccgttaaggccatggactctcacaagacatgtgaggtcgatggcaatactggtcactctggcacggattgtcggaaaacctgtgagaacgtcaagctcatgaacaacaacgggaatcgtccacaaggggaccaaggatggagcattgctccatggggtagatcaagaacatatcgacacacaaggaggtcaaagtaaaaccccgaaggacggataacttcaacactttcatgatgaacttcctggagcgggaagaaacgaggaaccgtcagtaccttaagccggcatccaagaaactggaaatacaggccggtcaacctgcattcccagtttcgaagaggccgctgcccgcacctatgatcaggaaggtgtggcgggttaaggagaacacacccgttcctgtacctccggaactgggtgcctcatccagcaaaattcgttggaggtatggtcgtgctcatcggacctgaaacgacgtcgcccttgccaacaggtaaattggtagtaatctcatatttattttccattgcatcaaagcatgtttgaattttcaaatgcacatttagatttgaatttgaggcaatttcttcaaatgattttttgtgagcaaaataaaatgcaatttttggcaaaattttgcacagccaccttcacactagtcgttggagcccaatggctaaatgtggggccgattgggtccaccagtggttcggccgaaccccttggttcggtcgaattggcctggtaccggctggttgcaaatttctgcagggtagtggctagtggggcccacatgccattactagccgttatccatgcactatatatgcagctcaactgggagagggaggtcacaccactttaactcattttcactccctctcaaaaccttgctgcaaaattcattcaaagttttgcaggcttacctcaaattcacacaattcactgcatttagtttagacaccttgcatatacaagtttgctttagttcggtgcaaggataatcggcgggtacttgcttaacccccgtccgagtagtcttgtattcttgctctttgctgtagctatgaagaaacgactttcgggcatattcaagagacgatcaagctcacggacaagccgacacgataagccgagtgcaccttcttccgcggatgcatccatggaggaggcgtacgttccaccaaggctgtacgacaactctgatctcgaccttgtgggccaccgggaaatgcaagcctatcatatgttgaaagaccaaacgtgtgctcagacctgaccatacgactcgaccttctgaaaaggataggtatggatgctgagtttcatactatttggcgtgctgtaggatgggataaatttgcatgtgtagaagagccgggttcccgtttgcttaccatgcagtttttatgtgccttgctagaggtaggcgatggcgttactttccggttattccgcaaggaatatcacctttcttggaaagaacttagcttgcttctagtctttgacaaaacatgcaaagttaatttcaggaacgcatttcctgattttaacaagcgtatgttttgacaaagtatttcgggtctctcatcctgtagaaagcctagaactaatgacatccataatcctaccttaaggctgttgcataagtttcttgtttcacgttgtttcctagagctaatatccggatagtgcgaactagtcctcttgtatgccatggttaaaaaaaaaatcaaagtttcacccgttcaacccaggatcaagcaatggttagaaaatgtgaagttgtctagtcctgttgagtgtatttctttggtgactcatttagcatgaagagttgggactctgctttatatgcaaatattcctattacccgctcttatgttgatgaggcctatttggttcaatgccacatactcaaacatggtccaaatgattatcttatatttttgtttcccggctatgcaaatgagattacgttacctaacccggagtttcatttgtataactgccgagaactaaccatttctttccaagcggagttgcctcgagaagtcccacgcagggtaacatgacgaatggcgagagaagtacctctggaggcgtcttcctcataaccaccagtgcagatgtatggaaacagttggggcccgaccgtgcatgcccgtggttggacccaattcctgcaacatgacaccggaggttcgtcctggcagagtgccagcgacagcaggaggcatgagccacaggagctgcactagggatactcgggctccttcagttcaagtggtctacctccatcctcttgatgcattgctcagtctcctctcgaggggatctgggagaactcatccggaggatggatacacttagaactgcaggcagggaatgagcaacacaccttggaggatcatgtggtacagtcacgggaacggcagcagtctgttggtgcacagctcgcaaacttcaacaccatgatgcaacaacagcaagctgactggcaagcgtttcactgctaccagggatttgatccccaccttgagccatagcaagaagcaagcttgggggagatgtctctccccccactgagctaacttgtatcacattgcatatttccctttcaaattgcatgtttaaatttttgcattgcatttataaacctgaaaacaatataaaaatttgcaaaatcaaaaataccaaaaagataggttatatttaataagataggttagatctaatatgctaggtaagacatgcttagttcttcatgttgaaatgatgaatagttgctctgttatatatctctcatacatgggttcatggttaagtactctctcaaaaattgaataggagtagccaataattatccggggacctgaggtaagtgatctgagtctaggttgttgcgagatatgagatactaaataagagttgctatgaacctgctctaagtttgacttgcattccggatgttttatgttccaaaatgataaaattgaaagttcctcatttgatatgagttcctaccagagccaaaaatatccatattaattaagtcatatacattttggttacttgtaattccattgaattttgtcaaatctttgtgacttatgtagatacttctcatgttctatgatcaagatcatacacccacttttgcacacatatgctaagcatctacactggaagatagcatccatatcatccaccatatccatgttatcattatccacaaataagctctccatccatgcttcctttccaaagaaaaatcctttgcaaaagtaaaagaaaaaaaaagaaagagggaaaggtatggctatgagaaataaataaaaaaagaaaaaaagagaaaaagtagccataccccctctatgaaaattaaaggatattttggaggaaaagcataagcacaaaggagaagcattttctttatccatattttgttttccatcatattttcccaccatatcatgcacacacactttgcgcgatcttgatcttgagtatgattagtcatctagtttagtccaagtttttgacatagtaataaatgtgaatacaagtatgtcatgtttgatccatttcaagctccacatatgaaccttagagtaggaatcaaaaaggcaaatttggtgaggaatccatattcatgcactttgagtgatctagagaatcatttgaggaacttggatttcttttgcaaaaatcatttgaaaacctccggaataaaagttgaataaagattgggtaactagcactctaattgttgttctgtctcacaaccgctcaagacaaggaaaggcagtgtctcgtgggaatcagggataagggtaagccgccgtgccaaacttatttgatttgagagagagtacccataccttgcatctgtatctttgagatatacaacattgcagcaactcctgatcaacaactaagtctttgttcctttcgttctttacttgggacgagcaaaggttcaagcttggggggttttgttgacggttgttatcgaccagtttcgaccgtcaatattacccaattaatgaagactaactatgcttgcaatgcattattccataaataaaatattctactccaccatatgcttggaaaactaaccatgcaggagaagctatcaaaatggagtagaatcgacaataaaacaatcgatcaatcaaacagacactgtcgagaatcaaacttgtggatagatgggctgagaactcagatatgacatgatcaaataagcccaaaattccctgttctgagttaaggggcaaacgaggaatccacctaccgaattgtgggctgattgggcctggccagggttcggcccaactccctagtttggttgaaccaccagctggcctaatctagcccattttccaccggcagttatctacatgtatcctatgacggttaggagcaattctaccggtagaaaccgtcataagcatcgacacatggcacaatgaggtgtaagatgctctttggatacttcatcttgccacttgtcatgaggagagcaaacatgctcctaggatgcttggagcatctccacactcccaaggcacctcatgggctataaatacccctcctctcattcattccctcacacacctcaagaagaagatcaagagctctctcaagtattgtttagtagttctagtgctattggagtaggaaatagaatagtcttcatagtcctcgagtcttcaggagattccgggtatggctttaatagcttttctctcttcttttgtaagatttattgaattaataaaatatttttctttatacaagttcggtattttattccattcatattacttgagtgccgactttactttatacttgaatcaatatagtcatgtaactagctttccagataggtgtattggtgtgggtttagtgtccgattactcggttgctctatgtcggttgcaaggatgtagagtagtattcagtaatgtaatcgtggtgcttagattattagataccattaattgttgttatatattgcggatgagaggtgggccgctgatggtaacagctcagtacgggtattcctccgcgccggtatataatcctaagttaattcccttgggaggttattcctccttatttagccccggttgtatggtcatgacaggctatcgtaaggaactcggcagtcagaggtggcttctcgaaacaccaggaggacactgggtatgtggtattggttgcatgactgtataatagcaagtatagactaaagatgtatgtatactagaagtacaggaatgatacttttcttattctttctccacttagcttagactatattttagtgagagtagttcttagttctttcttctgtgtgtcaccctacccttttaactgaattaacccctgcgtagactttgacgatgtatataagtaatatataaactattagcatggtactctctaatcatatcttcccttgggataaaataaatacgataccttggaatactcccgggtgaaatgctacaatggtatatccgtgcgcttgcggatcatgtctgtaaccataatataccaggattatttctagtgccattgctgggaattatatttccagtagtgttggtaagaaataccaacaacttcctcatcacttcctatgaagcaaataacattctgcaacagtttaggatagctcaaacttttttgtatgattcaaatgaaaaatctttctcaatgatttctcctctactacttctactaacaagagtagacatgtaaaatttatgtttgttcttgaagggaaaaccgttcgagttgttccttaactcaacaatcatatgtctgagaatctggtttaactaagcggattggaggcgggcattttcatttcaacgtagcagtagggaaagtgatttcggggggttagtacctattgatgaataatcatagtagaatcaaaggtacatagtcaaaaagggttctgacctaaggctatggatgaatcagttcaaagaatttactcttaacaaattcttagagtatttctggtagaattggggagcattaagtataaatatgatacatagccctttcttattaataaaagaataaggaaaaacttttgaattctaccttcatatttcctgctgagatcccaagtctccaagtgggccctcttggccacccatgaccttggctttttagagaatcccgctcctatgtcgtcagacagatccgggcttatcaagtggtactgaaatagggtaaaattcagtttagtagaaaggaaggaagcaagtgaagaaagatgggatcaaataataataatggtacgaatatttgatgattgatttatacccatgtatgacatgcttgtgcatatggtgcatgttgaatgctacggtaggtgatgatatgcttctttttaagacatgcaccaaatgaatgtgggatcctaaaatatgccccccttgtatatcgatgtatgacatgtatgacatgcttgtgcatatgatgcatgttgaatgctatcataggtcatgatatgcttcttttcaagacatgcaccaaatgaatgtgggatccaaaaatattttccccttgtatatcgataatcatatcaaatgtgggatcctcaaatattctcccacttttggcactaatctcacaaaaaaacatttgcaaggaactaaaaaagaaacaattttgctcgagcaaaacaagaacaaacattcacaagaccaaatattttttttgaaatcgaggctcaaagcaaaaattttacaaatggtccatttaacaattactcccccttactctcgtagtctcaacacttagacaaaaagaattagaatggatttcatttgttggagggagtgattatgagcattagaactttctctcaaaatgcactcatcaagtatttttctctaagagaggagtttggtcaaagatacttgacagattcttggtcatgtgagtaatctcggcaatggaatgacaatgattgacaaataccgagttcaagatgatcaagggttagtaccattttatatagacaccacttgtgtatgcaagtgcgaatttggatcaaggaatggtagttggcaatggcaacaagaatcaacttgtatttcaaaagcaaaggaaatggaatatgtaggttgttaatgaaaattccatttgagtttaggttggctcaaataatggggtttaagagcaagaggaattcatgcaaggaacaaatccaatagagctcaaaattgatttaacattcacgtaacatagaactcactacacgaaacaatttttattaagctatcgactcagattttcaacaaaatgaaacgcacttttaaaatttgaattttaaccaaaaaaaaaagatacaaccaagcaagctcttgtagcaacacaaaacttgtggaaatgatctccaaaaacatgcaataaatcctggagataattcatggaatcatgcacaagtttcattttggagtcttgctcatatctcaaccatatagacaaaacaaaaatcataagatttcagcaagctgaaattccagatttttacacaacttaagatgggctttgaaaaagcattcaaacagagtccaaatgagctgcaaaaattaaaacaaaaattaccaataattttcaaatataggggatcaaaagtcataccgaaagctccttccagtttgcaataaattgagagatataaaactcacaaatcagtgtaaaaccatgtcatttccaaattttttttagcaagttcatcaaagtgagaaaaactcgaaactcttccaaatcatgtccaaataagatgaaatcttacagaaatgatctttagacatgagagaatcttgtccaaatgaagtttttggaaaaacatttttctatcaatataaaaaccaaaaatagcattgtaggcctttcaatttagtaaattcgaatgaaagtcacaaatcacacacaaatgtgtttttcatggagtttgacatttgtatagcgttatatgggttagagatactaatttaagccaatattcacattgtactttagctccattagcataacccttgaaatccatgttttggtcattgtggtcattacattacacaattttggatgaattttaaatagctataccctttgaatggttggtattttgagaaaactttgaactagagatttgtttttaatgaccaacccataaactttcgtattagaaatgttttcaaaaacacaaaatattttgaattaggagatagaacattttgaataagaaataggatcatgcaagatccttttacgcccattttctatattattttagaaataagatcttttacttcaaataccttgcaaaaatttgaaatacatattgaagcacttttgggaggattttcacaaaatttggcctcttaaatgagatttttcttaattttgaccaaagaggatatttgaaatagctataaatccaacttttgaaatctttcatattttgaaagcatgggatataaaaatatgattaagaccactccgaattgatttatttcacactttaacatcatgaagtcaaggtttcgaagaaaagaccaagtttgagcaaaaagctacataagcttctattctaaacacttttatccaaaaatgcaaacacaaacaaataagatggttttggtgagaaataaatatgaatgaatgttatgtacttatttgagctagtatgatgcatttatgcaaccccaacaatgagaactcatctaagtgatagtaggtggccatgtatggtctaaataatattttggataagattggaatgtaaatttcttttagttggttggctttttagagaagttttgaaaaccaaaaatgtttgaattagccaaccctatctttttcattttgaaaccattttcaaattccttttgaaaattagctaaaacaagatacttagagctacatttttttttgttgaaattctttttcattgaaaattagctcttctttgaaatataaaagtattgagagatatttgaaacacacgttgagatcatttccaattagatttctcatagaaaagctttttctatagttttcaaaattttcacttttggctaaaaggtttgttttgaaattacgaactagcacttaaccaacttgagaacatatattggtgtgatatgcatgaatatgattgagtattaaatactcatatgacacaacttatcatgctcaagaatgcataaatgatgaatttcacatatgcaaggaaggtaaattcttaaatgctatgagaatgcaatgcaacctatacaagattaaatacaagataattcaatgtagatacatgttaccgagatgagattggttcttgacgtgaattttgcaatggttggctctaaactccgaacttggtgagatccacctttgcttgcataagccatacctccaatgtctctccatgtacacatattctcattttagcacatttttgtccacaagaaaattgggtccatataggttagtcataagagatttcggcacccaagtgagctttgtgctagcatgtggtgaactaatcatttaagtaatactagtgacattttttgccttcctaagcaatttaagattcaaataaaaagttcgggttaagaatgttaccattgggacaatttttttaccaatttgtccctttcaccggcaattgtaacaaagtcgattcttgtctttacatggtgctttcttcaccgcatctttcatcttacttgttgccttgatattaagtttcttccttgatgacataaagtcttcatccttcatatgggggcatgatgcaacttcatgatccttcacattgcatccataacacttcatattgcttcttcttgttctcctcttggtcatcaatcttgttggaacatatcaacgcatagtgtcccactttcttgcacatgatgcaagtactgagagttttgatactactttgaatttgccctttactcttgttgttgaacttagtatttgcttgatagaacttggtgcaagctacggttgatcccttctcaggcttcttcaccatgttcccacggttatcttgagaaggttaagcattgcccacaagtccttgtccttttttcctacataatccaagtcacatgtagtgctcagggaaatgtttgcttcggagcagcaagtgttagcacaagtaagatcaacctgagcatgaggcccatatgattttaccgttgcaattatcacctcatgagctatctctactatggtcatgagaatctgcaaagttcatgatgcatttcttgtaaatccatatacttgctagtgatctcaaattcagatttgagctcttgattttccttctctaaaaatgctacacaagcaattgaattagtggcacaagaaaattcattttccaatttttcgtacttcataattaatgaagaatgagatccattgagtttcttgtgttcatcagatagacccttgatttcttcattcttcttaatgagtcattcatgttgcttctcaataacccccatgagcatgatcaccattgttgtatccttcttgttcaattgatcaaccacaaagtcatcatcatcgcccataaagcatgcatgatcttcggcaatggaagataaacaagttgatgatgtggattcttcacttaaccatttatgttcattcacttcttccttcaaaaggttagttccacaagtactatggaaagtagagcatccatccatatcatcctcatgcacacatttagcgctagatggtttgtatgagtcaacaacacaatcaaatatagcaatttcattatcggtgttgttggagtacaatgggagagttggacaatcatcaaccttattcaccatttcattaccttgcttgtagttgtatgttggtgagatggatgatgagataagaccttcttgatcagaggagataatcatttcagacttgtcaagatgaggcgatgaagtagagcaatccccaaatgatgcttccactttccgctgcatatttaagacattatttatttgtaagacgtggatctgagtttcgactttgttgtttgtgtaccctggcttgtcctggataggggatttaatacacattcttcttgaaattctggttcatgaatttctaggcgtgacattccctttcacattgcatttataacctgaaaagaacattaaaatttgtaaaacataaaaagtcaaaaatatataggttagatttttatatgctatgtaagactactaaattttctatgttgaaatgatgaatacttgctatcttttatatctcctatgtattggttcatagttaagtactactctcttaagttttaagccggaaggccaaatattatctgggaacctgggagttgttaatagaacattgcatgatctaagtctaggttgttatgagatctgatttggtaaactatagttactatggtcttattctaagtttgactagaatttcagatgttttttttctcaaaatgataactttagaaagttcctcatttgatatgaagtcctaccagagacatatactcatttaaattacaaaaacctaatgttatggttgcttgtaattccattaaactttagtcaaatttccgtgacctttgttagatgcttctcatactttatgatcagacacacacttacacgcacatatgctaaacatctatactagaagctagcattcattttatccattttatccattttcttccacttcatccacaaaataaatactccatgttatttatggctctctttccaaaagtatcattcaaaatgaaagagaggtatggctatgcaaaaggaaaaaaagaaaaaaaaggagagaaaaataaaatcttgttcatacaaagtatggggcatgatgaaaaaacagaagaaaaaaacctagccagacaccctctcaatttttgaaaaaaaagagaaaggtgtatgcagaaggggtaatgtcattccatatccactatcataccagacacttgcacgatcttcatcaaaagtatgttttgttatcttatttggcccgactttttgacttagtaataaatatgaaagcaaatatgctgtcacacccagagtttccccttctctgtagtttctaattcaccaataaattgtctatagaaattactttggttaaccaagagaaagcccaaattaacaagacattttaataatcggaaatgtcagggagaattctttttcgaattctctttgctctaaaatcattaacagcacttaaagcggaatattcagaacatcggagttaatgttggtagattgaattgtcaagatttgaattaataataatctttctctcccgcatttggtcgtgaatcgtgcccgattcactgccctcttcgtccgtggttttgttttgcataacgagccaagtccgtttccgtttgtgagtccgtttccgttcttttcctaaaacggcacagcatttctttttcaatttgggaaagttcctttccaaatcctattcctatttttcctcccctccccatcccactaggccgccactccccctctcccctttcgcgagcatgcctcctctctccccatgtcgaactaggccccctctcccctccctctttgttgcctccccaccagtcccacctccctcttttttccccactcctgtataagttagaacaccccctattatttttcctattcaatttttgttttagccctagtcctagccctagctgccgcctcccgccgtcgccggcgtcgccctagcgtcaccgataatctgttttccctctccgtgtcatggctaccacgattatctatctctattctaatttatctccgtcctagattttgatctagcatcaccgctgtctcggcatgttgccgccgaactgtagtcgtcgtctcctcctcgctgattgtctcggtttggtgaggaacctatccgtaatctcccggtttaggtgttaattctttttagtgtcgttgttgtaaccctaaaagtgtaaccccgacaaaaccctagtagcctagccgtgccgccgccgcctagctgccgtgtcaccgctgccttgtgtcaccgcctagctgtcgtggtttgccgctgcccgtagctcagtagccgagtcgcaaagccataggtgcatccctaaacccctaccggcctatcgcttgctgtaccgagtctctgtcgtaaaccgtgtctgagccgtcggttccgttcgccggttcggttgaccgtttggatggtcccatgtcacgaagtattgggtcgttgagtcgttaattcatgaggcttgcttaccagaggtttatttccattgatctatttatctatcggcaataatatgtaataaatgattaaggtttttcagttattagtaataacgcaactcatattataaaattcgtaactaaataatctgagctccattttaacccattcaaattgtagtgaatccgttaaaatgtatagaatccattaaaattggtttcttttgctgtttcagtagcctcattgctggtatttcttgtgtgctttgtttgtcgtttagactctgtcaggtctggtgatctagtttatttcgaagtggtcgccgaggtttagtcagctcaagagcaaggcaggtcatacatgcatcattgatcatgtggagcctattttataaaatccccttctttctattaaattgcattgttttagaatgtcatgtgggatggatgcctatcatactcagcatgttgaatatcttatgccattgataacttgggttataactgactagatgattgctctaggagtgattagccatgcttagatcaattagttcacaatgggattcattataatttagtccttaatctaccctataattcaccaaatcattttactcatctttcactcctacactcttacattcatcactcaacggttaagatcgaccagtgtaaaatcaaatgatcgagatcaatcccacctcccacctctatgaatcgctcccaccaccttgaatcgcgcacgcggcacgcccctttctctctttctcgctctcccagtcacagatccacgtctcctctctgtcctcatcccgcaaggtcgcaacccgcaaccttgctcatcccctaaccgcgcctctaccctaatcgctgcgtgttgccgcggccttcgatcctccgttttcaagggcgtgtcagctcgtgccgctcgccgcggtctccatcaccgccctcatctctcccctgccaccgccaccttcaatcctccgtggtcaagggcgccggctcaccatggtcttcgtcacatctctcccctgtcgccactactatgagccctcgacggtggtgaagcggtggcgcggtggatcttcggtgaaaccgaggtggcgcgatggctggagcgacaggcgcctcgccagcatgacgcggactgcagtggttcttcagcaacatcacagcaccactgcttcatcttccatcagcaagtgcgcagcgattcatgcccgttccccttacctatcaccgccgcgattcttgcccctgcccctctcaaatcttcaaaccctacctagccgccggtaggcccctgccgctcgcctatcgccaccgcgccgccgctcacaatccccaaaccgtacccttctaccggtactgcgaatccccgatctccgcctcgcgttacggatgccactgcacctcctccatggagacgaaccaccatggaggccgctgtctttgctccccaccaggtcgccatcctggcactgccagcggtggaggcggaggtggctaccgctgctgcaccggggaggatggccgcgaacagcgtgacctcgatatccaagggcggggctgtaatgaggaggtacacccgtggaccatgatggatcggtgtgtgcggcggatgcgggcgagaagggaatcgcgcagctggtcaaggcaacatcccatctctctctgttaatctcgatctctgagattgctactaaactaaaggtgatatttttctaaaggctactaaactaaaggtgatatttttctaaattttgtgccaattccaggagaattcggaacctatgaggctccttgaggggagggagtacgtccctgaaaccacctgattccttgcatcagttcatcccttctattgaggctttgagtggctggggcttttgatgctatgtgctcttggtttgatgcgatttttgctttgttttggtgcatacagcaagatcatagacttgagcaggaatgggccagaagctgtggctcgctaactggcagctcgctcacacaggaaaattcccatatgctggcagtaagtttccccctaaattttatcccagaaacttcactgttagttgccaagtgaaatctgtgcaatgtttagtttaattctgatcgatcaagagaagcatatacactgcatttgaaagtgtgaaaacacatattttgctttattgagtttgcaagccaacgtgttaattgtagtttcatagtaactgatgtgtgtagtaccgaattctaggaaaatgcattctctttatataagcctttcctgatatgagttaacggatcagttaacggaaaatgcatactggatcacttctcttttttttttctcttactggtgtcagagttctctcttacaaatattcttatacaccattcataatactattatacctgcccactgtagttgtattgtgcatatataacttcagatttttattagccttcagttttttttttctactctgtcggattttcctgccgattaattgttggactcgatgtccagaaaaaaaaatgcaaggtctgctccccttgtcacattatttgcttatatttcccttgaaaaaaatagtgggttctagccttctaggcataatttatagtaaattgaaatagatatttcctgcatgttgaactatttagttcattgaatattagctagaaaaggtacaaaaacagggagaaaaggaaatcccaatgttgctactgaggcaatatgaaaaaaaatggtatactgcaatctgctttgtgtaaaagcttttcaatctaactgttattgtgcattattatcaaccaaattaagagaggatgcaacttgaagttccttgaggtagatattttatgtggtgatcatgaagttgatgttcatgggctttcattggaaaatttgagtcactaatctgatacattgggtttcactgatttataatttatcatttaatattcaccatttgattgaatttcttgtttcttgtactgaatcatgtaggttttaatgtatgtagttttacaagaacgtctccaacaccttaaaggatgttctttggaaatcagacgatcttcaaagtccacattcctggagtaacttgggagagtaggattagtgaactattagcataccgtcctttggaatcaatattcatatttctagaggtgagaaaaggagaaagcatgtctattgcacttgtaattacatgtgaatgatcctgtaaattatgttaagtctccactaatgttgcatgtgctgctcttgtttttcagagaacccttctaatagctcaagtgaagttgatcatgcaatgagttttatgtgttagtaagttttgtgcgtaaatcaatatgctgtgagatgcaagtataattaattaattaattagcatcatttcatttacactgtaaagttgtatcattctcagcaggaatttccttttctgtgatatcacagtggtcttatgaaacatccccgtaacgttagtacgggcatattactagttatattatgacatttaccccattaaattcaagtcctataagaagcagtcgattaccgcaatcactcaaagactaagtctaaacctgcaaacaaaaggttaattcaatagcaagagtcagtacattataagaaataatgtactggtaagcaccaagacaagcctaacactctacttgcaaggcatataatcaaggaaggcatgatatggttctttttagcataaagcaagttttatttgcataaaacatttccaaatcagatttgctttcaaataaatttcagcaagcaagtacttgacatattgggcatcaaagtagtcattaatcatgtataaatatactactcattgccatccatggcaacaaggagatcattctcaaatctcatcacattttgaagttaaatttcagcatttagaagaataaacacaagtctatactcaacacatatcgacatgccgctcatgaccgcgagcacggctaatcgattaggttttagaactctgcagactttatacagctttacccacatgatgtgaatcgctctggtttgtccggtacccgtcggtaccaccatactctacacattgagtatggtctagaggtcacaacgaggcttttacattaagtattgtctaaccttgcatgagcacgatatgtgtttctccatcctaggccatacacgttatatgacctagaactgttaatggcaggcccacgctttaaacttaacgccgtgatagcggacacaacgaggcttttacattaagtattgtctaaccatgcatgagcacgatacgtgtttctccatcctaggccatacacgttatatgacctagaaccgttaagtggcgggcacacgctttaaacttaacgccgtggtagcggacacaatgggaacccaccacgtggcacaatatcgttgtattggacacacttagacgcccatgccgtgaggcggaacacgtgaggcggaacagtacactcgtcccctcacggaaatcacacacgtagggaatttatcatcctacgatcacacttaggaacagtacactcgtcctaaggttcaacacacacatgggtagttcctctaggtagcccacagtacactcgtggcccctacctatactataacggcctcccgaatgcaaggttagacaagtgcttaacttaataggccaagatcccccataaagacacatgtggatgtatggtaaacataatgaacagacattgagtgaagtccttaggttggtttgggcacactctccccctatcggtacacaactaatcaccatatgtgcaccacttgaggcccaaacctaaaatccatgttttccaccattttatttatcaaaatcacaagtattaaaattctttccagattatttaaaaattaattttcatgtttgtaatgagcccataatgacaaggaaaaccattctaaacatggctaagcattatagtaacctagtgtcaccaaaactcatatataaagtggtatagtcgtattgttcctaaggttaggaatgagggatatggatatatgtgggttaaggtgataattcaaataataggagcttgcctaacaagtttaacaaaattttaatttattagtgtacaatcgacatgcaagatttgccaacattttcaataacctccaaaacataggttcaaagtgatcaaagagagggaggtgggactttccttgtaaccggaaaaagtcagcacctaaatcacttcttcaccgtttaagcaatcatctatacaaagtacatgttatgcagttaaacaccgaaatatgcgaaaaatctaaaatgctctaaaatgcatgatttgtgcacagtggataggtactggtctaaaatgaatttacgtgaaagaatttctattttatctcatttcatttgagagttatgaattatagaagtttgctcggtataggatagtatttacttaggtagtgttataaaatatttttataaagtgatgtttattaagtttgactttacagaggtgtagaggtgtgttttctaagactaatacatttggtttcacaatttttagagttattatgtattctttatgtggttcacaaattacaagttataacgtgttctaggcatatagtctctatgtgtacatggctttggagatttaggctgccatcggttcgcttttgcggttgctgttttgcagcagaagcgcatcggttcgctgttacggcctaaatgcaaacagctattggtagtgggccctacacatgtcgggatctatctacggccacgcatttggactcagtgctgacgagcacacaacgcacacagaggcaggcaagcagaggcaatgcatcagttcatagaagatccagtaatcagccataaacaaaacaatggaattgctgatgcttataagcattaggctagtactgctgaaaagcagcagcaactgcaaaacgatggcgcccttaggtccagaacttgctttaacttgctagtgttgtataaaatgagtattttagttaactaatctaatcttagttcataatttcggagtttatattattttactacatattttataaatagggatgttctatgttagttacttaacttatcaatctaaagattgttgcatgagataagttcatctaagttttggtagatggggatggaactatggctccactggtcctaacaagttttatttggatttatttggagctaccatgcatatatatatacacttattcatatgtattgtttaaccactattatgtgtttagtacctattctaccaaattaaggtttagagctatggtctgtacagagggtgccataattcactctactaggttaaagtatattacttgctggttctacagaaatttggttcacttcatttagactaaagatgaattttctacaaattttacaatttaaggtatgctccatgttgcttattccttacataaatgcttaggggttcttattatactgtaagtatgtctttttattttataacattgaagtgcacaactctatgattctacagaacttgagtttactcgaaaaggatctaagatgaattttatataaacttctaaagttcagcttatgcagaactagttattttaaagataatagttttagaggcatttgatgtaaagtgtgtatacgttttattttacttttttttagagaacatgttggggaatctgtagaaactaagtttgctctaaaatgagttgaaatgaattttgtatgcattttataatcctgtgtatgttttatatgtgattttacgtagatgaattttagagacagaaattgtattgtgagtgcaagtttttatgcaataaaactaaagttcttgattagatgagttagcagtaatttgaattactctaagatgagttgttttcaatttgttatggattttacaagtttacatgtttttctgttgaaaacataaagctttaggtatttcatttagattttttcagaatttaaatagattgggtcgacaggttagtctcaagccagtatgcagaaaggcccctggtgtttcagcaaaatcaacccgcggtcccatgactgttctgtgtgtgaagtaggtttacaaactactacctagagttttgattcttctcaagtgaggtccttggttcgagctgatacagagctagccatggccgagctcgtcctggagctcgccggcgacaaacggtggcagatctcggcgtgcaacgtaaggataaatgtaaaggggttcaaggcgacgcttttggtggtattattgcaagcattagtcaccggaattaatggcgacgncggcgcgagctgcggtggttctcgggtgatggtgcatgtggagctagagcattgatctagatgtttagctacatgcatgtgccgctatgggatcctagggatgcttaccgagcgtccaatgaaacttggcagggtccagatagcggtgaccgcgagcagaacgactcggcgacggcggggagcttcggaatgacgtcgccggcttgatatggctgatgatctaccatgcatgcatacacacggtgtataataggtctctggaaagcttcatgcccgaggaattgagctgtgactcaccggagagggagaaatcgaaggtggagcttgacggctggaattggggaagacgatgccgatctccaagctcgatgcaccactggctggggttcatgagggatttaagagaggaccccgaggagatgttgatgatgcggtggctcggctcggcttgctccggttcgacagcaacgaagacgatttcccgatggcggcgtccagtgcgcgctccagagcattatcgtcgaggtttgagttcccaccaaaccactgcatgaaatgggatgaaacttagagggctggaatcggcgaggagaggtgataatggaacgcaagagaagaggaaacgacggcggcttaatgacgctggaggcggtcgtcgtcttcacgaccggcggcgaggttgagatggaaaagggagatggagctctccttcttggtttcttcagtttaggaatggataatggggtgtggcgatgcagctgggaggaggagaaggctagactaggtgtttgatggcgtcgacacgttgtggccacgtgtcgttcatagccggcgccgatctctctctcagtctcggttgtctctggtcggttggaggagatgcacagggtgtggagcaagccaaagaggctgccatgtgggcccagggcgaagggaacatggcccagggcgaaggaaacaaggctggattgtgagaggtgggtagaagatggggtgttaattgattttggactaattttcaggattattttctcctctaaatttgtagcttcgtaacttaatgtgtggaccagattaactagtgttgattttactggaggtagatgaagttacctagtttccattttctttggttgcacttaaaaagtatggatagattactcacagaaattagaagaagaggggctctttggaaaatagtttggatttttaagagacctaaacagagaagataaattctggaaaaattatatttattcattataattaacctagtatttgaataaattatttcgcctatacacttccatgcagttaaatgcacattttagttatgtatggttttagctgattaagaactatatttagtctattattcgactagtttgacttgtttatttaaggtatcaaatttagttaatgtttgaccaaaattacagtgaatagcttgtgctaataatattctacataaatttttccatgattttatcttgcacaaaatatcttagataatccgcaaggcttatctcttatatgtgtttcccttttctaaatgcatgcaaatatttatataagttatatttggactcttcttaacctgagatgatgttgatatgtttgagttacagtttaccttacacagatcataagcttcttacctatttatgtataagtttactttagtattagattaagaggatgcttatagagatgattaagatagaatataccctatatgacttaatttatttgttcacttccatgttcatgactcgtcttcatatggatgaccaaattatttttgtggggcttgacattggccttttgatatattttaaggtttctatgtattattttccattagttagcactaagctctaatggtttagttgtttgtctagattgtaattatattcataagacctatgatgaaatgcaaatcaaaaatccaaatgcatatgaaggactcaagtctaaacatgtcctatgagtatgcatgcttacacataggtttacatttttgtcctaggttagagatgcaaaggttttaatttgttctcaagttttacttaggttcaagttagactgaccacacctaggttaaaaatggaaatttttggctctcaaaaatggaaaagttagcttccaactattttgacacgaaacttttaaggtctaaaatttgggtatgttacagtataagaaatgagagaggactaccgacaattgtagaattcctccgacttcttgtactctactctatccctaattctagtatacaataaagtacaatagagcctcttataattcagctcacgctttggtgtatgtgagaatgaggaaggagaggggtatttataggtggaagtgcattgggaggatagagtttctgtaacacccccggtattctctgtcatgcctggaaatatacaccatttccaaacgctcagtgcattaatcctcgtcccaggagatgaggtacacatagacattgttgattattacaagccacacttgcggaagcgtaaaggaagtactttattacatgggcgacttaagccctcacactcaaagataaacaaataaaacagtggaagactacggaacagcagcagccacaggcactcaacggtggagcgaactagagatccaagccttcatcttccttaggtccatcctctggattatttttgtgagcaagagtgagtaccatcaccgtactaagcaagtcacaccggaaatgcaaccataatgcataggggaaacaaggaaatggcctaatagggtttattttgcataaagccatagttgaaacattttaatcaggttaaagctcattttaaaacacgatcctgttctaagccaatattttaatatcatcaaggtcgcatgagcctgcgaacctgccttaacccaggctaatctccacatgactacaccatcatgatttcaccctcccaaggttttataaaacaaaactaactttgggtacattgctcagcttgcccataaccgaggtcgcggctattcgaatagtttttaactctgatcagaggtgtacaactttacccataagacacaacctcaacacgcgttgccacgcgctgggtaccaccacggtacccggatagaggtcgtgacaagactatccatctaggtctacccaaaacaggagaacccgccgaggtttcgccgcccgccggtccacgacaaggtaaaggttgccggatcccccgggacgagacaggcccccccttgcgccgggtgaaaagacagccttaatcctggccccatacccttccaaacaatggtctgtcttttgagaagatctaaacttccagtcaggccttacccactagacttgtggttgcacgaatatgccttgcaacagaggcccgaagaccggtccttatattagccagggtgcgactaccaaagtaaccagcttgcaccccaagcccaacccaaaaatatattttagctgtacaaagcattttatcacctatctattgacaaaccagtcaatagtccataactaatccagttttagttgttaaccaccagtctagtttatccaaaagttctaggttggaactaagcatgattaagcatttacctaaagcaactagttagtccatcatgtagggtactagactagtcaagttataattttactagggttcacaatgatcatggatatcaaatcaacaacatggccataacaaagagcataggaataactaataaaacaatattaataatgaaaagtataatttataaagcaatgcactataagtaaaacaacataattttcacaatatgggattcaacatgttcaaggtagatatgacttgccttgattgctcacaaagtcttcgccatcaacgacgatgaacaactgatcttccggaacggcaggatctacacgaccaacacaaagaaatacaaaaaggctaataaaaaccacatgaacataagcaataaagcacataaatgggatctactcaattttaggagaaattagagatttgaacgggttgattcctagttcaaacggtcaagatatggccatttgaagtttaggtgttatttaaatggaaatttgcaattttgtgaattatttttctaaaggaaaacttgaattattgagagagagcgcacgcggaccgggtccacgagcgggtcccacttgacagccgctcggtcccccgtgagccgagcacaccgaggtggctcacggtgcaccgacgtgcacagacatggccgagtagagcagtacccgagcaggcggctcgccggcaacggccaacggcgcggcggcggtgcgacagagtatgggaaggggaaaaacagaaaggggaggagacgacggttctcaccgagcagacacggcggcgagaggtcggcggtgttgccggcggtgaggaagaaacggtgagaagcttcgggtcgtcggcgtcgtcgtcgttcctgcggtcctcgtgctcaacagaggggtggacggggaataggaggaatcgccgaagcggatggtggcgactctgagctccgacgagggatggccggagttgcgacggcagcggcacaagaagagagcggagcggaggccgcggagaaaggaggagagggcggcggtgtgtggggagagaggagggagtcaggggtccctttttatagttcggaggggagggagagagacgccggggaaggagatcgacgccggccatggtggagctgaccattaaagaacaccatcaaaatccaccacgaataatgcgggatagagtaggaaattatgagggaattggagaggatgaggtgggaattaattcccctcaattaatttgatgaaacggcgagtggaggaggcgaatcggaggttgccgtcggcaggaattcggccggaaagagagaggatggctgaaggttagggatgacgagtgggacccacatgccatcgagagggagcacacctgcccaggctggggcgcgcggagaaggaaagatggacttagtccgagggagagggaatgagctgggccggcccaaggagagggagggggaggagagagagggaaggagagggggcggctgggctgggccaagagagggagagatgggctggaaacagcccaacaggaggaagaggatttcttttagcttttccattttataaaatttctttaattgtttttgttgccttaaaattatttagaatgctctgaaaattcaagtaaaaattggttaaacatttttaagcatggggaatttattaaaaatacccacaagccaatttgaaataaatgttggtgagttttaattgttggaggcttttttttaaaatttctagaaatgcattaaagcacgatttaaatttagggcgatttacattctcttacctaggatgctacacactacggtacagaaaccactgagtcctaaattcattaaaaatttcgaaagagtatccctgtaaatacggacatccacgacatgcaattatagattaaactaataataacatcattcccatagcactatccatccatctaatccatggaaagaaactaaaaggtagtttaagtgtcattatagacctaggcaatatagtttgatattgtgcagataaatgtgtatataatggagctacttcctgcccatgcatgtcggtctcaatgcgtgcataaaaccaaataaaacacaagagtgagtataaaaatactcagcaagtacaatatggaactagaaaacacatatacacatcattggcaataaagcatgtacaaaaggctttctttctttgataggaaacacattttcaaacaccaagtcaaagaagatagtagttcccatcccgggtaaacatgaattgaaatagtagtttccatcccagacaatagtgaatacatcctagcatttgccagcaaagccgagtaagcgtgatcaacgcttacccacaggaacatgaataaaaccagatagcacatccatgactcacatggaacatgaataaatgaaaccagaaataaagaaccaaattgaaaaccatattgcacatccatgacaagcatggaactttaactatttaaccagaacctgaatccggaatattgaaacaagaataatgacgtaaacataagataaacttgacatcaaaatagcatgaacaacaatatgaaaatatgccatcacatatcacacataaatataatgaaaataaatagatagagcaaacactccaagaatcacacaattagttcgtcatgcacttgcctccaataaagggttggtatgatacactattggatgaccaccacctaattacaaacaaaacctgaggaaacacattcaaatatacatataaaacaatgaaagaggtgaacctactggcccatcctgtcgaaacgcaataacagggaacgccggttggactatacacaagactactgcttcaaacctttatatcgtgaaatatgaaaaggctatgactgagagatatgatttaacccaatgtgttttttaataaaaacaaaaacatactctacgaaccatacctactactgatatgttgaaagcatatggatatgctgacgtgttaaacggtttaaatcgctcttgaaagtaaggttttgaatctggccagaatctcagagagaacatacaaaaacaactatatatggaggtctactcattggatctaagtctattttaccaatatggaaagcttggagaaaactctataactttgcctataggcggcctgactgattccactgtttaatcctccaaaaacagttaaatctactactacataaaaacagtcatactaaaaaaattatatctcctaaaccacttgagataaaatcacgccctttggtcagaagatagatccaaacattatctacatcttcctagtatacacttttgcagaaaatagcatttagagccccgaaacatcgaaaaactgaagcactgtaaatttgcccaaatgtagaactgcaacaaaccgaaccgcaagaacccaaactctttctctagccttccctaaccacgaattaaagcaataaagtcatgctagaacaactaatacaacaaagagaaaagcctcacctagggtttctttagagaacttgtgaggagacaatagaggagactccgatctaacccctcctactcctctccttctcctcgttccgtttttccacttcgcttcttgatccaggttgttggggtggagatctatgagggcaatttgctgtagaggggagagatgtgaacacaggaggagggaaggaaggaggcgccgttggagcccggccagggaaaggggtgtcggcaccaagagggtaggtggattcggttcccctctctctaggttttaggggagaactagtgggctgggtttatgggccttctcatgttgggccacttctaaaggtattttcttttatttatttctgttaacatctttattttaacaagtcaacccaaactaaaaaaacctaaataccttttaatatacggggtattacagtttcttccaagcatccaatgagtatcttcatcctcctagtgccaagtgtcctttctgatgatggttagagcgccggaaacagtcacaaccattattgggatgtcgttatctaccgaactgaacttgggcctgggccaatggcctttgtcagggttcgaccgaaccttggccagctccgttggccccgcttttcagcctagacactcattctggggccctcaatccattgccatggtagtttaattgggcttttcggtccaaaacttcgtaagtttggatatgagtttgactctccttgttcttcatgtatattttctctcaactttggtagtttgtcatctacatccaaatatacaccaacactcgtggaaattgttacaaatataccctaccactatgttggatgttttatgctttccattttatgcaggtactgatggcatgaatttggtacttaagagccatcaacaactatgcacttagtacctttgagatggacaacatagtagcaactcctgatcaacaactaagtttagtttatgcaagtcctttactcgggacgagcaaaggtttatgcttggggggtttgttacgttcattatagaccaatttctaccatcaaaacttctgaaaataatggagaactagcaaagcctgcatgcatatttatttataaatagtctagttccacttgtacttgctaaagtatttgtatacaggagattacttcataaatggaggagaaacgatggaaattcaccgttcaatcaatcaaaacctgtgtcaaacatatggattgatgggcccacaaacccattgaaacatctacaaatgggcccaaccaccatgccactgggctgaggatccatcaaacgacgtccaggaggaagcactgggctagggaggcctgctaggggtcggccgaccctggcctggctccgctggcctaggcccaagccaatgacagttgtaatcgaccttccaatgacgcccacaaccgtcatcctcaagctataaaaggacctctcatccttcattccagcatacacaaagaaggattcgcgaataagaagctctcttagtttactcactttgctctagtgctagtagagttagaattagaatagtctccttagttcttcaagtcttttggagaatttgggtatggttctagtagctcttccctctcttgtaagacttaatccattaatgatatattcttctttatatagttgtggtcctttactatatttgcataatgtcatgcccggaaaatagaacactatattccatttgtgagtgcataattccttgtcccaggaggcaaggtacacattacaaagttggtaaataacggagtatataaacataagcgtaaatagagtggcaaccaaaggcccaacactgaaagataaacgataaaagccagatgctacgtcgggccactacaggtacttgacggcaggcacgagctagacatcaaagcctttatctccaaagtactcctctgctggaagggggaaaaaggagcaaggctgagtacaaccaccgtactcagcaagccatgctagtaaaatgcaaatataatgcaagggagtacaaagaattcatttataaggttattttgcagaaaactagaatttaaaagcatttcaatatttacaagcatttaaataaaacacaaacatatctctagtcaaattattaccaagccgtgcaccaacgcgatcttgccttaatccaaggccacaagtgataactctagttattcaaattttaatagaattaaactttaactcgggtacattgctcggtttgccataaccaagggcgcaactattcgaatatattatactctgatcagaagtgtacatcgttacccaccagacacatcttcctcacatgtttccatgtgccacatgccaccacggcaaattgaccgaagccatgacataacccatcgtttagtaccgccctaaacaaggaagactgacatagactttgatgaggacacgactagcttggatataaccatgactatcttatgtattaattaaccaaaggtgcatatgttctatattggatttacatgttatatatttgaacaaatgttgctacacaatgagtttcatgtgtttccatttgcagaggtacttggttgggcgaaagaaaagaaaccgagcgtaaggaatgcatggatgatcaaagaagttcattggggaccaaactaagaccttccctaagtccacttccatctcaccacgtcacttttggtccgtagcatagtaagaaaacctggaccggtccttgacccggtggagggctcggttcaccggtttaccgactcaaccgttgggtcaccagttgaaccgcggtttatatcatatgtacatttagtatttccccttagtcacaacagttagtttggcctagtggtttgaagagtttgcctcaatcctagcagtgaggggtcgaatcccactgcctgcactatttttatcatataaatgtcaagttgggccttagctcctacatggcccatacagaataatgccatcaagtggcccagcaagcttgagtcggccagttcaggttgttggtatttctagaaagggaaaatttgaaccatgccacacaaattttgtaaaatttatgatatgccaccctgacccacatgtcattgactcatgtgggtcctacatgtcattgagatacgggtggcatgtctcaaattttgtaaaatttcagttacaaagtttatccgcaagcgcacggatataccatagtagcatttcacccgagcgcacggatagaccatagtagtatttcacccgagagtattccaagggtatcgtatttattttatctcgtgggaagatcatgtagagagaacttgactaataatttatatattacttttgataatcatattctaagcatgggttaaaataatccaagggtagagtgacacacatgcattaactactcattctcataataaattatctaagctaagtgaaaagaaaagagagagataatctattcctatacttctaatatacatagtatgtatacattctagttaaccgatatactagctaatatcctctttccgatgccctcctggtacttcgagaagccacccctaactgccgagttcattacaacagcttgtcatgaccatacaactggggctaaaagcataggaataccctccccagggaattaacttaggattatataccggtgcggaggaatacccgtactcttctgaaggcttccggactcctgatttctactctattcctattccactagctagatactactaaattaaacttgagagaaatgagagagctattgcttgaggtgtgtgagtgaagtgagaagaggagctccttttataggcaggtaatgacggttgtgacggttggaatggtcggtaataccctccaaccgtcattggggatcaaccccggccgtccatccaaaccctgcattatcggcgccacgagaggttcggccaaacccatgggctggcctaacccaacccatcttcagctagcggcctcttttgttgtcctcctccgtagacttgtgaattttggcccaatgtgtcatgttatttctgagttcttggcccattcatacataagtctggttcttgacaccgttcgattggtttatcgtctgagttgatgtcgattctcctccactttattatcattctctgcaaacggttattatacctaatactagtggaatattattattctaacaggtatatgcattgcaagcatcactagttctcctctattttagtaatattgacggtcgaaactgatcgataatgaccgtcaacaaaaccccccaagcttgaacctttgctcgtcccgagtgaaggacgaaaggaaataaagacttggttgttgatcaggagttgctactatgctgcatatctcaaagatactggtgcaaggtatatgtactctttctcagattaaataatctttggcacgtggcttacccttacccctgattcccacgagactctgcttctccttgtcttgggcggttgaaagacagaacagtaattagagcaccaatcacccaatctttattcaactcttattccggaagttttcaaatgattttgcaaaagaaagccaagttcctcaattgattcacacagtctctccaagtatatcaaaatgaattcctcaccaatttgcctttttgattcctactctaaggtttgatatgtggaactcagcagggatcaaacatggcatacttgcattcacatttattactaagtcaaaaacttagattaaagcagatgactaaacatactcaagatcaagatcgtgcaaaatgtgtgtggtatatgaggaaaaataaaagaaaaatgcttctcctttgtgcttactttcttcttccaaaaatccttcttttattgattaggagagggcatggctacatttttttttcaacatcatgctcatgcttgatagagcataactttattttttttttcataaccatgcctttccctcctctttttttttcaaaagcacttttctcttttataagaagaaagcacatgaaagcatggagaatttattttggtggtaaaatgggaatggaacgaaatattgcttaggtcccagtgtaggagtttagcatgtgcatatatgtggatgtatgatcttgatcatagagcatgagaagtatctacacaagtctcaagagtttgacaaagttcaatggaatgacaagcaaccaaaatgtatatggtttaatcatgatggcacgtttttggctctggtaggaatttatatcaaatgaggaactctcaatttatcattttgaaaaacaaaacatctggaattcacgtcaaactagtatcaggatcatagcaactcatatttactatctcatatctcacaacaacttagacttagatcagcaagtgcagctcatttacctcaggttcttggataattgttggctactcatatttagcctttgagagagcacttacctatgaacccatatataagagatataaaacatagcaactattcatcatttcaacaaagagaactaaggcttttctacctacatgactcaaacctatcctatctttttggtattttctatttggcaaattttatgttgttttcaagttttataagatgcaattggaaagcaaatatgcaattggaaagggaaatatgcaatctgatacaagttaccttagtgaggggagagatgtctctccccaagcttggctttcgctcagggtccttgataagaattgaacccctgaaaacggaagtacgcttgaaggtcatcgtgctgttgctgcatcatgttgttgaagttggcgaactgagcatcagcggattgttgccattcttgcgtctgagctatgtattccgtgaggttgtactgaacctcccctgcctacacatcaagggtttctattctcctagtgatttcacccaagtcccaatgagaagaacttgagctccattcacttggagatggaggcttaccacttgatctggaaggttggttgtccccccattggatgtcatgaggcgcacgccaccggtcctcactggcactcacccaagttgagactccgatgctgtggcgtggagcttgggtccatccgggtgcatcccagttggtgcccaatctgcctcatacatctgtacgggtattgaggatgatgaattctctcgttcattccttgtcatgttgcgcgtctccctgtatgctccacctgtacgagattcttctatggtctgcaagggaatggttagtttatggcagttgtacagatgataccccgcatttggcaacgggatttcatttgtacaaccggggaaaatgtaaatcaaagatccatctactccatgttttagaatatgcccttgtactagataattctcatcaatacacggacgagtggctgaaataaaagcaatttggttgctaacgacccctagcccttttgcaatccgagtaatcagagaagtgcactcaacaggaatagggaactttatactttctaaccattgccttattatacatttcataggagcaattttgatctttctaaccatggcaaacatgataatcaattcatcccccctaatgggtctcagatcacttctaggaaacaaagtcatagcaatccatttgtgcatgagcctaagtgtaggattatggatatcattcgttctaggtttcttgcaaattggggcacaagaaatgtcttccccaaacctatttttctcgaaccaagaaattcctttctggagatcgattttacaggaatcgtgaaaaccaagaagtgtacttgtcacatcccaaaacgaccctaaaatatatcctttaaattatgcctagaataattaaaatcctagtgaaagcctccaaaaattaaaatgtgcaaagttaaaagtcaaataaggcttggaggatttttgtagtatattccctaaaagcctaaaaggtgtaaataaattttagtggaattttcagagcacaaataataattatcaagaaataaacaaagttgaaaaggttttataaaaagaaaaaccctaaaaatcctccttccctatcttgggccgaatacagcccattctcctcctctctcttgtctccccgcggaccactcagaccttttccttttccctcacgcgcagacgccgacagg

SEQ ID NO: 28182 - DNA, 668 bp, Oryza sativa
gcgcgcagcggcgaggcggccgcgggcgaaagcgacttagccgcccgcctcgcagctgccgaacacaccatcgccgatctgcagggcgcgctagactcgtccgccggggaggtcgaagccctccgcttggcaggcgaggtagggcccggcatgctttgggacgccgtctctcgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggacagcgcgcgcgcgcaggtccgggatgccgccgactatatcgtcgacagcttcgagggctcggcccctcggctgcgttcgcccccaactccgacgaggagggcaatgccggtggtacagacgacagtgacgacgaggccggcgacccgggcgcatcggattgagccccagactcccgccattcttcagttttttcttcttttctttcttctaaggccttcgggcctcttttt

SEQ ID NO: 28183 - DNA, 1123 bp, Oryza sativa
  unsure (1)..(1123): unsure at all n locations
cgcggacctcggtgaacttaacgcgcacgtagcacaggcgcggcacgtcgtaccgtatgtgcttgatgtgcgccgcgagcttgtcgtccacggggaacgcggcgtccgcgtggacggccgagtcgaagtagctgtccttctgcgtgccgaaccacacggccatcatcacctcgccgcggaactcccctttcttgtcgaagacggggtaccactgcggcgcgggcgagctgtcgggctggacgctcgccggcgcgtcggggaggatgcccaggtcaaggcgcgtgctgccgacgtagtcgtccttggcgaagccccggccccggacgagcacgtccaggaacggcgcgtgtatcctctcccgcgagaacgcgaacacgtcgtcccactcggggctcgccgtcttctcgacgtggcgcgtgatgcaggagtagcccccaagcctcagctccgcgaacgggtcgaattgcgccgctccacttgagcccccgcgccttgacgacgcgcacgtacaggtactccatcctctcgacgagctcgtacgccccgccaggcccggagcaggcgaggccaggcgtgatctccctgatcccgaactcattgttcggcggcagcatgccggcggggcgggcataagacctcggcagtacgtcgcccatgtcggcgaacactgccgccggtcgaacgagatatgctgggctggtctggtcacactagctggtcagtgagcaagttgcatttatatatgtgtgttcagcagtctggctggccaccaaccggccgcgcgcgtgacgtcgtgcgtggcgagcgaatgcgtggatttttgggatttggtgatcgacacagtcggggtgtgtgcttgctgacggacgattggtgatccaccagggttagttagagtaagtcccagagcaaacagacatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28184 - DNA, 4065 bp, Oryza sativa
taattgagatgcggcatgtagagacatgagcgccacattgccatgatgttgatgacatgatttgtgaaaggagaaataaaattaaacaaccgttttcgactggggcggacggaggatttgggtggtatctggaaaaggttagtaccgtccccggtcaattaaggaccgagccatgaagttaagcatgaaacgacccccgtacaaccgcacttctcgtatgggtatagacctagcggattagatagccgagaggaggcagtatccctgcatagatggttcacccctgagtgaggcaggtgcgctacggtgggacagccgttgaggtagggccgagaggcgtgccctacatcggtgtcaccattggtagaactgccatgagtgtgtgagagagagaacttaacttgaactataatttaatatgtgtgagacttctctttcccgggagcgccagaacttctcacactgctagaaacatggacgcctagagtgcatgaggatttaagttcatggagcgggtactgccaatgcgaggttatcgaaaagctttgtcgtgacgcgtctcatgtgttgggacgaggctcatgtgttgggcagtcgcggagtgcgggtaaagtgtacatccactgcagtgtgagtaaactaaatctattcgaatagctgtgctcgcggttaatgagcaccgggacatgtattacacttggctagactctaaattcttaacttgtgtgggatgggatattgcatggtgatttttatactgatggagccacttcctgagaagagggaaggtggacgtcctcagaaaaccatgacgactcaatggcgggaagctatccttgggatcacaatggatggtggacataaccgtcgttgtttaatgtgaacactggaactaaaatttgatcagtctatgataggtcttaggcttgtgaaaatatttgcaaaatgcagctttatgcaaaagaacctgaaaccattccttgaataccctctatcatatgcattgttgttgtggtggcttgctgagtacggttggtactcacccttgctatttatatatcttttaggagagtattgaagagaagcccttgtcggtacgcttgcgtatcccacaagatgatcccctgcggtcttgttctaggtctcgttccccagtcgactgcctgtggcatgttaaccgggcccttatattattttgtcttccgctgttgttctctgatagttgttggcctacctagccctaatgtaagtatttaactcttttagcctaaattcattcgtgatatgttgtgatccaactatgtatatgtgtaccaactactgatccagggattggtacggataaacacagaagatttccgatttccaaaatcgggggtctacataaataaatatgagcaattctaaaaagtttacattgtgaaacagagaaagtggcatatgtgttttctcattatattatttaaatatattaaaatgacatcataattttaaattttgcaataactttacgaaactacaaatgtgtaatattcatattgtattttatatacgtgttagttattaattatttttaatatcaaattttagttatttgtaaattatatatatttctatatggactctagactcgtcttttaatatttctttttttaattccaaattttctataaattgtatttctatatatactctgcacgctcacatataccaagatgtggtactcgcgtgatctcctgccggggactcgtaggctctcctacgtgtttagctcgcgcgagaactcgccacgtgatgggcagtgaccggatgcccaagtgcttatagctatggtcgtcccctgagcattaccacgtgttgacctcacgtcaggataaggatactagttagtatcgtttttctcaaagtaatatcgtatcgtagtatccggatactatgtgattttctttttaaagtttaattaatatttatattaattatatatagccattctgtataaaaaatatagtaatgatatatatcatgcaaatagagacatttatcaagagaaaccacgttggttttaatatatttagctgatttttatataattttgagcatatttaattacattattttcaaaccatgttatttaaaataagatttcgtagtatcgtagacatgtagaatcgggatatcacctaagatttcgtaggattgtgtagtaatgaatagtaggatcgagatactatgaaaattaagatactagataggatcgatatcgttttggcttggtaggatcgtaatatcgtaagatactaggatacgaattgaatactgacaaccttgcctcagggaagtcaccccgtggacgacaccgagctaagcattctatcatgagtcaacattaagataggctccgaaaaaactgtaatctttaatttcaatgagccaaatagaaaaaaaagtatatatacagctgtaatcctacgaaattagtcgacaaacccatgtttcaaaagaggcgtaaagaattggccacaggacgagtacaatccatgttcaagttggtaaagaataaaggaaaaaggtttgacacagtcaaatggaaacaaatgttacaatacaattagtcaagccaaacaaaacctttggttgctcgtgacaattttctcgaatgtatggcaagcattttattaatctttcctattagtattgggccagtcatcttaggctgtgtttagttcaacatcaaaattaaaagtttgattaaaattagaaatttaaagaaaaaaaagttagaagcttatgtgtgtagaaaagttttgatgtgacaaaaaaaaattagaattttgaaaaaaaagttagaaactaacaatcacctagataggacgttgcatttgaagagagcccctggcaccgtttgagctgcaggggcagggaatcctgcaccgtttatttaccctcatcagtcaccttgctcactttttacagtcttttgaacagtgacgctgtgactgcgaccaggctcgagacctgggccggaaggtccaaaaggaaatacgagtaattaatactcgccaaaggccccgaaagaaagaaagggacagtgcaaaaagaaagaatttttttaaagctcattggtcccaaacaaatctgtgttatcattgcacattgctactgcaattgacaaaaatacccatgtgagaaatttcagtagaatcacctgtccttttaaaaaaaggaaatacgtagtgcagacctaaaaactactatcggataaaaaaattgaattatgagaattatccatgtcatcacgaataaattttagatgtttatttttatccaatgataattttacatgtttccactacaccgttgattaaattcagtcgtgtgacacttatcttctgaaataaattgagtaccatctactccatgatccatgcatatactattctcacttgaataaaacaaattatcagaaaaccaagccacgtaattggagcaccttctacaggctcacatagccagtcacatgtctttaaccaaatgtataaaggtgttattgccccctttcaaccacatatttagtctcaagaaattatctccggattgtttctttcccatttatagatcagggacagtgcccctaaaccttttggcaataatgatgaaaagctggaatgagctctccaaggtttgctcaccacccttttgtccggtggtccccccatggccatgaggagcgttttcttatccttcccctccggctccgacgtttgcttgctcggctccctccgtccctctccgtgtctgttaaagaaggccatcagtgaagacggggggcaatggtgtcatttcgtacgccttttctacatattatatcagctgttctgacggcaacagcgtacggcgggggcgttatctcttcgggttgcgccgacctgatggcgaacgccgaacggacggacgggatgcggagctttgtttgcatcgccgcgcgtgtgcgccacggaccgagattcttttgtttttcctttgtgtggtgaacgttgttgcaccggtccggtatactccggcgtg

SEQ ID NO: 28185 - DNA, 13933 bp, Oryza sativa
cccatctccagcatgtcgccgccgacgaatctcctcaccccgccgtcgccctttcctttccccccaccgccgatgaaactcctcaccccggcgtcgccccttcccttcccttcccccccaccgttcatcggcgacgatcccaccttcggccctaccggatccctctccaccaacggtagagaccctcatgccctaccggattgatttgataactacaagctccatccacacccagtgctccactcaggtttgatcccagttcgctgcctgctccactcctttgatccctgttccccccttttgtccagataatcgcacacttgggcaaactcaaccaaatttcgattttcagatatattgtcatatagtgttacacaatgagaattcctgctcacaactaaatagctggacgtgctcctattttcttgcaatgctatatgttagttttgagatgcagcggctaagcgagtagaatttgtgagctatctaagtaggatatgatttaattggtgcaaggttaatcacaatagcagacattttgtagattattattctctaccctctgagtaaaaaactgaaaatagatgtcttagcagattcttcagatgttcagcagaccactgtgcgtgaccccgctgattggaaacctcctgtgcgcatatcctgctgtttccagtccatgtcctcggttcatgacctgaattgaaggtaaaagcagtttaccaatatttttactccttaaaaaacaaaggtttttactctgccaattgatttattccgtgatataaatcagcctctattgaaacctatagtgctgaagttatgctttatgaatcagtactattttctaccgccaaccattgcaagtattcattatggtctttatcatggtttatggtttattatgaccactagcaatgcagcgtgcacaaatatatatatatatatatatatatatatatatactgattcctttagttgtctctcatatacaattaatggatatatctaaaaactgaacagtacggggcacaatgcagcaggaaaatggcttactgaatgaaaagtatgaacataaattcatataatgccaaaagcatatattcaagcctagctttcattaaaatacaaaagtactttcctctagaaaaacacgaaagtccttggatataacaatacacgtgcggtgtgtgtgaattaacatggtagatgtcatatcaattaactcatgtgtaatgttttgcgatttaaaaaagccacttctgcatggttgaagcttttgtgatcttatatgcaaagagaaaggtaaaatgaaaatatcaaccttgctcacattattcatgtttgtgttgatcctttttctaagtgtattttaatttgatctttgtgtcaggttataggaaacaccgtacctcttatgaacagttatgctacagaagtcctttttgggaatttgggttcaatcacacttggaattaatatgaaaatttattttgctataaaatatgaacattgcggccacaaagagtgttaattttcttccaattgattaaaggaaattctccatgaacccaagtttaaccactttgttcctttgctatagggtacagttatttaatttactaggtgaaaccccacgcattgttgcgagaatttagtatgataacaataaaaaaataacgtgtaagatagctaaataacatcagattaagtaaattaatgtgctttatgataatttaaatttaaatagtatgcagaatggtgattcaaacgtaaaaagtaaggtggtatgactttatggaagaagaaaagtagggagatagtttggaccgtagattaatcatctaaattctaaaaacaattgatatgatatgacttaattagaggaaaaactgaaaaatataattcgaaccatagattaatcatttaagcactaactaagtgaggatgagctatataagtttataggatatcataaaacataataaagatatacattggaacattatgtgaattatgttggataataatttaacatgtttgtatttgaaaagctcttaaattataaaaactataaagatatagcatgtttgcttgatgtttaaatgtgatgattgttagtggatgatgatgtaccatcttgttagtggatgataatgtggcatctttgcatgttaagcttaaggagttagtgggggataactttatagtaagatagaattagtgtacagtgaatgatactgtgtaaatgtttcatctttacatgagctaatttgtgtgtgtttttaaatgcatgcagtgtcttgtctcttcttgtacaatggtgaccacaaggttatatgttagtataggtccccacatgttcaatgtgaaaactcagcgaaattttatagacccaactgcaattaatcaatgaaccgaggtcaatacgagtcatatcatgctgatattagcggtgttaacgggacggaaaatacgatcgaagatgattatgtccgtcagcctgatgaaattgtcattggttatgcagacattgaagattcagtgaacgcactgattgaatatgtgaatatgtgttcccctcactcaatgatgagagatatacaacctccgcggaatatatgagcacacgggccattctctcaacagaaaatgatttcgtggataagctgaacaggaagatgatcgacaggtttcttggcgaggaaaagatttaccatagctttgattctgttgatgatgattcccaaaataactaccctttggactttcttaacacgataactctaaatggcctctctccacatgagctgaaagttaaggtcaactaccatgctattctcctccgcaaccttgatcctaacaatggattatgcaatggaacaagattaatgatcagggcattccaagacaatgcaattgatgctgaaatcgttggtggacatcatgcacgaaaaagggtgttcataccaaggatctctctgtctccttcagatgatatttccctttctttcaagtttaagagaaagcaatttccaatacgtctaagtttcgcaatgacaattaataaatcacagggacaaaccatcccgaatgtcggtatctatcttccagagcctgtattctcgcatgggcaactttatgttgcattatcaagaggggtgtcgagaaaaacgacaaagattttggcaaagcctaaaaaagaagtgcaccccacaggaaggagcacaagtcactatgatgttatatctttttcaatttgagttatcaaatgtcatcccatagcattagcatgggcatgtaatagaaaaataattataatatgaaaatgcactatattatataaaaaaaatatcacccactggtgatgcattataatgacgcagatatatacacacacgcacaccacatacagaaatgacgcttgtgagatgaataaatattgatatcaacgccattgtaaattattttgcgtgtcacggatatatgcattatatatcatattattatgcattatgacttaagacacagatatgcgcattatcatatatctttaatataatattattatgcattatgacatggggcacatatatatgcattatatatctgcatcaattggtatatcatattattatactttatgttaaatatatttgatgtacgaagtaaattgaattaaagctcaaatgtatagttcatatagtaatatttttttgctaacatgaaaattttaaaaattattaaagacaaatagagttacaccgggtatattactagtacgttgtgatatgacccgctaccgtatcttactcctacattcttatcatcagtttgctgctagatcctcgcgtgtttgttaacgaaccagatcttacacctacccgtaccggaatgcgtaaaggcaaagctatgcctgggaagttgggagtggagcagcgcacggctcgtcgcgtacgtacgtgctcgctcgagcgcgattgtgagacaacgtgacggagcaacgcgcgcgacgcgccacggtgtgcgctagctaccaactagtataccgcgctacgcgaacgcgggttcacggtaccgaaacgcggcgaggagcgcgtggcaggagtacgtagacacagcacgcagccacgcgcacacgtagtcgtgtacgtacgcgcgcgtaccggggaacgagcggtaggcgcggggtcggccgacacggcgaggcaagcgcgatctcgatccgtctctctctcaaccccctggtgcagtgccgtccttttcccggcattttctcccacgcccccccgcccccgcgcggccggggcgccatgcgttttgcctcgccaaggccacaccaccgaagccagccgtgcctcccgttcccagatccacgcgcgcaccgcgtgcaccgctgctctgactgcttcgcttgtctccttgcgtctagccgcgcgcgtttgtcagctccagcttccacacacacctgactactgtacctgacattaacctgcacgcccactttgcaacacaatcgttgttcagctgttcaccatgcctttgactgtttaacatcgatccatatatacgtagccagtgaagccggtgtacagttgagtacattgtacctgaggaggagtaattcagaaatgtcaaaggctgggggtctgtctgtggcgttctactaaaatactagttcagacatgtcaacgttacggtttaactagccagcgatggcaacactggaaccaacaaaataacaaacaacagtaaagtagtacggcttaagtatgccaacttggttacatcgaggatgtaaactgtgcttagtttatcagtttaggtgatatatatggaccagctccatgctagctaggagtagctagcaacaactagaacagtggatcgcactgcgtgtaataattgcaatgcacatgatcaagagatgttctgggaattaaccacggcttgcctacaaaattcacgtatctgtacttgtataacagcctcaagaaaggggacggatcgagacattcatgtgcggtcgaggagatgactctgcctcggttctcttcataaccaatagtacatggcatgcatgcatgccccattcttccttcacctataagattttatctctgttacgcgtgacatgaatgcttagtttaatacgtactgttagtacttctgcattactgtgattttctgcacgttgtatagtggaattactaagtcacaaagcatttaatttaaacccgatctgctaagatattttacctctagaaaaataatattagcaaagcattgacaaggacttcattctaagaaatgttatcaacgaattcaacttccagaatatatcatcatacgagtcaacttatctcaaaaatatcatcaccatcaggattccatccgttaactctactctgttagcccatttgaaaaatgcgatagggttaatggagagtaatggatggaatctgataacaatggtatgactcatatgatggtatttcctaaaagttacattcgtcaatagcttttcttaacatggagaatttgtcaatggcattttggattttctctagtaagatttacacattgaccctcttatatgatgcaataattctaatattatatccctttccaatcacaaatttcagctgctaaaacagtggagaaaatggtcaaaagttattgtaacccattccagaaacagagctgttaatgccaaaaaaaaaaacaaaggtgcatttgtcttacaacttgtcatatgaagaaactattctgaacataccccgatgtcgttctgcagttgtatatattgctccaatgtaaacctatcacacatggtcccttcctccctcagttctagcaaacccctcgaagcattgggtgagctccgagcagtacagtgcaagcctttctcacttctatctatttcgatcatatcatatatccagacccttccatgttctctagcttcttgtatatatatccacttgagtgaaccactactgctatctgctccatgcctagccaaagctctccgcaaactctcaatgggaagctaaagctcaacaccagcaccaccattctcctgttcatcgtcttcctcttcactctctgtatcatctcatgtgaagctcgtcacgatcacctccgtatcagtgacaagtactcgagcaagaagtcttccctggttcccaaggtcacagcagatatatgatcattgttatggaactattttttctcattcctgatttttttttctctgtatcacgcaggatgtggctggagacgatgttgttgggagcaagcagccgatcgatcaatcagtgggcaaggaggtgacgctgaatgcgaagatggaattggcggcatcatcaggtggagttcgaaatactggacccgctgttagggtttcgcaacagctgcttcgtcatcggaagcacgaggatgatcagggaattcacctggattatgctcaacctaaaacccatactccgtgccataactgatgacatgatataatgtcaatgctatccatccctctgattgtctagtaatctgtctagtataatcctatctagcctgtatgtttttctagctgtgcctcctagctagcactagaacacataatgcacgtacgtgtgcatgttttgatgagagccctcccccgctgtgagcctcactagctactagctagtaaaattatctacaaacactcatttgcaaactgacagactgagtgctagctatagcttggctacagggagttaattttgatatatagctcgaatggaacatgctaatcttatatactcccatctctttttccctcgatctcaaatttgattgatcattcctggtagtattgtttcatagcaagtggtcgtgtgatttgcagggagttcttctggctctctgaataaacggtttgaaggaaccaaggtatgtatatatgcaagcatttcagtctgagatctcacatatacacatagcaagctcccttcttaatccccatagcaaactgggtatctggccctcttcttaatccccttctgcaaaaataatgtaggtgaggtcggttgcgcgagagcgttcggtgctaggagctgagactaacagagagcaagtaggatcaaagccggcgaccactgcgtacaccgcggaaaccctagcagccatggactacccagttgcacacacagcaccagctgttcacaacaggtagccagttgcaaaaatgccaaatcgatagcatgttcggccttttcacataaattggccaaattttggaggcatatatcgagagaaaacagttcgctgttgatagtgtgatcactggtcagaagtatgtagcgtcagatctctccgatttacttagcccatcaagcatcaagcctgtgatgttgtatatataggattacaaaatatggaggcatgagtgaatcaaaacatgagtttgcaatgtgcatgcctcttgctgaaggtggttttcgttaccaattacatatgtgggatctatttcctgcactggtctcctcacaaaggacctgtttagggaagttcagccgcaacatctcctagaatcttcaggtcctccaaacatgcagtctatattcttacctagattatgagaatttgtaaatatagaatcgagatgaactagaagctagtaaccctagcttttccagattgtcaccaattgcttctcagaatcccacaaacagaatcaaaaagttgatcttacatatgtccctccatgcgaaacaaacgcgctcagcaggccggtcggcaccgcacagtatgatcttaacctttcttggttcagacgacagagctgctgatattttgtggttaatgatagagtactagagtctctgagatcaagttccctaggctcgtcattggctaataaataaacctagctccagaagaccgagactatttggagtaaatgtttcgtgaatgttgtgcacctggagcgcagtcaacagtttatgctgaagtcaagcaaaacgtgttgtacagagtacagtgcataataaaagggctttctaaaagttcagaactttcaagtttcaacaaacagtccctgcttattgagttccttttttcttagatggagctttgtacacgttccatcagtcaggctccagcctcttgcattcttcatgtttgatccagcagaccagcacaagctcttgaatcaacgatactagttccaaagcccccaaacaacatcacctcaaaagaacaattgtatggcaccattcagcaatcagaagaaaaaaacaaacttgtagccaggtgtctgattagaaacgcaaaactgagagtaaatcctagtatattgaaggcacgaactacaaaggtttttagtacatgcccacttgtgccaattatctcaattctcccaagaatgccccctgatccctgcatcaatcttaccaaaatagtgtaactaatgcgagaagtgcaactggaacagaaacgcctgctctaaaaaagacagacatcccaaccccagatccaagcaaaaacctattggtttacatccctggcgatgtctcatgtgttcatcaagatggtaaaaccacatggattcaaagtttctcttccgttgtacagttatcactaactacacttcaccacaaatggtttgaatgcatttaggaactgtgaggtccgcaccccaagcttgaggtcaacttctccaccacccagccagaagaaatccttatctaacttggtaatagcttcatcaatgataacctgtgtagaaactcattgtatcagatgccttgaaagcttcaaaatatatgtaccctctctttccagagaaacaagaaatacaagaactcaaaacatccacgcgtaaaatgcaatctatcagaagtgtaacttgataagacagtttgtcctactcagagttgaaaatgaaaccaaccatatatgtcaccagacataatgcagacagggttagaattcaagaaaggtttaacaggatttgtaaagtacagagttttatatatgagcgtgcaaaaacatgattatcccttatattcttgcaagatctccccatttgaagttgacccttatgacataaaacctaaagttagaggcaacatttataccggtatgtctgtttccattccaatgcatgtaacagcattgtgaacaaaccctgtaagcttgagtgactcctcttctggtgccagcctcactgcacaaacacaagtaaacaacatgagttaaagaatagaactggcataaaaagtaggtcttcagacacacctacaaatcttgaaatgcctaaaatataatagaggcaacattactgcaggatgctgaaatctacacacgatatactgcattcctttatctttgatcatggtcacacatttttccttaaagtgaaaaaaataccaccgtatgaaaaatattgttgtatgtaaaaaccatcagacaagatgcttgccttagttgttgatattaaaaccaattcacagcataccatgttgttcaggaattaaggttttctcccatcctgtgagaggtatattcctcctcatacttcagatatagcattccatggagaggtaccagaactaatcttataggttagaataggattgtgaactcatctttatatatgttcttgaccttctcttacgtttttttagaggtgtaggtatttgtgctagtcaagagatacatacctattcctctctactaacactaaaagtcttgccactgccaattatgaacttgtcttctgatcagttcaacaggtttatttttttacctcataaatagtagggaggtatatacctcactaaggatgggagaaaaccttcgagggatttcatggaagctttgaatgctgatgaccaataaaaggttatcggtggcatttgtagagattagatttgtttcaatatattattataaatcttactgttaaatctcttcttgggtatctgcttctcgtttagggaatagatgaagttcttgatgctgtctgcattaagccgtgccatatactgcaaatatatccgtgtgaagataaaatgtactaattaaatttgaagatagtgtgttgagatcaaacttacagtttacctgaacaacaacgacataatattttgaattctttggattgctgcagtcaacaacatctgcagcagcttgtgtattcacctaataggtaacttcaacatcagcattaacacaaaggcttcattatttacagatatgttggcataaacatgaaattgtggctctacggtcagataacaaaatattgcacatccctcctcccattaatgttgttttagccaaatataaaagagttaaatttcaataaataaaatactgcactgataggcagtgaagttcggtccatattgcatttctgaatctaaagttgagaagaatgtcaataagttcaatgcaactcaaaacttcatgtatagctgagcaaatattcctaagagtgctcaaaagcacaacatttcttgcttagcagtacacaccctcttctctacaaatgccatgaaaacagagaacattttgatgtcaaaatattgaagctgctctcgaccaagttgatccaactggttaaaaatattaatatataaagctgctcccatctatcaacagtccagctgaaaccaaatcacaaggagcagctctacagctatccttctctgctgtatacttcaacttaaaccatttctttcatagttcactacctagcaatttccaatttatcatgttaccaattaccacgtcatgctaacaaaaagtatcaagtcattatcttgtacctcaccgacgacaccattgtgtctaaaaccctaaaaagttactgataacacaaatccaaagagctatctccaagccgacgttacgcaggccaactgttcgacaaaatgccgcacgggaaggaaaagggaggcccgtaccatgacgatgctcttgcagagttgattgactgaatctgcgcggaggaggtcgcggcgctcctcaagagggcggtcgtagtagtcggcgggcacgcgccggaaggtgaagtcgagcacgccgcgcgcggtcaggatggaggagagccgcgcctccgtggcgcccgtctccgcctcgccccccgagggcgccggggagatagatagcgcccccaggcggtgctgctgcgcggcgagctcgaggtccgcgacgcgggggaggatccgcagctgccgcgcctcgagatcggccgcggcggcgtccatggtcgccgttgtctgtccttcctaggggactaatttgatggttttggggacttcgaggtccaaaggctcagctaatcccctgtttgatgccaaatcaactcacttgcaaaattaaaaagtcaaattgtaggactaagcttaatcaaccatttgcatcttttaatttttttaaaaaaaacaaagtgtacttttttaaggaaagggagcactttcagtttaaccttcgagagtgacggtgaacaagatataggcaataagataataaatctttctaatgatacagtcatcgaacaacaaatgttgttggcaatctagttaatgcacgtaatgttgtgactaatgagatattgaggtcaatctgaacttttctttgaacgagtagcagatgattgccaattttgctaaagataagttatggtcaatcaaggttaatcgtatttttgacactcatgacatatcacatggatttgtaatttaaaggtcgctattggacactcacaaagctcatattcatatatagcctattaaatcgtatttttcacgtaactataaccaccctctttattaaatatatttacatgttgagttgtgctaattagtttaaatttagagtaaatttcacaaaactacagatactatgaccaaattatcataaaactacacatttaacaccaaatatatctcaaaactatacatttaagatgaagtgtcacaaaactacatgtttagtaactaaattattataaaactataggtttagaaccaatttaatcacaaagtaataatgtttatagctccaccataacaatggtgctagggatttaaacttcaaaagttgtagttttgtgataagttcaatattaaatatgcatttttgtgatacttaacctaaaatctgcagttttatgataattttggtgctaaatgtgtagttttgtgatacaactccttaaatctgtagttttgtgataatttggtcaaaatatctgtagttttatgaaatttactcttaaatttataacaattcgataatagactaacatgataatataaagtttctgataattatgctaagtgatttacacggccatgagtagccatccttggtcaaattttctcataatagggaagttcaaaagtaaacatgttttgtttaggtttagacgtgtccttttaggctgaacgaaatggaatggaatgttgaatagcttaatgattcgaggaacacatgaatgaaaaatacacaatggtatttaatgaaaagaaacttggatgtagcatttaaaaatggtatttaatgaaaagaaactcggatgtagcatttaaaaaacacacacacaccatttataagttcgaagagcatgcatatttatgttcaattcctttacggaaaaagagcgcaccctatccttgttgttgatacacactctttgtccctcttagcgacccatagtcttcatagcccatgatttttataagattagtatatttgatcaccgctaaagtattgtaaggatttatgcatttaaaatgatcttgaatttatcatgtagatgttactttattgaaaattgttagttttccaccctgttttatagcatactaattagaacatacgtacttctttttttggtaatgtacttatgtatgtctagataaattttatgtattatactcgtgtaaatctatctaaactaaaatatgtttattttttaaacactcgtcccgagctatggatctatttgtaaataagttttacattgtaaccatttaaaaatactaaaaaaccatctttatgacctatttatataaaataaatattacaaagggtcattaatttgcatctctatctttatagcacatttgtttttgtcctttctgttaacatctgatgaatctttccaacctaagccacatgaagattctagatacctcctttctatttcattcaacggtaaatattggttctacatataaatccaacggtcatcttcgctcgacgatgtggctcatcttgggaacatcctgcgaaaaactttttacttatagagattggcgcaaggcgtatacgtagccttccaattaaaagtcagtaggtagcgctgtgatgtaagaatggatgaatatgtgaacaactataacaacagaaaagtctgttcaccagataagctgcaatgattaaaaaaaaaacagataagctgctatgacggagttgtgagggccgggtttgattccattcaccagtgtttatgtctgtgtgttcataaattagccaatgctcaatccaagccggatatccaacggggcaatgaagacatctcgtacatctcactgccagtcagcgactcctttttccgcgtgttcggcacacggactccacgtccactaaatttcgtgtactatgcgtgccgtgcgcagcggtgaacccgatctctgcatacactgtgccgtgcgctgccctacccgacgcagcggcgagacgaagaaatccagcgcgtgtgacgagtgacgacgtgatcaagctgtcgggggacggaccgggcaaccggccacatgaaaccgagacctcgttacggggcgatgaaacgcgcgcccgttcgtcctgtggtgtgggccggagcggtcgtctcccgcgcccaactggacacctgatgggttgttactggtcgatc

SEQ ID NO: 28186 - DNA, 1567 bp, Oryza sativa
attatctcgaatacgaataagaatcgaatatgatcggacacaaatacggaaacaaatttttctcggaacacgaaaaccaactcaacttctaatggaaacaaatatcaacatatataattagctcattttatataaaatgaggtataatttataaatattttttaaaatttaaataatattaatagtatggactagtgttaagagataaactactattaaaatctataaaggtatattgaaggttatagaattagaaagaaatggggtatgtctcatgggtcctgcggatatccgaatagcactgttcaccggatatccgaattattatccgtatccgacggaaaatctggtaccatattcgtattcgtatccgggagaaaatatccgtattcgtatccgtatccgaactatccgagaattatccgattcgaaaggtatccgtatccgtttttgtccagagcggacggaaactatccgctccgttttcatccctagtggccggtggtgcagccaccccgcagccggcaggcccacgcgcggtcacgggctcccggctccgcgcatctgccgcctttggtttggttggcacttggcaggttgggtcccaacactcatagcactggctactgcagctgcgcgcgcgagccgtggaggtaaaaaagatctcactgcgcgtctgcgccgcggctgtgccgtccggcgaccaggaatccgcttcttgggtgaagcggatcgatgtgccagtaggcctgcctggccacgcagaagaggcctgcatggatcacgtcaaccctgtcgcgctacgtacgttcgcgtcatgttggacagctgaagcctgaagaaggcgtcacgtattcacgtgaatgcttctggagggttccgccgtcttccaaattactactctaggagtagggaaaattttgttctagggtgtgttagttcacgttaaaattaaaagtttggttgaaattgaaacaatgtgtgatgaaaaagttagaagtttgtgtgtaagaaagttttgatgtgatggaaaagttgaaagtttgaagaaaaaatttggaactaagagcatgttcactttgatatcattttcaatcttaccagattttggtagagttgcgaaaaagtggctacatttagtttgctactaaattttagtaactatataagaaatcctatcaaaattattgccaaattttagtaaggttttttttggcgttaaagtgaacaggcgctaaactcggtcctaattggctttctttgtgctcacggtgaagtaggcttatcacgaggaatacagtactgttcggcggcctatatatacatgcagcgcctttgtatgacggtttaaaacacgtacatacgtgtggattaatcgacgtgatttcggtggtaatttcatcgtacacctacgttgttttacgatggtgacatggtgtataagtagggcctgtttactttgatgtcattttcaatcttactaaattttgataaagttgtcaaaaaaatagctacatttagtttgctgccaaattttggtaactatatggggatcctctagagtcga

SEQ ID NO: 28187 - DNA, 3961 bp, Oryza sativa
ttttgacaacttgccaaaattttggtaggatttcttatatagttacaaaaatttggcagcaaactaaatgtagccactttttgacaactttaccaaaatttggtaaggttgaaaatgacatcaaagtgaacaggccaaagaaatcctgccaaaattttggcaactatgccaaaatttggtaatgccaagatttggtaaggttttttttggcatcaaagtgaacatgcccgtagagttgaactttaaaatccaaaatcactaatatatatactagttgagcgtgtattaatttataaggaggcaaactctatacatatatatatatataggttctatatatgttgtgtctctgtttttccctccaactaaaaagaacaaaattgagagccaatctactgttatatgttgtctcttagtggaacagatgtaaattttaaaaaataattcacaccgaaatttccaacaaattaactgtcctaagtacattttgtcgtacaattgcttgcttacaattaaactacgagaacgtactgcaagcaaattacaaccacacccagacatagacacgccaaattcaatctaaaagagtatccattgcatgcaattccttggagaacaaaacctccattaattgaccaaatgatgacagaaactgattaactgaagaaacataaacaaatcaagtacagttaactcgctggattgatatctgaagcagttctacattcagaactaataacagagtaagtaaagactcgaccgatatgcatgcaggcactcaagaacgaacgatgtgttcgtgcatgcgtgctgcatgcatgcaaagctagcacgtcgttacaccgtacgcgcgttacgtagcttaagcacagatgaagccactagggacgttcttgccgcagtagttgacgaggaggctgagcttgacggggatgtcgagggtgatgccgagcacgttggccttgatggcggtgcagagtacagacggcggcctcaaggtcggcgaggccgccgaggacgccgcagcacggctcgtacggcggctggccgacctcggcgctgacgaggcccagcacgtcggcgcacgccgcgaacttgagcgcgttcttggggcacttggtgttgtaggacggcgtcgatggcgtcgtcgacggcgtcgaaggcgtcgggcagtacttgccgcaggcgctggccacggtgaagaagaggaccaggtttagagccacgaggaggaatgccctggaagccatggctacgctagctgaaagcgtacaagcacttgcgccgttgcacacagggctacgtaagtgatggtctgcaactagagagaggtgcgaaaactcagcagagtacgtgggtatttgtaggggagagaaccagaaccctagcaatctgttgttgtcaaaagactcctcctgacaaaccatattcgcagatcttccccaagattaatacattatgtgcatatatgattttttgtgagagtaacgtacttttttttaagaaatacattacaaatatagatgctcacagttcgtgcacacacatccctattaatacaaaaacacacccttctcatatgaacatatgtgaaagactgatccatcatatattgggattgacgaagtcaccacgagtgtctcactgttgatggtacattggctatcactaaaagaaaaaatagacgtaaatgtgatacttaaatccggatgagctggttccaactagagaaacctaaccagttaagctacgcttatttcacaataaaagaacatcctgaatgatcgatcatgcacatatattagatgcggatttgcgccagtgttgtagaaaacgggcttaccagtcatttactttagttgtttgtatatgtaggcaacccaagtaatataccgttcagtgtctaacgtgaccaccacatgtatttgattgagtgttatccatacaaaaatagtcactcatcttcagtgtgtccatgatcacggttaacacttacctttcaatatatgaactatgatgccgagtagtgagtaagagagatattcgatagaataacttgctaggcaatttcaacttaatatatacccgtcaaaccactcaaagacgacgatcaaatgtgttacatacctcagtgggtacttgaaccaaagcactacatttcacgatcatctcaattactcaaaacacttaatcatgcttagctagtccctagaaaaagcgaccagcctcacactttcatcgcaagctgttcataagcatcacaaatgcataaatatggataagagagcagcaagatacatataacataaccgggttcataaacccgtcatacaacacaaagatagcagcaaaagtctcataaattcatataagcaaaaccaaacccgtatttgccaaccattccacacagacaaccaaccagggcaagagccaagctaaactaccctcaacgccctcagtagggttcatcatatgtatttggatgagtgggatccaaatacatgtggtgatcacattggacactagacgatatattacccagtgtacctacaatgggcatgaactatttttttgacgcgatacatagtacaattatcatttatgagcataaaaactccatttttagcaattgattgaaccttctttttatcatctataaataatcgttcgtatattacacttgatcatttaaagtagcatatttatcttttatgatcttattaatttgtttagtgtttctatatgtttatttagtgtttccctccgtcccataatataagggattttaagttttttcttgcaacgtttgaccactcgttttattcaaaaaaatttgaaattattatttattttatttgtgacttactttattatttatagtactttaagcacaatttttcgttttttatatttgcaaaaaaaattgaataagacgagtgatgaaatgttgcaattaaaaactcaaaatcacttatattgtgggatggagggagtagtttttatttatccaatatgaaccaaactccatcactatttggtgtacaactatgagcatcaaaagctatattttgggttaatgtaagctatgaccattcaattgacatattaggcttatatagttttatgtttttaaatatccaaagaagctcataatattataaaatatatacatatatatgcataagccaaattttcgcacatataattctgattaatttttcatgtttcggttaattgttgagtggtaccctctctgtatgtatttcacatatataattccgattagtcgactgtatttcacaaaattgattattatacatcatatttttatgtatacagattgtttgcatagggccgggttatatattatatattatatatggaaattaaatgattttgatttataagtgtgggtgacaaataataacgagagcctaagagttggcctcaaattaaagttgttaataaattaatattgtttgcactaaaaagggcgcaccatatgcggttgtgtgaagtatatagtgggaaacaactatcttaaggaagaaaatatgtttcaattaagattacctctgaaggtaattaatataagtcagatatagcaatatatatctatgtggaaccaattttgttagtaactcacaaagatgctgatatacatgcatgcaagacaacaaaagaggcggatctggatttgaagaccagcatacatgaggggagcatatcttttttaagactgacaaatcatgcatgcatgtaataattcgcatttcaggacgcaccacctcctatacagcgaagtaagtacatgcaaaactatgccgagctaattgcaacttatgttgatagatattgacagcacgatatttgtcatgcatatgcggatgtgcataaaaccctcgcaacacacatctattgcatgccaacttataacccagccagtcacatactcacacag

SEQ ID NO: 28188 - DNA, 6379 bp, Oryza sativa
attatggagctaggcatggggcttaagccctagctgccccatgtctgattccgcctctgtacttacacgcatgtaaatatttttccctctgcttaattaatatataacaccagctaagtctagctcgtttttttctaaaaaaaaagtagctagctgttcaagaataccacacgcaaaagtacctctttgtgttgtaccacgaactgcattagtcataagtaaaacactcactttaagcaagctactccctctgtcccaaaaaaaaaagacaaaccctgaatttccgtgtccaacgtttgaccgtccgtcttatttgaaaaaattataaaaaaaattaaaaaaacaagtcacgcataaagtattaatcatgttttatcatctaacaacaatgaaaatactaattataaaaaaattgcatataagacggacagtcaaacgttggacacggaaacccatggtttatctttttttaggatggagggagtagctagcagctttcgatctgagatgaaatgtggacaatttaggccaaatccatagaaatgggcaagtggcattgtcagcgcgaagtgagagggacaagcggtacaatgggtaatgggtacccctccataaaaaaaacttaacttaggaggggatgagaccactccagtccaatgaatctggactacccctttgtccagattcagattcgttgtcttagaaggattccctcttaggttgagtttttttttgacagagggagtaagtttgatccccaccatttaaaccgcgctctctacaattaccaaaaaataatttatcattctactggaagtaattaaatgttaaatcacatataatttatgtatagaatccatcaaacgtactcgtaatgtcttaaaggtagtatattctttcctaaatagagtacacctaaaaatgattgctgcgaacattgggcaaaaatttgaagtggtttgtttccactggtcgctgagttgagtggaaaaatgacaggaattaattgggagctactgccatctacttaccgactaatacttcctccgttcatattataagacgttttagcattgaccacattcacatattatatatatatatatatatatatatatatatatatatatatatatatatatatatatatatatatatgcgcgcgcgcgtctagattcattaatatatatatgaatatagataatgctagaaagtcttataacttaaaacggagatagtcctagacaaccgaggctacgtgtgttaaattttgtaagaaacactgtacaaacataatgctcacagtatccctacattcacccctatgaaacacgtgcgcacacaacactctaaaagtctagatcagtatatcttaatatttgaggagtcaccatggacgccttgttgttgacatatacgtcgtctatcaccaaaagaataattaatcataaatacaagcacccgtgtaaaatctagtaattgagctcgggtatactgatttcgtcacaatgaacctaataagctgagttgtgctcactttacggtttatcagtgttgattactcctcatttggtaagaaaatatgggtcagtgacactggcaaaaagagttctattatcacaaaaaaattgatgaggacatcctccactattacccgctggcaaagacgcaaaagtcgggtggcgaccgtgtgagcctctgaataatcccaccttacttagcttggaaggagaaagccaccttaaaagagagagccaccatttccctattggactagtctttttgggagattgggtattttcccgagtgggtgtgactaagaactgttggggtccgagcaatcttaagttattgggtctcggccgaccctacctgagccggattgttatcaaaaatgatgttcgattcacattaagaaaaaaaatgtcattacgaatgaatttttggaaataaaagggaacccaaatcacatgcatggaggccagatcagatgcatgaccgtggacagtgatacgaaaggtgtgtgtatcttgagctggcaaagataaaactggcagtgagccagcgacaagggtcttgtccagctcgtggctgtggacagggcgcagtcaatgctgtgttgccccatggagtacatggactggaccatccgttctctctgcttttttctagaccccctggccgcctttctgcgcgctctgtgatcactggccgaagcacaactcatcaacgtcacatttgccggccggcagatggcccggatagcctgaacaacgaagtggcgcaacagaaactcagtggcccagaggaggagcacgaccagcgatcgacggggagatgtgtttggcactcacaaatccatgagattttgtgtacgtgcgttgctttgagggtgcttgcatatgtgactcttcttctgccttttggtacatgcagtatgagtttccttttacctgaaaccaacggcgggaataggagtaagcaacgacgctccagatcggcagagcatgcatcatcgtcatttccttttttccaagttgccaagaacaaacaagggctcgtgacagttgcattattgcagaacgggtctaacacaagaaaacaacatggcatacgacacagggttatgaatgactaactgttggagagatattctttttttgatcttgttggagagatattttaattgtacgtgtggctcatactgattcaaccattctcccacactgcagggtagggcctagcgtggaaatgtatgcgctgtagcgttattggcccttgggatatactagtactgattcactgaactactatgtctgcagctgtactatctagtgcaacacccagagcatatagcaatagcaggttataagtcaactataaccacgtatcaagaagaaaaaagaagagagagaagaaagcatgctataaatttgtagccagctttaacacggtgtatgagaggtggctggatattaatggtgtagtatatttttataactaactattacatgaatagactattaaattagctataaatgatttatagctaacatttgactatactagtattaaacttgctctcaggaggtagttcacactgaaaaaatgttagtttcctaagaggtgtgcttaattaatttgtatatactctcactaaggtgtactccctctgtcttaaaaaaacctaacctaacctagtacttaaatgggatataatctagtatagcgaatatggacatgtgtactagtctatatcccatctaagtactaggttaggttttttttaggacggagggagtagagcacaactaaaatcggaacatgttgagaactagttatactgtcctctctgtggtttagttttgagtgatttactgtatttaattgtctaccgcttccgttcacaaatatatacgagaggtgggagtatggttatagtatttctgtgagaactaaatgagggtggcaattcggtgggggtgtactagctagctactccctccatcttacattttggaacggaggaaataggctacaagttctttacacaatattcattgataaattttaatcgttatgggtatgttcactttgatgcaaaaaaaaccttcctaaattttggcattgccaaaattttggtaacttgctaaatgtaaccacttttttggcaactttaccaaaatttggtaaggttgaaaatgacatcaaagtgaacaggccctatatttgtgatcggtgggtactattaagtttggcactaagaacattctagtagcaccttttttttaaggaacaaaaaacaaactaaaggattactcatctttctctctatacatatatacacacacgcttgcgcgcgcaggcacacaaataacacatcacgctagagggtcgtaactccaaatacaccaaacccaaatctccctacgagataacagacttttactgacggagtaaaaccgtaaggattaacaaaatattgtttggattattctatcctcacgaccactaccaggtacgcgtcgacaggaataaaatgtgaggaatgcgagattaatttctttcacaatggaaggtcgatagaagctaggacaccaaatcttgacgagaactgaccatgaggacatcatcttaacaactgcatgccttgttggtgagccaataggagcaatcgtccggactagaaatgtttgatgtgtctagcctctattatttgtatcacattctaccattatgggatgtatttggtttgaggataaggtcagaccggacataacgataatggttttagggacatgggtatacaactataactaatccttaattgcaaatttaagaataattaaactaggatgtaaatatatgactcaatgattattacttgatatgttttaccgaattccctaataatcatagtaattgaaattaagactccaaactaggtaaagctatatatttattaatttcaagtcataaaattatttgattacgaaaaagaaaaactaaggctccaccaagtaaaatttcaagtaataagtaataaatgtagcatcttacaccaactatgtctatgtaaattcattgttttggaggttttttttttgcgaggacattgttttggagttattaaatgaagaaaaaaagtaaagaaataataaacatatttgaatggtctatatataatacaagacaagtgcatattagtaaacgtttattttgggtttttgaaatattaatatgaatagtaagatacaccgacagttccctaacttgtgaggtggtataacttacctcacttatcttgtgagttagtagttatcttgtctctagggtgcatatatcattaaatacaagacgtgtggttgtttgatgccaagttggatgtcatatttacctaatacgatgtgctcgaaagtaacacgggcaaggtaggcacttaagaaaaggaataaaaagcaaattatcccccttatatatatgttttgcgcgctttgttctttatgagggcttttttttagaaaaaaagaagtattacattatgtgtttctacgttaaaagagaccggtctgtatgtttgtcgaaaaatttttaccgaccgactggatgtcagtatagatatttttttccatctaaagtcggatgggaatgttaatttggacatggtgtagtgaccgccatggcgttcaacttggcattttggcaacgatcgaacagcccatgtaacatgtgtcaatgagatttacatcctcaaaataagatgagtagctcatttaagtaattaatttcgagatgagtaactaaattgcacacaccacacaaattaattgtggtatcatggtgtattttatttattctagagttcggaattgtttgtgatagtaaataaatttgcatgtgagtatatatatatcccattttgaaaccaactacaaagcatatagaaaattttaaagttgttcgatagtcattattaacaattgaacgtgttatttcataacctggacgaatgtatgggctctctctattacatattataagacattgatgtttgttttatattatttttgttttaagtttaactaagtctagaaaacatagaagcatctacaatacaaaactagttttagtaaatccatccttgaatatattttcaagagtacatttgtttcatgttagaatattattgattttttaaatgagctttttcaaactattcaagtgtgacttactacaaatcaaatgacttataatatggatggagagagtatgaacgattttgattctagagatgtagtaccgaaagctagagtattagcattactccctccgtttcatatatatatggtatatattttagttttgtcctaaagtcaactatttttatctttaactacggtatctaaaattttgtatagtttaacaacatacgagtacatattataaaagtatttttttaaaactaaaagcataaatcatataacgatgttaaacttctcacaaatttggcacgcgcggagctgtagtcgtgcacgcacacatatgtacacacacagcaaacaatcacaaacagaagtacatatatatctgaagttgcaaaccaaagctttattagaagttggtaccggcacacaagctagcaccggcccttacaacaaatgcgcacgtacggatagcgggaataagagtactacaaagaagacaaaggagagagtacagagagaatccaaactggtaccgtgatacgtacaaacagccagcatgcacgatcgatcatgcgttgcgttgcatgcaaagtacgtacgtaacgtagtagcaaataaacagagcagcaagcaaatcaaatcaagagtcgtcaaagccaaggggatcctctaga

SEQ ID NO: 28189 - DNA, 2043 bp, Oryza sativa
cacgaccaggaacagagcgaacgccttggacgccattgctacgtacccgagatcgatcgatcacaagcgcagctaatcactagctagctaattaagagctcttgatcagctgaagatgattaggctgcttgagatggttttgatcatgggattagggaggtatttatagtcgagccccgggattaattaatcgaccgttagagctcatgtgaaccctgccctgccatcatgtgagcgtgcatacgagggcgatctggattggctggcagaacacctgccctagcaaggctcgtagattaattaacaaatcgtacgtacatctacgctgataatgtgttaaatcatcggccgaatatttggttagctgtgaagcactcgatcccgcaaatgaccaagattgctgcacacgacacatcgcgggcttgtttccttatgatcattggttgttattttatctcgcgatcttggcctatcgggcgtcgcttcgcgcggtgcagcgtgactgcgtgagcaagttggtgattttcttttgccgtttaagaatgcttgctccgtgatcacacaagagaggacatcacatgaaccgagaccggaggaatatcggggcatggtgggattggtgggtgtcccagtccaacgggcaagaagattctaagcttacctgggtttgttttcacgtacgcgaaggacaggggaagatgccattgcagcgtggcttcctgctggcccggcaactttaatctacactaggcacgtggctactaggtcggcccgcttagatagctaaggtaggctaggtaggtccgtggtaaactgccagcccatgggcgcctgggattcttcttgggccaacagaagcagaggttgggcaatgcgaagcctgaaaatcctcctcctccttctctctctctctctctctctctctctctctctctctcacgaacaaacatcctcttcttcccgaacaggctagattcaattttttttaatgaaccagtgagccaccaatttcattgaatagaagaataaaattgtacatgcgcaagcgcaaattagaaactttaccgtctcaaggccttgggccgaacatgttaaaggtagcccacctatcaaggtgtttcgcgcccgccaagacccatgtttgggcatcctccttaatttgggctatcagactagccaccggaagctcttggtgctgaaaaactctgcggttcctttcattccaaatatcctaggcgactaatagcattagagtctgcaaggctttctttggcgcttcgttggaacatgcggtggcctcccaccacttgagtagcgtcgaggcttgttgccataacgttggtcttatttgttcacatgttgtccagtctgcaagtgtcgcctagattctttcacatatctacactccgccaggaggtgagggccgtttcctgattccttcgacaaaggggcagatggagccattttcgattacccacgggttgccaatctgtcggaggtccatactctattttggataacaagccaagcgaagcgaatgttttacatttgcgcggcgcctagggcttccagataggggcattgaaattgaagcttttatgccaagaagttgtgcgttgtaggccgatgtcgtcatgtattcgccgtgactagttagcttccatgtgatcttgtccttttcgtactctgtcaactgcaggctatgaacagcaccctagacattgacaagttggctaattagttctgtcgtccagcctgaggttaccggcaaaccgaggtcaaccaaccattggtcgggaaagcgatacttgttgcaggcttgcattcttcttttttgcaatcgcgtagactagtggtgctatgtcctttagccgtcgcccctgaacaggctagattctcacttaagtttaagaatcagtacttaatttagaaaagctaaaagaaactttcccatattcagtatatgttggttgattgcttgtcagttgtttcttataattttcaactccaccaaataagatcgtactgcttctaatagaatgg

SEQ ID NO: 28190 - DNA, 718 bp, Oryza sativa
taccttcagaactaagaatcaattagatataacatcattctttgatgttcgccaaaccaacttacttttctttctttccagatccaaaacaaaagttgaacaaaaatagtgtaaaaggtttgcccagaatcaaagagaattatgtgcaccaaaggcttgctaccagacatatcacatagatcatcataaatttattggaactacacaaactctacagaaaactaattttttaaggaatgctttttttcaaataacttcatattttctgacataggataaagtaaaccacaacgtcagaaaattcccatctatccaacaaagcaaactaatcagttatgtcagcaaagatggggtgggggcaatccaatgcctttaggttagcaccacaccatcagtatgatgggtaaaataaccatatgttgtcaacaagtgggccaataggttatgggcaactaactagaatgtgccatgggtacagaagaaatataacaagcagtttcataaaaaaaaaactgttcaataaacattttataattgcgtgattttgtaagagtctggtcatgatatattacctcatgaatccatgcatttttccatggtgaaccatctccaactgcgatgcattccacaactgataatcatttagaaaaaaaataactcagtgtgttagagtaacttcaatatcagcaacagagtacaccacgtccaatagcactta

SEQ ID NO: 28191 - DNA, 680 bp, Oryza sativa
agaacaaaaaaaatcatgcttgggctaaagtaatcattcaagtctttcagatctaaacagcacgtaagaaatgcagatagaggttggctgggtcagctgattggttttatacggtacaaaatatgaaaaactacttgcctggttgtatttggcaaggcgctctgatcggcagggtgctccagtcttgatctgaccctgtttcagaatgacaaagatatattcagccctcacattcagtacaagagtaacaactaatacaggatgccgtaaagttcactacagtgaatgtagagcacagaatcttaccgtggccaaaccaacagccaaatcagcaatgaaggtatcctcagtctcaccactgtggcaatgaaacacaagtcaatatacaaatggttggtagtcagaccaggtccaccaggaataaagacaggtaagcatatcagtatacctcctgtggctggtcatcacaccccagccagcacgctttgacatcttcacgggctcaatactctcagtgacagatccaatttggttaacctgttgaaagacaagggtgatatattcgcacatggaagataaactattaaacgtgaaggaaagaatcaatagaaccataccttcagcagaagagcattgcatgacttctcctggattgcctttgccaccctctgcataacata

SEQ ID NO: 28192 - DNA, 536 bp, Oryza sativa
aagtccaagttcaatcaccaccaagaagcctggaaccataatgcatactttgggcctgaatccgaggaaggcggagctacaatgaggtggacactgatgacagcagcagcatcgacttcctcaagttcctgagccaaataacgcgctagataattatgtgcagggcaaggactaacaggaggggcagagagagatgttccatgtcttcgacaaggactagaaaacaacttcatctttgccaccgagcctcgccacgttatgtccaatgcatcaagaaaggctcactgatgagaaggtcgacaatgatccgcgaggctgatggtgacaggcggatcactacaaggagtttgtacttaaattcagaaaaaaataaaagaagcaatttgattaaaacacatacaaaaattataaaatcattaaaactataaaaagaaacaagattccatgtagaatataaaatatcaagagtccatataaaagtataagttataaatatatggaatttggaataataaaagaagtattaaaagaagagt

SEQ ID NO: 28193 - DNA, 332 bp, Oryza sativa
ccgtgggtatggccatgcccgacacgaccttcacaagaaatatagttcattaattactaatcaacatatatatgtaacaaatttcgcatttcgcataccttgatagacaagttcctgaagggagtatgcatatcgcagggtgttcgctgcgtgatatcatcaacggggaagtgggttgcttcgtgagctgccactgcatcaatgccctctgatccaacttggcccgttgatgcatagctgctgcggttgcccgaggggctcaccatgacgggtgcttgtatttccattccgcgctactcggccaggcattggtccacctgtcttgtcacctc

SEQ ID NO: 28194 - DNA, 746 bp, Oryza sativa
  unsure (1)..(746): unsure at all n locations
taagacgtcgttctcgctaagtcgctaagtcatcattcgtgaaagtcgttaagtcgctaagtcgtcgttcgtgaaagtcgttaagtcgctaagtcgctaagacgtcgttctcgctaagtcgctaagtcgctaagtcgtcgttcgctaaaacgttctcgttcaaacgttccaccatggagtcgncggtggagtcggcgcncgncggcggaggccagtgatgtcgncgncggtggtgccgncgncggtgaaggtgnaggtgaagttggcgcgcancggtgnaggtggagtcagcgcncggcggcggcggcggcggtggagtcgncggtgncggtgncgncggcggtgaaggtgaaggtggacttggcgcgcggcggcggcggtgaaggtggagtcggcgcgcggcgncggtggtgtcggcgcgcggcggcaacggcggccggcggtggagtcagcgacgacgatggcggcgaggtccggtcggccgacgcgtgtcaagatcgatcgagagagagagaatgcgagatcggaggcgcaagatttgcgcccctcaccttgagggaggcaatgctgccgatggcgttggcaagggcggatgagcgcggtgagcatggcgacgacgacggcggaggcggcggcgatgtctggggcggtaatggcgcgagaggaagaagatcgatcgtggagaagtctaagtgtggcgcggggaagccgatgcagtggatgggtaccgagctcgaatntcaagg

SEQ ID NO: 28195 - DNA, 737 bp, Oryza sativa
  unsure (1)..(737): unsure at all n locations
ttgatatctactgccacccagccgcnaggagaaagggccccctgcatgtctaaatcctggctctgccactgactcgtaaatggaactgataaggttgatgggctattcagctgaatgaacaagattttgatgcgtactgcatgaatattcggatacttgttggatggtaccaactagtctttacttttaaaattacagatttatttgcttattgagagggaacagttgagtcaaaagggctgtaatgctgtatggtgtgaaaacagctgcttgctaatttatctttgcccaatatcaacattttgtcagcctgttacacaaggttggtttccggccaaaacctcaagtgttatctgaaaccatatcttatgatggctaaacccttcagttttgttttatttggtcagtaataccacatgttagaatctaatttgaggtgcaaatagtagcaggggtctctactgactatatttttttatagatattaaaatctctttaactaatttcaaagattattatgctgagatgagcattatgtacgagaatatttctatttcattggttaattgggcccctaccttttatgtccaactacccaatagttatagatggggcaccttttttcctttgatacttcagacatgaaggaaatagctgacaaggattttgaagaacctcaagatgaagataaacatggggataataataagggtgaagttggtgaccaaatgagcaat

SEQ ID NO: 28196 - DNA, 819 bp, Oryza sativa
  unsure (1)..(819): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagtacattttgtcgtacaattgcttgcttacaattaaactacgagaacgtactgcaagcaaattacaaccacacccagacatagacacgccaaattcaatctaaaagagtatccattgcatgcaattccttggagaacaaaacctccattaattgaccaaatgatgacagaaactgattaactgaagaaacataaacaaatcaagtacagttaactcgctggattgatatctgaagcagttctacattcagaactaataacagagtaagtaaagactcgaccgatatgcatgcaggcactcaagaacgaacgatgtgttcgtgcatgcgtgctgcatgcatgcaaagctagcacgtcgttacaccgtacgcgcgttacgtagcttaagcacagatgaagccactagggacgttcttgccgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28197 - DNA, 626 bp, Oryza sativa
tttttttttctgactgatatcggtacaagcagatacaacgaggagaaggataaaccctggtatcttagcctcgtagtcgtagcccacgccatttttggggagtttttcgtgatctctctctaataaacggctgtgaaatgtgaacggaacatcacgagcaggcgaaaagaagttgttctgtatgttctagaagcgtctattctcattgtcgtcacggaacgcggaacgccggccgcacgtaccgtgggctttcaggccgattcacgtcactgtttacgcgcgcaattctattgctcgcctaataagtgctgatattctctttttttttcattatctaaaaaagtgctgacattcttcttttccttgtatcggcaggattttttcctttttccctttcgagccatcgggtgcatataggggctgtttggatgcccacctcaaattaccacagttttttaccaaaggtatggcaagatgcaaattgtgtggcttaaaatttgatagccacacttagcaaactttggctaagaaaagggtctatgactagtgggatcaaaagagtagaaagtgtggcatgccaaagttatagaaacaaaccaaacactaactacatttggtcaaactaa

SEQ ID NO: 28198 - DNA, 741 bp, Oryza sativa
  unsure (1)..(741): unsure at all n locations
nnnnnnnnnnnnnnnnnnnnnnnnnnnnnnnnnnnnnnnnnnnnnnnnnnnnnnnnnnnnnnnnngatgatggccgtgtggttcggcacgcagaaggacagctacttcgactcggccgtccacgcggacgccgcgttccccgtggacgacaagctcgcggcgcacatcaagcacatacggtacgacgtgccgcgcctgtgctacgtgcgcgttaagttcaccgaggtccgcgacatcgtcttcgcggacaaggcccgggtcggtgaggtgttcgtcaggtcgcgcatactgggacaggtgcacaggacgagaacgtccatggaccaccgctggaaagacgaggaaaatggtcacctgtttgtggccgccgcgccgttcaaggactacctcaacatgtccgtcgtgggcgtcaagaacggcaaggaggaggtcatcggccatgtcaacgttctgcttgacagcttcgaacgccggtgtgacgcccgcccgattagcccaagatggtacgcccaattgtccatccatctcatgtactagcaaagaacgacaaagtacctggtattaggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 28199 - DNA, 1179 bp, Oryza sativa
  unsure (1)..(1179): unsure at all n locations
acgccgcatcgccgagcaacgcggcgtcgaaatgctcgacgccaccgggctcccacggcagccgcggcgaagcgtcaggcatctcgggcgcgtctcctcccccatcacgtaggctcactccatcaaaaacaaaaaaacaaacaaacaaacaaacaaaatcaagagaaacgcgcgaggaatcgatcgattagctcctggagcagttgggatttgggaaggatcaaacgcaatggggaaaaaattgggtaggaatttttgggggaaacggtggaggctgaggtgtgcggtcggggagaaccaggaggcctctgggggaaaatgcccgcgggagaatagcggcggtggcatggcatggtgcatggcgaggccgtggccgcccgagaggcggaggaggaggaggaggagagaggagagagagggaagcggccaggcgaggaaggcgaaggagtggcgtcgtcgcggggttcacgggtcgcggctgctttctagctgggccggtctggtgaatacgggttggaataagttcatttaaggtcccttaacttgtcaacaaatttgattttcgtccttcgatcgaaaaaccagatacaacgggtccctcaactatcaaaaccagtgcagatgatacgtggctaatttgactcggtcttcatctgacgtagcattgccgtagcgcttacgtggcaattcgatccgaaaaataataaatctcatgggacccacatgtcagtttcaacaaaagaatgaattaaaaaatggtggggcccatatggccccacatatcattgtcacccctcctcttcttcctcctctctcaccatctctcccctctcctccctccaggcgccacggggccacggggaggtccggcggcggcggccggcgacgtgggagaagggcagtgggcagggcgtcggcggcgagagcgctgggtcttcgctcacggcgtcggcgcgggggggctcgtggaggagatcggggccgcggcgccgcccgtctccgacgagctagagctcgtgcgagcgcagtgccgggagctgcacgactgccgacgagaagcagaggaggttcgaggtgtacaggagcaacgttgagcttgttgagaagttcaactccatgtgcaatggctacaagctggnnnnnnnnnnnnnnnnnnnnnnnnnnnnnnnnnnnnnnnnn

SEQ ID NO: 28200 - DNA, 1292 bp, Oryza sativa
ccgaccccctcggggggactaagaggagggcgaacacatcaccctcgggcccgacgtccctcgagggtgccaggccacgtgggcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcaatggtaactcggctgtcaataatgagcggtctcttcaagactgccacattactcgagtagcacacgaatctggacatggcgattcgtttcgtctggagatatggtaacgtcgcttcggccggcgagcgtaactaacgcgcacacgatatgatctatctcgactgccacaaccgcatatccacctcatgcgccgcaagcgggcgaatgggatttagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactctttctttcctgtgccctaccttcgccacacgcgctcgctcttaatcttctcttcctccggcgccatggcacggggctccgctctgctcgatggtagcgtgctgccgccctcccgcatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccggtgctgaaccgctacatcccctgcgccctccgcaagaagtgggacgactggaagagcgactggttctacacccccctcgccgacgaagcgcgcctccgacttccgagccagcccccggcgcaggcctccagctggcgggcgccgg

SEQ ID NO: 28201 - DNA, 1241 bp, Oryza sativa
ctcggggaaacctcatttcccctccaaagtggtcgtttaaccgaccccctcgcaggttcgtctctcacccatcgtggctgtattcactctctcaacgcgagttttcactcacccatcttgttcgtcttctagtcttttcttttgtttcagcgagatcccgtcgcgtccctcccgccattccaagtccggccagtctgaggccgaggatccggcggccgcagaggcccggaggcgggaatctgaccggcgagaggctgcggatcgcctacgggaagccgaggaggccgcccaggaggccgcccgggcccgccaggccgaggaaaccgctcgggagggggccgcccgggcccgccaggccgaggaagccgctcgggaggaggccgcccgagcccgccaggccgaggaagccgctcgggagaaagccggatttcgccaggacgaggcgatggcgacttccgaggcagctcgcgatgaggccgcgggcgcgtcgcttgggcccactccctcgggcgacgctcaggcgacaacttccggggcagctggcgacgaggctgcgggcgcgtcgcttgggcccactccctcgggcgacgctcaggaccaaccgggtccgggggacatccccgagtccggcacttccattggcggcccgagccgcgtggcatcctctccaaggcggctcttccccacgccttctatcgccccactgaacacagagccccttctgcaggccttggccgccgcaaacaccacggtgttggatgggttaagtgcccaggtggaggccctgcaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccaggggatgcttgacactgccgctgcccgagaacagcgggcggcggagaccgaagcggcgtcccgacggcgcgaagaggcccttgaggcgcgcgccatggcgctggaagagcgcgcctgcgtcgtggagagggatctggcggaccgcgaggccgccgtcaccatccgggaagcaacgc

SEQ ID NO: 28202 - DNA, 1947 bp, Oryza sativa
tccccccccccccccccggagttcaccacgccccggggcagggctcggttctgggccccgtttggcgattttagccgacccgagcccccgagggcaggattgagcgcgagtgacctatttcaagtcaagattcttcaaaaggaaaaaacagcacagacacagcctttaggaaattgaaactgcttttattgaaatactgaaaaaaaagaaataagaatgtgcatgtgtggcagcccccgggcaaccctgcacgcccgagggggtgcggggttggcccgagcccgaaacctgacacccgaccccccccctcaggggtagaagcgacgaaggtgttcgatgttccatgggttaggcagctcagtgccgtcgcccgtggccagccgtatggagcccggccgggggacgccgaccactcgatacggaccctcccacattggtgaaagcttgctcaatccagcaagcgtttggacgcggcgtaggacgaggtcgtcgacgcagagtgatcgggcccggacgtgacgctgatggtagcgccgtaggctctgctggtagcgcgcggctcggagggccgcgcgccgccttcgctcttccaagtagtcgaggtcatctctgcgacgctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcaccgctggcaactccttgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagctgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggtgtccatctgcgggtcagagcaccggtactccttacagacttggttaacgaccagctgggagtcgcctaacaccaggaggcggcggatccccagtccagctgccggggatcctctagagtcaacc

SEQ ID NO: 28203 - DNA, 2707 bp, Oryza sativa
tctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggatgggccgtcgcccagggcaacctccttgaccgggacctcgtcgcctatgatcatccgctgcctcggggtggcgggggcggaggcgccaagcctctcatcgccaccctcgggcttggacgcatcggcgaggtggtccgcgcgctgctccagacaagcgagcgcgactttgaggtcgccatggacagagatggggccaccggggcccggcaccttcatctgtaggtaggcgtagtggaccgccgccatgaacttcaccaacgcgggcctccccaggaccgcgttgtagggcagattgaggtccgccacatcgaagttcacccgctccgtgcggaagttggcggatccaccgaaggtgaccggtaggtcgatgtgacctaacggccacgtgtgccccggcgtcacaccgataatcggctgggacggccggagcaccatccccggggccttgatggcgtcaaaggccgcaggggaaaggatgttgagggccgctcccccatcaatgaggacacgccccaacttcacgttgcaaacggtgggggaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattaccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcctgcaggcctcccctttcgggtggcccgcgaagcaccctcgacggcgaggacatgaccctcgtcgtcggtatgggctgacctcttcttcctcctcctatcacgccgccctatctgagcggcggatcagggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggtcatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtcacactccggacgaggaggcgccctccgttgcgtggggagcacgtcggccattacgccggcgctcgatactgatgcgggcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggg

SEQ ID NO: 28204 - DNA, 710 bp, Oryza sativa
gtttggctaagcatccacatttgaggctatttttttacatatttttccctctagaaaatgtgatggaagatgatgagagagaaagtgtgtgtagggaataaagaagattataaatacttgtttgaataattaaatataattttgtatgaaattataaaactaagctaatttaatattaaaataagaaaaccatattaaatatttgtttataatgtaattaaaacatgaaaaatatgtacaatgaatttaatagtaatgattaattgtatgaataattatattcaattattgtattattatgtaattaccttgtaaatcttggattttgtataattacgatttatatgtatttcatatagatgaatcggcaatggatatacgcggatcggtggtcgaaagagtttattgacggcgtgcattattttttgggtgtggccaatgataacaagcgtaacggttttataagctgtccatgcgataagtacaaaaaccagaagaagtattccaccacacaaactattcatgcccacctgtttcaatgggggttcatgcgtagctacaaatgttggacctcgcacggagaggttggggttgcaatggaagaagatgaagtagaagatgagaacattccggactcggctcagtatggcggatttgaagaaaacacaatgggcgaggcggagctggatgttaagggaatgatgggtacc

SEQ ID NO: 28205 - DNA, 725 bp, Oryza sativa
aatctttacaagagactagagaaaatgtctcattgtaatcaatcccttctctttgcgtgaagccttttgccacaagtcgcgctttaaacttttccatatgccctctggagtcatatttggttttatagacccatttacagcctactgttttggcttctttaggaatttcttctaaatcccagacattgtttaatttcattaattttatttcatctttcatggcttccaaccattcagatgagcgagcgcttctcatggcctcttcatatgaggtgggatcatcctccatgtgcgactcttctatattatgaacatgatagtcatcatggatagccgatcttctgtctatttcagaccttctaggggcctcctgttctggcacattatctgtttgaggctgttgcagctcctcctctagtgtggcaataatttctgttgaatcctgtagaataggttcctcactttcattcattgttgccacaggagagataacaacatgtgttggtaccgcaacgtcatgcattggaggcacaacatcagcaggtagagagaagaaaggttcctgagtcgacggagcaggtacagacacccgcctctcctcaagatcaatttctcgaactaccgagctccccctaatccaagaagacgacgtgtctcgtttctacaaactttgtataactgtttggacagtagaaatgataaccctttgatctttcgggtaccga

SEQ ID NO: 28206 - DNA, 317 bp, Oryza sativa
cgccccctctcgatcggattagggtttatggggtggagttggcagcgcaaacctcgtgtcatgtgccaccccagcctccacccctctttatattgcgcagggtgacgggggcccaccagccattgggctaggcgcccttgatcagggcgcgggtcaaggcccccttgagccgttgggctcaaggggagggagatccatctaacacttccgtgccggcaaggaccacgtcggcgttcacaccggctccaagatagtgctctgggaataatgctcgctgcccgccgccattgctcccgcctaccggtgccagccgaaga

SEQ ID NO: 28207 - DNA, 543 bp, Oryza sativa
gctccgaatggaatgagctcaaaatccgcacctttaaagtcagttgccctttctagaaatctctccggcataaacttctctgcctctggccatatgtctttatctcgacccatagcccagacatttataaacacttttgcacctttaggtattgtatagcccaatatttgaattgttgttgtagcttgacgtggtaataaaaatggaacaggtggatgcaatcgaaatgtttctttgatgacagcttgcaaatagggcagtcgaccaatatcagattcttcaattcttcttgtggatccaataactcgttgcagttcatcgcatgctttagccattggtaatgggtttctaagcaattctgccatcgcccattctacagtgctagagcttgtgtcacttccagcagcaaacaaatccttcaacaaaaaccactttgagatattaatatatagcacactcttaattatgagagagcattcaggtgatgaattattcagcactaatcactaacttaacccgtgcattagcacatgctattgatat

SEQ ID NO: 28208 - DNA, 316 bp, Oryza sativa
gtggtcaccggaggcgtcgggggcggaccgggtggcgaagacggcgtcgtgcttctgcaggaactcgcgtgcgacgtccggcgaggagacgaccaccgtggtgaccgcgcccaggcggagcgacatgagcgggccatacgtcttggcgaggccggcgagcgagcggtgtggctggtcgccgagcaggtggaggctgccgatgagcgggagagggtggggtcccggcgggaggcggcggcgggagtgtgcgaggagatcgaggaggtagatggagaggagggagaggcacaagccatgaaagccaaaggaacaaagc

SEQ ID NO: 28209 - DNA, 603 bp, Oryza sativa
cagtgtatccagccttttcaattgcagtcttcaagagctcaagaccctccttgttttcctgcaatatcacacaacacaaacgattcaaaccacatgctaagtatattcatttagatttctaattacggattagcttcatacatcaaaacagaagttatctcagcatctaacatcaagcaaatacaaagcaaaacagggaaacataattgaagtgaagcacttcacatggatcaacagcatagtggaaagaaagataattgaattcactgctgcaggcataagtacctgaatgttaggagcaaaaccaccttcatcaccaacattggtggcatcctgaccatacttcttcttgataacagactgtacagataaaattaattaattttcaatgacgtaagatggggaaaaggtttaaaatgaagatgaaagaattaccttcaggttgtggtacacttcaacacccatcttcatggcctccttgaatgaagcggccccagtaggaaggatcatgaactcctgcaatatagagcacatcattaaataactttatgagcaacacatagaatgagaaaatcttagttcagatcactgcctgcatggcaa

SEQ ID NO: 28210 - DNA, 552 bp, Oryza sativa
ggaattatagagttaagcaaagtatttaatgaaattttatctggccccattttatattggaatttattaattaaaattagatcttctcttctaggcttttaaaatcatttctaataattccaattaaacaacaatttatatatttaggatttttagggtgtgacaaacctacccccttaaacggaatctcgtcctcgagattcggaagaactggcgaatagatgcggatgagctgacttcaattcatcttcttgttcctaagttgattcttcttccgagtgattactccattggactttataaaaacggataacttgatttctggttcttctctcatctatttctaagatacggattggtttctcaacataggttagatcctcttggacttctatctgttcaagattagcttcttcggtaggtacccttaaacactttttcaattgcgacacatggaacacattatggactcctgccaaagattgaggtaactccaactgataagcgacctctcctcttctgctgacaatcttgtaaggtcccacgaaacgc

SEQ ID NO: 28211 - DNA, 885 bp, Oryza sativa
ccttgccgtatacaattccgccaaccagcttccggaatatgttgtctttactgggatgaaatgagccactttggtaagtctgtcgactattacccaaatagagtcgtggcctgatgacgttctgggtaggccagtgatgaaatccataccgatttcctcccacttccactctggtatcttcaaaggctgcaacaaaccggcgggtttctgatgttctgccttgacccgctgacaaacatcacatactgctacgtattctgcgatttcacgcttcatacttgcccaccaaaatctctccttgagatcctggtacatcttggtactactagggtgaatggagtataaagtatcgtgagcttctttcagaattgcatcttttaaatctttgttgtcagggacacagattctctcgcccaaccatacagttccttgctcatcttccaagaaaccgatagcttttcctcttctcatattcttcttgatttcttgaatatcaggatcattaatttgggcttctctaacctgatcgattagagtgggctttgcttctaaggctgcaacgaaacctctactgacaattcccaaatttaatctttcaaattccttgcataactccaatggcaactgtcgtccttccgtagcattgcaatagcctttcctgctaagagcatctgctacaacattagcctttccctggtgataatgaattcccatatcataatccttaattaattccaactatctccgttgtctcatgttcagatctggttgagtaaagatatactttaaactcttgtgatcggtgtacacctctgtacgagtaccaaaaagataatgacgccaaattttcaacgcatgaaccactgcagctaactcaagatgggt

SEQ ID NO: 28212 - DNA, 369 bp, Oryza sativa
atagataaaaatgaatgtgtagcaccagaatcgaaaagcactgttgcaggaactgagttaacaaggaacgtacccaaaatcacatctggagcaccttgagcttctgcagcagtaacatggttggcgctggtgcggtagagttgctctgggcagggacaaccttcacgcgtcagggcttcggacacttgtcagagtaatgtcctgggtctccacagttgaagcacaccccgggcttgctgccttgctccttcttggcatgctgttgctgtgtcgaagttgcaacagggcgtggagcttgattgcggatgttgttgccagcattgttgttgaagaactgacgctgcggacgaacaacaaacgaagaacctc

SEQ ID NO: 28213 - DNA, 665 bp, Oryza sativa
ctgagaatcaacgagatacttaattgaaccaatccccccatcatacagtttaatgaccttgtaagatgctagtagcagcactgcacaagaaaggaaagcacaatctgaaattaatcatgcaaaaggctgagatgcagcatccaccaccatgacaatgcatcaacaaaacatgaacctccatgagcaaagcaataccaagaaaacaagaaccggcacgaagaaacccaagaagcgaatggatccaacgatgatgagcatatacaaggacctccagcagacaatggatgcggacaccggtaacgggtgcactacatatctaaccaaaaagaaccacatgccgatccggccacgacccgacgacaaccccgggcaacacacctcgagcaacggcgggagagggtggtgattaagtcggccgcccgtcgcctggacgccgccacccttggcagtaggcggggcacgccgccgctgttgaactgctccatcgaccgccgcagccatcgctctcctccttgcctccgctgcgccgctagatccgtaaaaagcggagagagagaggggaaagtgagaggagcattttagctattacgcaccctaggtctatatatatatatatatatatatatatatattacacacatgcatatatgtgtgcactatatgta

SEQ ID NO: 28214 - DNA, 660 bp, Oryza sativa
agattttcctttgttgaattctagattgcattgtcgtgttgagtgctggtttatttttagatttaattttaagttttgagtggttgcatctgttcatcacttaggcctagggttcatcactcaagtcggtgtgagttgtacgtcagttttaggtccagtttttcatctcaacgattgttgctggtatcttgaaaaattgaatcctctcttcgtcgggtaaaaaaaggtaatgataatggtgctacaactactcaaggtatgtatatttatgatgtgccaactatgtctactacttatgctacattagagcaacccatagtggaaacaattgctgaaatacctttgtcacaaaataatttgcttgatgtttcttgtgataaagaagagttgtgcgatgctccacttatatccatgccacaactagtgaatggacatgttagttctatagtagagccaccatgtgttgagtttaaacatgttattaacattgctagcgagaatgaagaggttaaattattatcttctttaaatacataggggtatattctatttgatgatgtttgtcctatcaactgttcagagaagaaattatttgctagatttgaattgccatgcccttctgatgtgatttttcatattattggcaattatgatagtaaa

SEQ ID NO: 28215 - DNA, 739 bp, Oryza sativa
tcgccattacgccaaccgcagaaaaaaaaagaaaggggtggcaccgcgccgttgtgctcccggggggccgccgccaagcgctcaacggctgcgcgcgcggccaaaagaaggtggaacggcgcaagcgccccgtgccccggcccgtccacccgccgtcccgccgtcgcaccatggtaagggtttcgcccgagagaagaaaagagtggctagggtttgcccaccggttgggggctcgggttttgctctcccgatctccccgcttggccgtctgatcgaaaccctagcgatcggacagccaacgtcggccggaccgcttttggcccaagagggggcgcgcgctaggcctctttcccggcccaggcccaggttgcggcctagagaggggtgagagcccgcatgtgcatataccagggccgccagagtccaattttggtccctcggggccgaaagaaaaaggaaaagagtctatttttagtccctgtttcagatgcatttacaattatagttattaaatgtgtttatttctaagcaatttgagccaacgtgaaaattgtttagagaatagataaatgtgagaaatgcttctgaacatgtattttgtatattttcatgcaaattacaatagaattttgaattgtttttgcatgatttacctccgtttaagatttgaaccgaagggttaatttttacagagtgaataacagaattttgtcagggtaccagcaagggtatcaatcac

SEQ ID NO: 28216 - DNA, 976 bp, Oryza sativa
  unsure (1)..(976): unsure at all n locations
ccgattgtggtatggtgtatgcattccacccaaatccaatatctttggtggtggagggaagtggttgggaatcttggaagtctgttctagagaaggactccaatggaagctggattgaacttccattagtgaagaaatctattgcaatgctgcaggcacttttactagattctcaacttgggggtggccttggcattggagggggatctggggctggcatggatgctatgagtgcacttaatcagttgttggatagtgatcagccattcttttgcatacttcggttgacacttgcttcaatcagagaggatgacaatggggaggatgacatttttatgagaaacattagcatgaagaatgtcatatctgaaggattaggctgtcaaactggaagcatgatgattcatgatgataattcttgttcgccttccaggaaacctcaatctgcgcttctgtggaggtacatagtgtataaccagaaaagtgtagtgatttagaataatagcttgttcaagtcatattctgaaaaaaaggctcttagctcagtaaccctgcaaatatgtactccctctgttaaaaaatataaggcatattttatttcgttaggacaagactttgatcaacacttactatattatgatatactgtcaccatttttaatgtttgacgctgttgacttttgaacatatgttcagctattcgtcttattaaaaaaaagagcaaatatgcaaaaatgttagtcatgcttaaaatacctttaataataaaacaaatcataataaaataaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28217 - DNA, 904 bp, Oryza sativa
  unsure (1)..(904): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttcttagggtcatttataaattaaattttaggcttgggaggagaacttcggggtgtgacattcgggcccctgaattgtcaggtaatagccctacatcctgttggccgaagccgaagttccactttattcaccataatcacaccagtacaatatttggggtagcctatctaattgttgtcgacatggaggtctgaagttccgactcgtagtcgacaacagggtagtcttcctcctcgaatctgtgcccgacgagatcagagatagcgctttcgtctctcctgacagtatccggagacactgtaggggactagccgtgcttatccctgaagtcgatatccggcgtcttgtcttggcgtatgttggcttgtattggcttatggctttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28218 - DNA, 731 bp, Oryza sativa
ttgatagtcgagctcggtacccaagaactcctagattatatgggatccttatacgtaacatctcgagagaaatttggtcaatgcttaacttcaattattttcaataaaaaactaatactacatgtacggcaaagtaaaagttttcaataggctagtctatattatctcgtctatctcacttgtactctttccatcttataaaaactcaacaatattagatatgatacattgtaatactatgaatttgaatgtgttaagattatattgatatttgatgggagggatggagaatttatcttcctactaccttggatgaatggatcacgtgactgtctgaacaggtaaaaacaagactacagatgagctgtgacctcgtgggttggcagataacagtcccggtgcgtgggctatcagctcaaaacacgtcataaaacttccaaatataaaatatttaagatataattatattacacactataattacaatatattttatatttgagatataattatattacacactataattacaatatacgtaattagagtttttctcccgtcctcacttttgtagcacgcggtactggtaccatgaggcaccagtcttcatcccgccgttgattgctgaggggtacgatggggagctatcgcgtgtggtcaaatagcgtgcgcgcctcgatattctcgcttcccttctctgcattaacgccgctgacttgacgggagaaaaa

SEQ ID NO: 28219 - DNA, 721 bp, Oryza sativa
gttctccattcgaactcggtacccgatttccacctgtccatccaggtgccgacattgatcaaggataacatccaacagactttgctcgatacctttcgaccggtcggaaatagacaatcctaactggaacgacctcttgtgggccgggcgccccggcgggcgggcaatccttgacaacataaagggtaagctccagctgcaaccatggaagcttgcgggcagccgtcaagtgttgcacgattaccggaacatgagtggtgcgacaatcgcgttcgtgcttgacgaactacgccggcgtcccgataacgaagaacaccagctaccccagcctgaacggggagggatgctacccgttggaccaaggacaggactgacgcacatggaatgcgtaccccccatgtccggggtcccagacaaaaaacctgaccagcctcctgaaataaaggatcgggcaatcctctgggggagggggatttcacgccgtgaggtttattaatggctggcaacgaactcgttgcgctggttaatcggctcccgcagcggaatcacctcactaaaggccggtaatcgggttccacaggaaacagggattcctccaggaataacatgcgaccaaaagcccgcaaagggccggaaccggataaaggcccatcgcttgcgcttttcaaaggcttccccccctggcaagcatcacaaaaatccctccccagtcagagggggg

SEQ ID NO: 28220 - DNA, 743 bp, Oryza sativa
  unsure (1)..(743): unsure at all n locations
attgaaannctggatattttgatattcgagctcggtaccctattaagtttctttgcaaagaagggacataaaaaacatctctaagtaaaagtgtgaagccattcgcgagctctaggcgaagatctctaatagtttcaacttttgcttcaactccattggcaactctaatggatctttcgcttctttgcgtagtcctcatcgaacggaatccctttaaacaattacacacatgaatagttgctccagaatcaatccatcatgtggatctagaataaccaatcataatgagattcatttacaaatgtaataatgttctcacctttctttgccatgatcactatcaggaagtcaggacgaactttcttgcaatgccctgtcttcttatagtggggacactgatcttgtcttaactgtgaactgttgttactgaggcagatgctgaggctgttttgcttttgagggggggggggtgaccagtggctcttttcctttgtatctttaacaaggttattggaggcaccattggtctctttgattctttcctcctcttgcacacaattagagatgagctcttcaagattccatttttctggacttattttgtagttgacaacaaagttgtcaaagttctttggcaatgaggtcataaccagatggaccaaaaaggcatctgagatgcccaaatccattggcttcaacttgaaagccatgtccctcatcctaagaatgtggtcttttacacc

SEQ ID NO: 28221 - DNA, 417 bp, Oryza sativa
  unsure (1)..(417): unsure at all n locations
nnnnnnnnnnnnnnnnnnnnnnnnnnnnnnnnncaaatcacatgcatggaggccagatcagatgcatgaccgtggacgaggtcgtcgacgcagagtgatcgggcccggacgtgacgctgatggtagcgccgtaggctctgctggtagcgcgcggctcggagggccgcgcgccgccttcgctcttccaagtagtcgaggtcatctctgcgacgctgatcttgatcagcctcgcagtacatggtggcccgaggagacctcagggtgagctcggatgggagaaccgcttccgcgccgtagacgaggaagaaaggcgtttccccggttgctcggcttggtgtagttgtgagtggggatgatgcacctaagctagtagctagagacaggacaatcgattcaagctgaacgggtaccgagctc

SEQ ID NO: 28222 - DNA, 6584 bp, Oryza sativa
cttcttgatgagattggtggcatggcaacttactgcatccatgtcattgactttgatctcggtgttggtggtcagtgggcttccttcttgcaggagcttgcccaccgccggggagctggaggtatggccttgccgatgttgaaactcacggctttcatgtcgactgcttctcaccatccactggagctgcaccttacccaggataacctctctcagtttgccgcagagctcagaattcctttcgaattcaatgccgtcagtcttgatgcattcaatcctgcggaactcatttcttcctctggtgatgaagttgttgctgttagcctccctgttggctgctctgctcgtgcaccaccgctgccagcgattcttcggttggtgaaacagctttgtcctaaggttgtcgtggctattgatcatggaggtgatcgtgcagacctttcattctcgcagcatttactgaattggttccagtcctgtgtgttcctccttgactcgcttgatgctgctggtattgatgctgattctgcctgcaagatcgagaggttcctaatccaaccaagagttgaggatgcagtgattggcgggcacaaggcgcagaaagctatagcatggaggagcgtttttgcagcaactgggtttaagcccgttcagctcagcaacctcgccgaggcacaggcagactgcctcctgaagcgggtgcaggtccgaggattccatgtggagaaacgcggagctgctcttacgctctactggcagcgtggggagcttgtatccatatcatcttggcggtgctgatcagccataagcttcactccaccaaggttccaccaccgtttgcaagcatcgaccactccagtaatgtccatttattcttgcaattaaatgttgcaaatgaaattgttgtcttgagctgttgaactcttcatattgcttttcgttgcagcttattagctagcctagtggatttaggaatattggtgtcagtctctatagctaatgatgttgctttaggttgttgccatgctctgctcaattagccatgatcatctcattggaaacactgcttatgagtagagactagagggtaatttaacctatcaaatggttgtgtggtacagaattaatattatactgctgttgctctgtaattctttgggtacgttagttctgcatttccattgttatgcattgaactgaaatggatgcacaatgcataccattctaatagttagtggggatggctatcataggactaagacatattgatataactacatatgacttagtacagcaataaaaggttttgccaaacagctcaaatatatttggagtaataggtcataatcaagtttcagaaagcgaaacaaagataataaatttccacgtcattctctcctttttagtttgtgtaagctgtgcttagtaatttttgcagattagaatatgatatgcagagcaactaccggtgtcgtagttgattttgcatagcaattgtgtatctatcgatctgcacaagctcctgattgaaattctctcaagtaagtttgtctaaactggatcaaaccttagtttataacccccttgactgaccatcaacggtacaagaatgccaaacgatgtttctttccacaacaaacaacaaaataaatttattttgtatctctactctagaaatggatagccaatgtgtaaaaatatattgcccgtaacatgagaacttcacgcttcacagtccattcagttatatttccacaatagacgtaattccaggataacatgacgagggcgaaactaaaaatgcttattgtaacttccatgttatgtcctgtgacgaggacacgaggtatgcatatattcccattggcgagatggtacataaatcaatccttgtaaacttgtcaccttggttttagaccgtattccatttcgggagaggcctagttttcttggtgatatgttgtaaacttgtcggtgttggtaatttgccggatttgctccatgtgtatcccacatctactttgactccatttcactgcattactggacactgtaattgtcatcgtctgagttgtttcactctacagtggagacatttctaggctatttttttatgcatatctactgcttcaataatgcacatacatacacctgcacatacatacacctctacccgtgctatcatgtgattgtgtcctatacctcggattagaaaatgtgaagggctattctattaacgactggagagttgattaaatttactacagaactgggaaagacccggacaagaacactggctactatcagggcttatttcatctttgctcatctcccacatggacgtgtcccctcctgcatgatcgcctgcccctgcatttccttccatccatttacaaaaactaatcacctggagtctcaattataaaactagttttttatgatttgaaatttctgaaactccgaattaattaatagagttgtactcgatctagattctcaaatattatgttatacgatttaacaaattctgaattaatgaacataaagttataccccctttgaagtcttgggtatagtgtttttatgatttaacaataccggaattcaggattaatatacattaataaatattgtgttgtaagggcagtttcaaccctccacttaggataggatggtgtttatagcattaactacattgtcatgtaggacttttaacttatgtggcactatattaattaagagagaaatgaagagatgaagaaactgggtcttatgcaagacacagctttaacacgagaacctatgcactagacactatcaagttttgcattaggagagaataatgtcttcataatagatgaagaataaatatgattggtagagaagagaaatgatatatttattaatggtccactttaagaaaccatgggttgtggagtgtagtttctattgtggtgtcttgttgacatggcaccatagacactacttatggatactgtgggttgggactgccctaaggcctcgattagtattttttataatctaataattttgaaattccaatagttgaaattaacaaacaccgagttatgcttagtttagaatctcgataataatatctctatgatcgcataattctgaaatcaaaattaataaatattagtactagttaaaattgattgtttaaaatgtatagcacgtgcaggtgcactacttgcataattgatggctagttaaagggaacgtattttatgcgcttaagtttttcgtgtacatatcatgtatactagctaacaaatttcaaaaaaaaaatctaaaataaaattatacaggtacttttattagtattacttatgtgtcaagttttacctttaaatttattatatttagcctaaagaaaaggataaaattcctgacaatttcaagagtataaatcggttcgaattttatctttttttcaatcatatataaaataaatttgaaaatgagactttacacataaatgtactactaaaagtacatgtacaattttttctcgtaatttttctagaagtttgttatgtgtgcacaatgcggatacgagaaaacttatatgcatggaatgcgtttactaattaaaaagtaacaacaatgcgagtgtaaaatataggggtataccgagaactggcctggtcgaagacgatttgtggcttgatcctagcctgatccaccatgtttgtctggccaaggaccttgtttgcttgccatacggagatcctctgctgctcacctggaacgatccatctttgcctcgcaaattgcaattagcctgggcttcaaggcggcagcgacgattttatgattaccacggtaatcttaatctcgtagtacgccacaaaccgccgccgctgaatcccgtttggccggatcctgccatgacttgtcactcagatcccacaacctacacgaagccactcccgtaggtctccttcccaaatccttgacggatccgcgaagccatccgccgcgcaaagctctcgccatggcctgccggctcaccggatctcgccgtcgccgcggttttgcgcgaagaagccggagaggcacagaagtcgatggcggcttgtccaatctttccgcccacattgctgtagcctgaagcctgaagccgtaattccgtaaagcagttgatcggaagcgatagaaagcggtaaatgtgtttttggcgaagcttctgcggaataaaacttgcaggattttcagcggaattttttacatcgacatagattttggaagtacaattagattctatgagtctgtttggcacagctccaactccagcccagctaaacaatttcagctccacctgatagggagcgtagctgggtggagcgctctcacgaaataaactaggaaggtggagcagggtttaggaagctccataactccactccagactaaactcttagagctaaatttagaaattggagctgtatcaaacatggcctatatgcaattattattttcactatcaaaatacccgtgatgaagagatttttcattgtaaaggttatcacttattgcaagttgcaacatacaaatatattttgtttgtataatatatatttagagtttatgccttaaaaaaatgaattttagcggtttgcctaatgaaaagctgtaatggacggggaaatgtggatatccatccatctacaaccattgacattcaagtagtcttaaactcgaatttcaatgtctaacatcccctctccccctctcctcaaccaataaagaaaaagcacgccctcatctttcaattgttcacctcacatctcagaaagttcgagccaccggcccacctttcaaaccaccgatgacatgacatcctggctctctcctctcccgcgtcactgctgctcatcctcacataccttagacacgcctacgccccttcctcccacacaccatcgctattgacatcgcagggcaagatctccagttcagcttgaatcgattgtcctgtctctagctactagcttaggtgcatcatccccactcacgcgcctcgagattcaggaactttggcctggtttagttggtgaaatgaaaatttttgagtgtcacatcggacgtttgaccggatgtcggaaggggtttttggacacaaatgaaaaaactaatttcataactcgcctgaaaaccgcaagacggatcttttgagcctaattaatccgtcattagcatatgtgggttattgtagcacttatggctaatcatggactaattaggctcaaaagattcgtctcgcgatttacatgcaaactgtgcaattagtttttctttttatctatatttaatgcttcatatatgtgtccaaagattcgatgtgatgtttttaggaaaaaatttttggaactaaacaaggcctctatagaaatatggagaggaaactagttgtattgggatatcgagtgttgaatataaagagtctactggagcgtgcagaaatatagaaatggtatgttaaggagaatcactcatatggatggaagaaaagcttgttgactctaaatttgatccaacactcgaatgcctgagagatttacttgactctagtgtagatcctaaatttcaggttcaaagcataccttagttgactctaaatttgatctaacactcgaaggcctgagagatttatttgactctagtgtagattctaaatttcaggttcaaagcatactggaatttaggatatacactagagtcgagtaaatctctcaggccttcgagtgttggatcaaatttatagtcaactaggttgatcctgtatgttttgatcagtaaagaaagatacttcgattgtttatacgttatataagcttagccgatgatagcacatttctttatcaaaagcaatcttactatatcggacttaacggagataatataaaattgaagttgataagaggatatttaactactgagtatacacaattaataacaaaattttacttaattaactacaatctaatagatcagattcaacccagtacaagattgatagcaataggtagatctaattaagccgatagattctatacaaagtaatggatatataagtcaagctaagatagcaaaacaatcaaagaaaaagcggatatatgggaagacggtgtttgtaataaattgattagaatgtcggaccgaagcgagagtcataactaggtcgatacaaacaaagttgatgaaacttaccttctcgctgaaaattgtgacgatgtatcctgctcgaataactaagaactcgctaaaaagggtggtgatgtgtcagaaattgtatattgactagcaaaagtgtccgtgcgcgtgcgttgcaccgggtgataacggagtgtgtatattgaccaaaagtgttgtttggtttagcaaaagtgcccgtgtgttgcaacggggatgcgtacatatcagaaaaatattcaattaattaaaatacaaatttgctaaaatatttggtatttttaagtaggtatatgtgtataattaaataaatttacaagtaaagcaagtgtgagaaataactataattgtaatgcttctaaaaa

SEQ ID NO: 28223 - DNA, 5989 bp, Oryza sativa
ggttggtggcggccgcgcggatccaagggtgggggcggcggcggcggcggctccctccaccccctctagcctccctcccgcggtagatccggcggcggctgcgtctcccttctcccctctcgcctccctcctgccccagatccggcggcgatggcggtgtcggcggcgtcagcggtggcggcggccgcgggccggcagtggcttactcctaccctctcacctccctcccgccctagatccggcagcgatagatccgacggcggtgtcggcgtcggcggcggtgcccccaccacccacggcggcgtcggcggcaccctcccccaccaccggcggaggatctagcgggaggggaggcaccccgtgagcgacggcgacggcgcccctcctcccgtgagcggcggcggccctctcccccaccaccggagagcgccctccgccgccgctgccggcggatctagcgggagggaccggcggaggcggcgctctcccctccaccagatccagcaggaggggagccgctggcggccagccgtccctgtggcggtgacagcgacggcggtggttcggcaacgacggcggcggcggcggcgacccccttgatctaatttttggttttgatttggatatatatgtgtacatgtatcatgatttgtgtgattgaactccgattgtgatttttttccggggtttgattgcatacggattgggatttttttttggagggggggggggcgacgaagcgggacgaaaaaccggtgtgacgaccggaaaaatccgaatatttatattacttatatatttgttgataatttacaaggcttgtgtgcacttatatttatgcccctaacctaactgagtttgattcgaatacaattcaatcgactaaaaacttatctcctaaaaagaaatgtaaatctaaaaaacctgcctaaacgtaagtacacgacatataatttcaaaagtaaatctaatactatcttaaacaacctgatacacttttcaacaaaaccaactcaattgatggcgtcaattacttccattgacccgtgttttaccaaagactatgtcaaattttaccgttaacagtttggtttggactcgtattaattggctctcaagctgagcccaagcctccttcatatacagccctagctgtgggtgtagagagaggagaggatgaagggatctgctagcacatggtggtagtgtggatggtgccggtagccgacttagatgaaactctcgccatctcatggtgtctcaacataacaccgcgggcaccgctttagccactactctcctcatctcccttccctcttctccttggctccacactcactccctcctgccgccgccgccgccacgctgcgccgttggccggtggcatgatgtgcgtgaaaatccaacctcatatagcatttagtctatacgatcggatgctgttgtataagtatgtgataaaataggcggtatatttaaggataaatttaaaatactattttagtaaaaagtaaattttaaatagtaaaattattttttggtcatgttctttttataggggtggaaaatacgagcagataaaacatatagtagggcgttaaaaagacgacgctaggagcagagccgattgaaaacgatacagggagagagagtgacacttttaaaccttttttatgttgcacgcatccagggaggatggcagcggagagagaagagtccaccacacagaggagaggagaggagagagagaccgtagcaagaggagtagtagtagaggagagcagagagccgaggacttggccaggagagagaaggggtagggggagaccgggagagaggttgcagcagaggcagagccaactgcacaaggcaaggggcacgcagccacgcagtgctcctgcttgccctgcccctgcccacccccacctcctcgctgttctactgctgctctactctggctggcaacgcatcgcgtcgcgcgcccaagcaaaggctccatcaaacacacaccaagaaagaagaagaaaaaaaaatcccccgccacgccgggctgctccagatctctcagccgcgcgcgcgattatgtgggattaggtagatgagggcggcgctgttcggtgccgagaggagcggggtagtggacctcggcggcatcggcggcggtaacagggggctgttttggcccgcggggaaagggggcctggtggtggtggagccgaggtcggtgcttgactgcacgcgcagcccgagcccgcgcaatttcacctcgacgctgtcgtcgtcccaaggcggcggcggggcggactcgaccggtgtggcggcggtttccgagagcagcgccgccgccgccgaagccaccaaatggggagccccccgggaacaccggggcggctgttgctgccgtggccgccgtgggaaagaagactggagcaaccgctgtgagttgcccccgataccggggaccctggatgtggggctcgtcggaggagagggctgggacaccatgctcggcaacgccgccgccgccgcagccgggcaggatcagtcgttcttgaactggatcattggggccgccggcgacctggagcagcccgggccgccgcttcttgacaatgcgggattcgggatcccggccgtcgacccgctgggcttctctctggaccactccctcaccggcgtcgcctccgacctgtcgtcctccggtgcgcaaaacgcaaccggcggcgcgggtggcggcaaggcttccctaggattcggtctcttctcgccggaagccacctctctcgagcagccgccgccgccgatgctgttccacgaaggtatcgacacgaagcccctcttctgggcgcgcagccgccgggcctcctgaaccactatcaccaccagccgcccaaccccgccgcagccttgttcatgcctcacccgcccttccccgagcacaatcaccagtcgccacttctccagccaccgctcaaacgccaccacgccatgcctgatgacctctacctcgcccgtaaccagctaccgcctgcggcggcggcggcgcagggtctcgccttttcaccactacatggcccggttccgttccagctccagccttcgccgccaccgattcgcggggcgatgaagacgacggctgcggaggccgcgcagcagcagttgctggacgaactggcagcggcggcaaaggcaaccgaggctggcaattccgtcggcgcgcgcgagatattggcgcggctcaatcaacagctcccccctcttgggaagcccttcctccgctccgcctcctacctcagggaggccctcctcctcgcactcgctgacagccaccatggcgtctccagcgtcaccacgccgctcgacgttgccctcaagctcgcggcctacaagtcgttctccgacctgtcgcccgtgctgcagtttgcaaacttcacggcaactcaggcacttcttgatgaaattggtggcaccgcaacttcctgcatacatgtcattgacttcgatctcggtgttggcggtcagtgggcttccttcttgcaggagcttgcgcaccgccgtgctgctggaggtgtgaccttgccattgttgaagctaacagctttcgtgtcgactgcttcccaccatccattggagctgcaccttacccaggataacctttctcagtttgccgcagaccttggaattccttttgagttcaatgccgtcagtcttgatgcattcaatcctggggagcttatttcttcaactggtgatgaagttgtggctgttagcctccctgttggttgctccgctcgtgcaccaccgctgccagcaatccttcgtttggtgaagcagcttagtccgaagattgtggtggctattgaccatggagctgatcgtgcagacctttcattctcgcagcacttcctgaattgtttccagtcttgcgtgttcctccttgactcacttgatgctgctggtattgatgctgattctgcctgcaagattgagaggtttctgattcagcctagagttcatgatatggtgcttggacggcacaaggtacacaaagcaatagcatggaggagtgtttttgcagcagctgggtttaagcctgttccacccagcaaccttgccgaggcacaggcagactgcctcctgaagcgagtgcaggtccgaggattccatgtggagaagtgcggagctgctctcacgctctactggcagcgtggtgagcttgtctccatatcatcatggcggtgctgatcagccataagcttcaccccaccaatgttccaccagcgcttgcaagcattgtcaactccagtaatgtgcattttgttttgcaattaaatgttgcaacggaaattgttgtctcaagttgttgaacacctcatattgcttttcatcacagcttattagctaggcctagtggatttagcaatatcggtgtcaatctctgtagttaatgatgctgctttaggttcttaccatgctctgctctattagccattatcatcaaattcaagacactgctgatgagtagagaggataatttgacctatcaaatggttctgtggtacagaattgatatttgcttgctgttgctgtgttaattgtgcatttctgttgttatgcttatggattgaactgaaatggatgcatttctgtatttcaattttgcaatggtagaaatcattcaaggcaatgggaatggctataataggagtaaaccatatggatatattgtacataagatttactacagctatatagccttttggcaaacagcaaaggtttccgggtatatttgaattcgtaatcaggtttcagaagagaaagaaagatattttttggaatttataatatgatgtgttaaggagccaatggtgtcaccatcgtttatctggccacctgtagctccaaattttcaaagtttagtttgtctatttctggatgaaacgttttctcaacaacccttgactgaccatcaactgtacaagagtgccgatgatgtttctttccgcaacaaacaacaaaaagaatattgagtatcctcactctcctggaatggatagccatattggcgcttcatttgataatgtgcccaacacatagagcaagtaacatgataaattcacgcttcacagtccattcagttatatttccacaatagacttaatgccagtataacatgacgagtgcaaaactacaaatgcttattgtaacttctaggttatgtcctgggacgaggtatgcatatattcccattggcgagatggtacataaatcaatgcttcggttgtcaactagtcatcctgggtttagatcgttttgcatttcgggagagtcctagttttcttggtgatgtgttttttcatgattgtgccttgtcggtgtctgttttcttgaccaactgcccatccaaatgtgccggatgttgctccatgcatattccaaggaggccatcgcttcccttatccatggaataagcgaaacggtatatttgtaaacgaaaaataatttgtaaataaaacttttatatacgtgttcttagcgacctaaaagcaaaggctaaaaaataaactacaatgaaaaaacatcaaaatcagctccaaatttaaggttgaaaattcaaatattggtttataagtataagcacaagccgaaagatgagaccgcaaatattcttttgctccgttttccattactggtcactttaattgtcatcgtctattttttacactcatatgcattttgaaaaaaaaaaaaattctgtacgatttgtatcctattcagcccattgaaacaagagattaattcctactaattcctttaaaataataaattcttatagaataactatcctgaaggaaaataagcatgaataatgagcatgttttcccttttcctacatcttgctcctatgaaagttcttgtatttcaaaatccgatagtaatgctatgagcatgccatttggggttatactggctcctttagaacacacca

SEQ ID NO: 28224 - DNA, 3677 bp, Oryza sativa
tgcagagatgaaatctacatgagtctgcaaaatattttgtttggtaaccccataggaagaacataggacctctacacaagcaagagagaatatgaggtgtgatgatctcaatatgtttgttttcttctaaaaattccatgaaacaacccattctatatgaattttgaaggtatcttcagagctattccttcagaacaaggatcatataggattttttttccctggggattcatgttgtagggcacttttgaatcgtgcgaatgaaaaaaaaatagaggaataggaaaaacgtagaattctaataggaatacaagtacaaaatagatgattgcaaaacataacaaaaacacaggaatgaccgattgattgaaccataggaaaaatgcatgaatcagatgagagagatagactcaaaggaaagtttccaagaggttggagctcttgctaaattttctccacaatctctataagattgtctgttccattggaattttagatgataagatatgattcaatcatttgttttaaagggtttcataggaaattttcctataggattgaaatcatccaaaattcctatgtttttcctctaaatcgaaggggctcatattcttctaagggctccgttgaaacgcgggattcagaagacacgtgaataggaaaaacatagaaatagaaagtcatgtctttttgaatattacagaaaattgattcagacatgaatttgtaacagataacatgttataaaaccggcctcaaaatcacatcggaaaccaaacgcggaagaaacaccataggagatccaaacacggtgacgacaccgagacacgatatttgataacggagttcaaccgaagcctatatctccagggcactgattacgggcacttctccctaatctagcatattacagcatatcagagttacaacgactcacggccggtcaccgccggcagccgctgcctctcgctatgctaaattatcatgtggttacaatatgcacgcccctctatttatgagagatcctaggatagagtccgactcttactttagtcttaatatattttaccactccaagttctaaactgtaaccgactacatacacatattcgacacaaactctaacataccatttgtcaacaccaaaacaaaaccatagaaactgcaagtcttgcaagtctccaggaagagaaaacatgaggctagacctcacgttgacttttctccaaaattcctatgaaatgggagatttcacaaaaatttcaaaggattttgtggaggccaattctttggaacagaggacctagtaggataaatttccatccgattttaatcctctatttttcctttattccaaagcagccctcagattctagattttcgtctgcacgttttctaagctattaaacaatatgtttcgtgtaaaagttttctactttctattagttaattcatacgtttatacactccaataattatataaaaatcagattatccatcaatatatcaattttagctctctcggataggacatgtcaatcataaaaattcctttagttttcgttcgttctaaaggagcccttcatttttactttttctttagcaattaattttatgttttttgaattcctttgttttataatagtcccacgttgcaaaggagtcctgttcactccccgtagagacatgtctagcctaatttttttactcatctactgcttgaacacatataaaaacatctctaccagtgccatcatgtgattgtcctacctcggattagaaaatgcgaagagctattctattcgcgactgaagggttgattaaattgactacaaaaatcggaaagacctggacaagaacactggcccctattttttctagggcttatttcatctttgctcatctcccacatggccgtgtcccctcatgcctcctgtttcacattcttgcccccatgatcgcctgcccctgcatttgcttccatccacttacaaaaaccaatcatctgtactacaaattgtactagctggagaagctggtttttctcgaagcatgcgtacaaatctatgatttgaaggatttaaaacaccatgttactggtgtgacatcagggttagtactccacagtctctcacttttttcccctgtgccagttaggatcctctacatcaagaaaaaaactttatcagagggttattatgctaatcaagattcagtaattcaggatgagattttttactgttcatcggaagctgaaacagcactcaaattgtaaattttgttcgggaggtctgacacttgctaaacacagggacgaggaacagagtaacttttgaattaacccggagaggtagagaggttaaccggtcaatcggtgtctattcacacgggtgaaatgttgttacagcagggactatctagatggtatttgacagaaaaacacctaaaaattatgcgaattctataccgttggatcgctttaagattagtgctggcagttctaaccctacctccccttgtcattctaggccccccgccgccttctctcgcgcgcactgtgcctctgccgccaccaccccacgtgccgtcgcccggactcgctagttggccgaaaggagtcaacggcgccagcgagccctcctcctcccctcccctaccctaccccctaccccctaccccctctttttctcaatggatcgcgcgagtgcccccgccccaccgtcttccccgtcttcggcggctccctgcctccggatccgccaccactagccgccaccttctaaccactaaccgccggatccactgtctcttaaccatttgcccccggcggcgacgccggcccaccgtccttcttcattcccgcggattttgcgccgccgccggcgcctcgccgtccgcccgtgtcaccgcccaccgtcgggctaggcctcccacgggcatccctttaagcccagcgacacccccccctctttccctccccccacctctcctcttacctccatcccaacccgggaccctaaacactaattccattgctttcgtcggggtcgtcggagttagagaagatgttgccggagctgtaggagaagagctaaggtcgtcagagcacgaatcgcgaagcaaatcccaaaatcagtaatctgcatgattttggcttcaaaaatcattcgccagccatttagccctttccctaaaaaaatggtcatcctatcctatctatcactcactctgattttgatagcacaacgaattataatgtgttgcaatgcaagtagaggatcaggagagagcccccgttcctgcatgagaacgtgcacttgatcatgaagctgacagctccatttgtttatccaaggagtgacgacaagctacacatttgtttatgtcgccatgcacccctattgcccccctcctctacccttcgctccaagtgtttcaagctagctacagcgtgcgcgatgcatgcatacgccactctggacctgggactccgggagagagggctaaaccacgctaaagtcggtgctgctttttcttaatccaaggagttaagcagtgcccatccattcttttgaagccatctactttgctgcaatttttttttgttaggacttgcagctttcaatccaatatagagtactcctacattggtttctttgcttctgtagagagacaag

SEQ ID NO: 28225 - DNA, 1740 bp, Oryza sativa
ggcagctgaattggggggggggggggaggggggctatgctttgtaggagtagtacttaccccttaattaatcatgtcagttaggccgcctggccagtctgatttcattcagagaaggtccaaatcaatcacaaatcaacacaaaggcaaccgctaacctaccccataaacaactaccgcctacttctatttgcaacatggcgaattatttccaaggtaggtttggtttgttttgctttgaattctacatgaatttcgccagaatgtatagtactagtactagtagtatactgcagagaaaccacgatgtttccgtggagcacagtgagcgacaagacgtgcggttaatctcggcgtgccatgggcagacttggcctttcgtcgcacggatgtagcagcagcagtggtgatgtcgcgggagaaaaaccacggccgggggccggcccccatacgggacatgtggagtggaggaggagcacccgaggacacggcctcgtgacagcgtcgttcaattggactggtgacgagtgagcggtcgtcgtcgaggagaggacggccactggccacggcgcgcgtcgtgcgtgcgtgcgagcgaaactccgtcgaccgagtagcagagagagagggggcacggtggcatggcgtccacatctacagatatagcgccgtggattgtgtttcactactccggcatcagttgatagcgagcaggcagagggcgggcgcggtaaaacttccgcgggcgaggtgggggcaccgacccggacacgggaccacgcctccccacacacacacgctaggcaacgtgcgaccaaccgtgcgcgcgcgcgcgcgggcgggggcatggcatgattgtgatctctctctgatcacgtcgcgcggttcgtcccgtgtcatatctcgtctcgtgggatttcgggcttgtccttagccggcgaaacagttggattggacggaacgggcggcgcggcagccggctacagcgaccgccaggccaacccccgcgcgcggctggggcgggggcgggcgcgcgcggatgctgctgcgaccgtgaccgcctcgttatctcctcggcgcaggctgggtctgctgggggtgtgggggctcacaccggggcttttggcaaaagaggccgcctttgctttcgcctttggatggacgttccaaaagatggcgatcgagatcaaatcttgtgggggcaaaaggagggggatgagcctcctcatcggccgatccgatttggtgatcagcctgcctgccttggccccctccctggccatgcttctcccaacgagtacgcgcgcgctgctgttaggtatgcaaagccttttcctatcgttcttttttttttctataaaaaaactattaacactgtgctgtgctctctctggctcttcagtgtccacgcgacgtgttccatattgccatatgcccatattggccagttcttattttttcccccttgaagacgggacaattgtgcttttcctggcttgggggcaatacgtttatgcgcctttagaggagtaagatcatggaaaagcacacgagattgtttccttgtatgcaagggaaggtacgtaacgtgaccgcgacgacggaggcaggccggcggtgaagacgtagacgcccaacagcggcggcataataggccagccgtgtaggcggaggcaccactcggggacgacgaaggcaggccggcggtgaagtagtaaacgcccatcagaggcggcataatagg

SEQ ID NO: 28226 - DNA, 8078 bp, Oryza sativa
gatcaaatgcatcgattactattctctaagaaacctgtcattatctaagagagcactagcaattatatttgctgttgtctgaaagcgtacagtcccggaagaaactgaacagggtacgcctccgaaaacgttatctgaaaatctatccttgacccgagatgactctcagctggttttcaggtttcagcagctaacgacaagggcttgcacagttgcgggggatgtgtagtgtactctagctcattaatgagatgtcaggtaagaaaagtagtcctccaaatcgcatcgacggcgacaaatgccctcgaataatagacatcacccgcagaccggctcatttggccatttgggatgcccacaaatggtaaacattccaacgcccgtattactacctaacacaaagtacagattcagagaaaatatggacagattttgtgcacactcgtgcagtctctgtccgttccctctcgtggcaagcggtgtaaacttaccaaactgcacaatagcaactgcactggatctcaatcctatagagaggagattttgccaataaacagaggaaagcctggaagctttcctggacacttatgtcactagctgcatgctttgctgcaattcaaagatgctgtattgtcagcaatcagagtctggctggattttctgtcacgtgataatttgtctgcaaataattgatcattgctctcctctctctagtctatattggcacacatctgcaagcaatcaagaaagagagactactcttcaggttcacgacaactacttgcacattttattcaactactgcaccgtcgctttgcattacacagaaatggaaacgggaaagatctgacgagctgctaaacactattgaatcgcaaaaccacaaagcgaggtcgctatggatagacaaaaagatgcaaaagattagccctaaaagcaccgtgattaagcagtcggtctgatgaatgcctgcgtgaaatgggtttcagtacttgctggaaagcaaccgacgcacattgcagagtattgctgtctggtccaaacagagcgtacaaagcaaacggagcgtaagttgcaccctcttaatcttaacaaagctcacatgggtggtagtataataccctggcaatctaacttgttcctgacattacagtacctcacctttcctacactaaagtgactaactatgtcgagagaaaacttccaaacaattcagtagcaattgattagttggacgacagaatcaaatgaatgagaggaacaagctatcatcagatcttttcctcagatacgccgagctgagcttagttgagatgaaagctggaagaagccaagaaaagaccaccagggtttaaggcctgaatcatgaggaggaggacgaagaataatacacaccctgtcctaatgcaaaagagcttccttgtccttatcaagcaaggctgcaagtctttgctaatcttctcatccgatcgaaaagaaagcaagctaggggagaagagattgtagtagtagtagtagtaaagtggatgcatgggggtgatagaaaaggagccatgcattgtaccaccaacaagcaagtgccgttgcatcgatctgcagccttttgatggaccggccggggaaggaagcagaaaaaaagatagccgtcgattaaaacagtctgtattgcaccagcgatcgatgcgtatgggtgtggtacgtactacgtagatagctaagctaggtcgtctctcgatcgtcatctccctggccctccactgctcgcaaagtcttgtaataatgcacagccttttcggttgctaaagggaagagggaaaagagagacagagaagacagaagtgatcagattgtttttcttttagcgaaaagtgatcatgctatgtacaagtgagatgatgatgatgatgatgataacggtggtctttctttctctcttcatgcacaagggccggcggtctgaattcaaaccccatgggggtacatatccttttaaacttaaaaggcgtaaaagaaaaataaaggagaaaggatatgccataaacagaactcagacagcagccatgaaaatgcatgtcttcatcagtgattagtgagaaaaggagggagcggatgaatgacaacttgtttaattctccctctgaataaagatctacttacgttgtgatacaggcagaaagatggcatacgcaactctctgtctagtgtgcacctgcagggctaatctaaccggcgtgggtgagcgcgtagggcaaacgcttcctctccctttcgacgaaatcttttacgtgctgcccgccctcaaaagaatgcactcaatttcatgcttgtcgaaaagccctgccttctcgagtgagagcgatacgtgtgatcgagcccctagcttctctctgtgaggaaacgcttgtgcagcagcagctagcaagacacctctgcaatcccaattttctgtcaatcactcgcgccttccgtgtggtcctcttgtcaatctctgtgtgcgtgtggactacttgcttggccacttgtggccaagtagaaacgcacggaaaggaagctctggaactcatcaattcgaccaccggaattatatttgctcgtcgatctgtactcccagctagcttccagcggcaaaatctcacacatgcacagaacagtaaattagtgacagatcgatctcagcgagtaggtagaagaactgtattagataggattttcctagctagttgagttaactagctttttttttaaaaaaaaaaatatcagaactgcattaggcaacacgcaccaagatgaaggttaatagagaggtcaactacgactccatccaaacaaagaaaagctcgtagctttcatgcatggcccacgcagttgtggccgtgcggcaccacacgtacagcgacgacgaaactaaagaccgtcgagtgagtgctcgtcgctgttgctggctagctagctgtactacccgctggccgcgatcacggttattttcgccctgcttttctcgcgggtcaatgctctaactcatctggatgtaataggcgtatagctcagctatagcttattagccagccaaatcgatgatatactgaaatgatcgatcgatcggatccatctgcgaaaagccatttgctagtaatacggtagcccacgtgttgggggcaaggagagatcactagctttcggctactcgctctcgctagctctctcctcttcccggtcgatgattcgcgtttcgctttcggtcgtctcaccatcgatccatccggccgcgacctgcctcagctacagctttttaatttccgttgtgcggtacgcatgggctcgggataatctcaggctcgcttgcgcggcgaggagaggccagcgtacgtacggcgtggcgttgcgcgctggccgatccgtaaatggatcggccccgcgctattcaccactagctagcagtttgtgttacacggaatggcgatggatagaaagagagggggtggggtgaggaggtgaggtcgacgtgaaggctcaagcgcgatcgagatcatgaattggtcttttgctgcgtgtgggaggtgtgtccatcatgcaagtggagctgtcgattacatgtattgtgtggttgttttttttgttcttgtatgtataggattggatttatgtatatgcacggagagagatcatttatgggtgtggagacaaagcagagattttgaaggcagcatgcaggaagtggtgtagatcgatcggattgtattgaaaacgttcggggcgtcggtgtacacaagtgtggttcatgcaatttgacactagaaagtagtagtagatcagatggtctctacttggaatgtagtagtactagtaactatagagttctttcgtaaagggcatcccctgtgcatgatattgcaggggaatatattcggaacatccgtcagtgtgaagactgttcgttacttatagtatcccctcctccttttgttctcctccccgcgttagccaacttgactacctgcgaaaaagaattgtggtatggctgtatattacttaacccgtaagtctaccgaatatttcatttctgagactggaaaagttttgcacaaagatcgtgtgtcgtgtctaaaagatgtggctggaaggtttggtgagagacgatgtgtctacttggaaatccaactagtaacgcagcccgcaacacggccctctcggcttaacccatctgcgcgatgccaagcccaggcgatgcgttggctcccagtgggctgttggctaacgccgcaacgtgtatgcatcagcttagcacgacaacctcgatagaataagtccattttagctcccttaactagtgacataatctgattcgtatccctaaatcacaatagcggatatctcgacccccgaactattggaaccggtgcaatttgactatctcgatagttttgaaagatggtttcgctaatgtggtggtgttgacctaatcttcgctaaggaaaaaaaaactataatgataacaaaatacgtatagtatcatctacgattctgaggaaacagacgcgttgatattcatttttgttctggaatccttctatttaccattcttgggagcacgattaacttcttattcttattagataatattttgtacagagacgcaagcggcacagcgtccttatcggcacgctgtttcgcacacctgccacgactaatacaaacacttatactgctgctaaatccctgaaccgtatagcaccaagatgggtcagaatcttgtttatggtatatggcaggttcactttcaccacgcagaactaggatggcgactggcgaggtaggcgttcacttgtgcagagcttgctgtgtaatcaggttgtgaaattggggaccttcaaacaaccggaataattggtcgggtaccaacgcgaccaaagtttaacaatgtcccattctcctttttttttcttctttgctgtacagaattccgatttcaagccaattccccgtccacctacacacctttttgcggcaaaaacaggtcgattagagcttccttgggtaaaatagcgcgaatccaccatagcaagctcacgactcgagaaccccgttgccttcctgcagcatccgatcccctatcttcgagctcaactgcagcattaaggaaacatcaggtaaacatgtcactattctgtgcgccagcagtgaacttgttaaaaaggcctcggagatagacactgatgatgtataaacagtaaaagactacaagcgtcaatcaggacctgaagatagtagctagatgaggaactgggtcacttacagcaggatatgtgaagactatgagctgcttgtcagctgtcgaaacaagaagattagtgttatctttctgtaacgcaattgctgtaacgttctgtccttccccaagttttagcatatgaattatctggcagtatatcccttattggttagaattctggtcatagcaaacaaagataaaaaataagttaaaaagttgctcatggttttcacctcaagtttgtatagatcaatgaagcagaccgagggcacatgaacagagggcttagtctcatttaattctggcaaatcatcatcaccgttgggtttgtcaagctcataatcatctatagcactaaaaccatcacgattgcaactgttggacaagcatgttccgatcaaagcaaacttgccatccacagaaatctcaatgcaactaactcgaccagagaaaggtgtcagaaccgaggtaccaatcgggattccattaacagtgaatgtcgataatcttttctctgattcattccaaatcaatatgattccttcagaagataaacacattaaatgtgcctcctgtttatccagcttcctaatgagcctgcctgtcctcaaattatgtagaaggacaccagacgtacttgaagaggaagcaacaagtcccaaggcagaactaacagaacagcaagttacttctccaagatgccctcttagtacatgcataggaccttcaattcgtcgcctcctgctggtttctagaactttgcttgaattgctagtgctgctatcaccagaggctgaatcatttggtgttgttggtgtagatggtggaggttctggagtacttttcttacgtaaagagcctatctgacgtatcctccaaagtattactgtggtgtcacgagaacctgtgacaagataattgctatctggagataaagcgacgcaggtcacaggagcaagatgcccaaatgccgtttcaatggtccttgctccgtctggggatatcaacttcacagaattatctgcatgcccccctacagttagaagggaaaaaaggatatcagaaacagcagagggagcagtttgatgatagttcatagtgtaaatacagttcaaaaaaggaaaaagaatgctgctgtaaaagcagaataaaaaaacaacattttctacatgaattaatgaagatgtcagttactcgtatgatctcactttgaacaccaggttttcaaccagaaaaagatctaggagggctttcaatacaaataaaacatggaaaatgaataatagaaaaaaaatactagctttccaacaatataattgagggggaaaatgaagaataaaataattaccagttataacctctctctcacatgtgacaacaacaaccgatgaattttggattgcagaggcagcaaaagcaatagcccttgggaactgatagtcgtctacagaaccagcagatcctttgaagatacgcattattgcaccaccacttaaatttatggcatttcttccatgatgaaagaggaaaggtgtccctgggccatttgaagtatttggctgccaatggtgcagtgccaaatgtgctgcaggaacatttgcacctacgactacaatagagtcatcggatacaagcattgcactagcaggaacattgcagttttctggattaggtagtacataagatctgacttcagttgggttccagaatattgtctgcacagaaaaacgaagagataccatgcactcacttcaaacaaatctaaatcatgaattagcgaaatgaaagctaacaggtacaatagatttcatctgatgtaagtgaaccatggtgcccataggatcactttaaccccagtaccccactgctccccatcctctccgacattcaaccatcgactgaggactaacaagtgaaatgaggcagcttgactttcttttagaactgtagactttgcaatacatgttggtatatctcctagaggcaaacatggagatggttgtgtccctatgattacgatgtctataaactcttcaataacgccttacttttcccttgaatatgctatgccattttaactcagcaagtatgtagcttactcgtgaacctctgtattgcttgatgatggctattctaaattgcttaatctgtattctaaaagttcacaggccaccgtgcttaccaaatagtgacatttcattttgtaaaacacagaaggataacttgaaaacctacctgcagctttaagatgtctgccaatggccttctctttgtatgtgggattgtcagcaattgagatggtgtttgtccaaaattacatatttgatcttgcatggatcgccgttgcaccttcagcattttcagcagcacgttaacaactagctagctactggcaaaatctaaaagttgaatgcagaatacttactggattagtgatttgatcaatatccaccatcccctcatatgtagcatagggaaaaacattgttagccatcactgcatctttacctctttgtttatgtctgaacgagaaatagttgatgactaaaggatgttaacatagagattaataaaatataattttaatacaactagcagaacccgtactttgttacgggattaaaagaaaaatcaaatgcagtggaaaaaatatattgcttttctttgtaatttttaattaaatatggagtatatgagtattaattagatgtgcatgctgcaaaaaataatcactgtgacttcatcgtgggttgtgaccattggttattttaatcattctcatccactccaaagacccaagtccatcttg

SEQ ID NO: 28227 - DNA, 5211 bp, Oryza sativa
ccacccctaccaacattttaatgtagtatagatatagatcctctagggcaacaaaattaggacccaagataatatattaaaatatacagtttctgtcagcaaaaatatcaatgaatatgtatcgtcatcagcagataccatcacaagaaattttacattgtccatctatgtcaactaaacatcccctaacagtctcagcagatagtagtctttctatttccagcacaaaaatttactgacatgggtcagttttgggaagaaagataacacaagagggttgaacaagtggtcaaaggatggggcaggacatcgatgtcactggccaacatatatgggacgaatagtagataattaagtaaaataacgcaatgcagctaagaggtggcaacaaaaaggaacagcacatagataacgtacccaaatattaggtctatccattcatgcaaatgagcggagacataatcactctcaagagccttcctgtgtttacatatgaaatcaacagggttctcagcccaaggaggcaattgcacagaggctgcaatacaactcaacattagaggagttcagctccattcccttatgcatacagaatgaaacaaacttacatagctttccagtaagttgagttgaccctaagtcaaccgaattcacattcgtaaataactcaggaaggtaaaacatctctggaacctagagaaataatcacatgattaggttccaccaaagattctgattggacttactcactaaggaatcacaatgaattgaaggcacatttttgaacaaaacttactaactcttttacatcattcatgtcttcaaggacactattccatgttttgttgatacaagaaaacatgtgatcatcttgaccaaacctgccaccttgctgctgaatagaaagggctgtaaaaggctctatcctgacaagataatataagacctgcagtagatgcttatgtcaacaaccaatagcacagaaatcggggtatttgaaaaaaaaacaaatatgtaaagtcacactaatcaactacaggaggaattgtcatcgatgaacagtatagaaccgattaatcaaatgggatgacttaataaattaatctaactccaaataaaaggaacacatgcaagcaaaatgctgactcaaaacatgcacaagagaaaaggtaccgtgccaggacaggagtaatgtgaactgtagtgaaattttgggatggttggatcattgaaactagagtaatgttcctggaatttcttcagtcgtgcaggattcagagcgccaattggctgcattgaaatttttcaagcatcactaccagtggttattgaaaaaggtatcatccacagagttaatgaattgaaaagaagaaaaaaaacaaaagaggtctaaactggcagcaaggaatgaggtacaggatctacctccgaaagatctcggtatgcggacggatcttcaagatccagtgttttggagtggtaatctgctaatacccatggaaaaacagggtactgcataaatagctagtgatcatttaaatgcagtagtatatttattatattcagaaaatgagttatgaagcaaacatgcctgtgcaatgtcattgtaactgcgcccagcaagagtgttcagttccatcaggtattcaaagttgctaatctgcacaatgagatggctctacttaagtgttgaatacacttaacatgctgggctgaaaaaagtggtttattgcattgatacctcccatctagcccagcgctctgtcaattgcgactttttaaggattttctcaggtctctaaaacaaaagtacaattgattaaaactttcagtaagaaacagattttaacattaaagtttgcagaactgcactgaacaccaacctgggtagctaggaaaatgctgttcaaataaggaggtttggtatgaacgattgcccgataagcatgtttacatgcttctgtatcctgataaaaatcatatacatcttcaaaatattcaggtagctgtagtgtgcatatgattccaacaacgtaaactagagtatcatcaaggatgtacctcaaaatcgaagaagaaatttgacctatctaccatgaatagctctaaagcacttcgccgtaacaaatatctgcacagttaatttaaatcagtatgacatgcaagtactataaatggttactgctaactcagtagtccataattatatgataaggacacagatgataaaagcaaaaaagttatattagttaacactaacgactgcaacaagaagttcaatgtacaccaccatactggataatgaagaaccatttaccttctactataaattttatgaagtgaagatatgaaccagctccgatctttatcttgctgatcgtattgcccactagtagatgcagcatcatccatgtaactatcgctatcactcatatgctcatcaattataaagttaatcatctttgatgtgacctgaggaaaatcattatatactagggcttaatatatctttcgcatattacattggagatgaagcagaatactaccataaatgaatagaaatacaagaaaacaacttataatgtaaaaagaaagtgatatgacaaacataactagttatgttcatcagagaattgagattgattaaaatccagttaagaccaagatatacagcaaaaatattaactttactaaaacagaaaggaatcatgaatgtgtagacatgattattgtaacttcagtttacaactaatatgtcataatcatgaccaagaagtaatggcattaattagaatttgaaaacacccttatgcatgaaaaactacaaaagtgaaagtacgtacattagaaaccacttacttggaaggttccccgcacaaccttgaatggacgcaccatcaatgaaggcagttcaacaataattctctcattatttttgctagaactgtaacacggtgcaaccacggtcgatcgaaccaagttgtgaacactagaaaagtcagaacttgttgaatcatctacactgctatagatagtctcagtttctgtctgtttggcattcccatgtcctccatctactgatattgcgtcagctactataatggaagaatttgttcgaagagcatttgcaaatagagagtctgcatcttccctgtggctataattggattctgcaccatcacatagaagcatgttctcctcataattattggccatactcaaatgttcagaccatttgtagtttcttttcataaatcttctcattcttgatgaagtttctgtggaatctaacttccagaaaatctgtgtagaaaaatagtaaagcaaatcaagatgtctataagaaaagaaggcatgcatagtgtttactgctaagatgttctttttcctcttgttgactgaaacaatttatttgtatcatcataaattggtcatcaaggatagagcttttcataataatgtaaaataaaagaaaattttaggaaaagcaggactgttcgtacgttatcaggagtacacagaagttccccaaaaggtccgtatagcctacttgtctctattaagcaatgaacaagacgtcgccatgcccgaattccaatagatgcacaacgacgattcaaaatatctacctgtgttcgcctctccatctgcatgtccaaaagttgcctcaatggtgtattcacaagttagtaattcctaaatatcagagcagaagcttcccattccatatcaacatacctcaactcgttgcaagttccgtgccaatgcaaaactggaaacaagaagtgcaacatatttgtatgaaagggcagaaaaatcccttcctgatactgactttgaatcagcagattgaagacactccaaccaagcagcacacatagcttcagatgtattccacctctgggccctctcaatatcacctgcagccctcctttgtcctgaagttgccattgctacagcactaagaccccttctcgagccaatcttagcactgcgctcaaggtcacgagcagcagccaaggcagcagcttttgcagctgctttatcctttggtgcagatgttggtaggtttggtgttgcatcaataggcttctgaaaacttgagaaagtgtgtagtttagcagatctacgctctagcaatgaggtgtcacgcctgcgcaacttatttgttggtggtgctattgtttctgtcccagaggtaccagcagcaatcatggccaatgccattgcaaccgggggagaagcaaaggcagcagcccatccaggtgatatcattgagacagcagcctgagttcaaaagacacatacagtaatctcaccatgaacagataacctccagaaaagcatagaactgaagaggtctttctcaatagtaattattgcaaagtagtttatagttatgctaatgatccaaatcgtttaaatatttgacaaaactagctctgaagcattccatgaactactcaagagactagagataaaagaaaggagagatactgggacaagtgactactgtacacagcacacaccacatagtttcacgagcacaaaatggaagtgcctgatgagcaattgttaaaaagaatgaggatttaaggtaattagccaaattcagacactttgcaaacatagcattttaagctggatatgagaggagctcccgtattgattttttttaagaggtggtgaggctcaaaactaggctagctagctcaccaaggtgctagccggtaagactccgggtctttctcctaaccagaacttctactctacgtaaaaccaacattagttgacacaggcatacagcatcagcgcaactgccaggcaatttaagttgatagccattgtgtacgaactgtgaagaatcaattgttacctcaataggtaaagtgtctgctgctaaagcacagtcatcaacaactagtggattttgtccatctgaagatgtgagctcatgaattccagccaaaacagagcgatatcttttcagtacagctacaaatggtggcatgatcaatccaacatattttttccttagtggttttctatcactacttacagcatgccatacctgttaagatagaaacaacttcatgaataatgcataatataatataataaactttcttcgctttatctactaaaaacaaaaaaaaaaaaaacagctcatagagttccacaaatttccaagacctaacacagaaaatttta

SEQ ID NO: 28228 - DNA, 1868 bp, Oryza sativa
  unsure (1)..(1868): unsure at all n locations
nnnnnnnnnnnnnnnnnnnnnnnnnnnnnnnnnnagttaacctacatggtcatctagacatctagtctagtcttaggttggctcatgcgacacatagctctttgtacatatttttccttgctaatagaacagatatgtagtttagcaccataggtcttttttatgacttcaccacttgcctttatggctaagggcatatcatgtaggccatgatatatttttccttgcaaatggaatagatgtacagtttagcaccataaaaacctatatagcatatgatggcaacaacacatggtataacttttttccttcatggccatatataattaacgatgagaaaatgcaactgcagtttatgtggacttcattgaattattcaacctggattacaccatggtacatgtgtgttgttagatgcagatcataagcttccatggaagtggaacgtgatattacctctgaataaataatagaagatgcaaccaaaaccctctgtctcttagattcagaaacaggcatattcaaaataggaccaagcactctgtacaaaaaacaagaattacatatatgaatgaagataatatggattaaaatatcaatgaagagatgacggagaaacaattagtctggaatataggctgagaccgaccactgagaaagaattgatcatgatgtaacccaaaaacaaagcttaattcacataattaattgtgcaaaaacatacagtaagggaaaaaaatctccaatactcctcgttaggagttcaatgcacatatattttcattaggttctgtatttgatgttcagccacattgagaaaaagaaaagaaaagggaaacatgtggcaaaattgaatgttggactcttgtaccccatttctactttggggcaaattgttcagtaacaccagaagatagcacaggtcggagaatggcatttgtgggcatgtcccctaaggaccagctgtcagactaatgatggacgttagtctctaatttatactccattaaaaaatataaggcgtattttgttttgttaggacaatgctttgattacaaatgttttactaatatattattaatgtgatacaaaagcataatcataagtactccctctgtcccaaagtatagcatacgggtattaacagagggatgaaaagatttggttgcctcctcggtatagatgaggtataggcccagactatttggggctataataaaacaacggggtagtagggatagtatggtaattggtaagtttaatggtaaaagtacaatactaggtttgagcagtagaagttatattttgggatagagggagttaatacttttgaataagaatataataacattaattttgtgttacaaaaaatactccctctgttttttaatgtttgacatcattgacttttgaacatatgtttgtttggccatttgtcttattcaaaaaacttacataattatcatttattttattatgatttgttttattattaaaggtattttaagcatgactaacatttttgcatatttgctcttttttttaataagacgaatagctgaacatatgttcaaaagtcaacagcgtcaaacattaaaaatggtgacagtatatcataatatagtaagtgttgatcaaagtcttgtcctaacgaaataaaatatgccttatattttttaacagagggagtacatatttgcagggttactgagctaagagcctttttttcagaatatgacttgaacaagctattattctaaatcactacacttttctggttatacactatgtacctccacagaagcgcagattgaggtttcctggaaggcgaacaagaattatcatcatgaatcatcatgcttccagtt

SEQ ID NO: 28229 - DNA, 8333 bp, Oryza sativa
acagacttccaagattcccaaccacttcctccaccaccaaagatattggatttgggtggaatgcatacaccataccacaatcggcttctgtacttcaaccttctgaaagatctgaaatacaggtcccataggatacaaatgcatgcctaacagatccatatggctccgctgctgctgctgcagtgacacgttccatcacctcagaagaaatttgcccgttcgcatcagccatagaagcaagaacctgatgttttgtacaccaacaataaagatagaattcaaaacgatggtgtgaaaagtagttcaaagcaagttaagttcaggctatgaaatatccttttggattatactcatattgctaccacgaaatagcttatatattcatgcttgtcgagttctaggaaagaatgtagaagaacattcaagacagataatagagataataggtacagtataccaacataaaatggccaaccagctactagctagtagtttacagacatttccttttgtcaagaaattagtgtacacgcatttctttttgtcaagaaattacaaactacaaacagattttcaattctaaaactacgtgtgtacaaagaaaggctgggagacacaaaaaacattgttcatagcaccaactcttcagaaatctcatagcagtatcctttactttcaattttcttcacgagaaatttttcttagaatttggacaatcaggtgtcttctcatacattattctatttatgagtttaacagcattagacaaagacaaaataattaatatagtgaattcataaaaggacctcgaaaaaacaatcaaagttgattcagtcatatgcagcaacattgaaaaaaaaaattgaaaatttcggagctccattatcatgttagtgaacactagattgaaataatgcaaataaaattatgatatatggtcttctagatatacatacatcaacaggaagaccaccagcatcactggacaaagattgccttgagccccctgcatccaaaggttcactaccagtcctgctcaatgaatttgatctagtggcagctgatgaagcccctgaggcaggagatgcagcactatcaattgagcacgataagaaataatgttgactgcgtgacctcaggtgatcttctacgagcatcagaagaacaattgcattctcagccaaggctagagagagatgggtagctttatctgcttggattttagtttccttgggcatcataccctcctctgcaacaccagctgctgcagcattgattccttcagtctgctatggatataaataataaaagaatatcatttgcggactaataaaattaactgaatactttctaccttcatagacacaatatgtgctatgtccctaagaatgaactcatgagtaattgaactggaattttctgcgcaacatcatgaagaactaattctgtttcaagagtgcacaacaaaagtgaagtttggaagacaaaggcaaagggataaattctttatttcactggaaatatcaaatgatggtagtagtgtgaaaatgaattgctactgcggtcacacaatcatgacgtgaaagtgtggtaatacaagcttactatgttcaatctagggacctagttagcggagcaacattaggagtcttgtgattctaagctcttaccagacacctgcttatccctatgcttatttggtaaggctatgctccttcctaaactgaaacttaagtcagggaagatgattttggagttctacaaggttgcaaggaattagaaaccagattaatcatgtatagtttcctgtgctaactccatgagttagctagtttcacttataatcctagtaaagtggtatataaatattaccaagaaaacaaaacagaattattacgatgacttattccccaaatttgctatcactttacacaaactgggagtaaaaagtctaaacagattgatgtggaaaagaaggtagaaagtagcaacaacaaaatatacaagaagaattggctgacgagtatattttgtaagagaagcaacatctacctgaacttgaagctcctgagcagaaaattcaagcagattacccaataatctccttttgaaaatcggtaacgattcctcacgccttaataagaagaaaatgcaaactaatattagcatatcaagattgacatatgttttaagcaccaacattcactatagttcaaaaacacaggggagtatttcgtaatgacatgacaaagctccttcagattctcagaaaaataagagagagatgtaacaaagtgcaaaaggctgcatgctaaaggagaaacttttttagaaaggtagaaacgaatattttgtaaggaatggtttagattatatgaggcaaaaccctgtaagtattcatgctttagcaaccttattgattgtggtggtttatcacctcaaaatttctgttagtgcctagtagatcaaacaatgacaggatgaatggaaaacatgttatggggccaatgcttcttgtttacctaattctttggtccccagtgctagatcctccaaccattgaaagccattctgcacaatgtatcgttgcctctacatcctggaaaaacccagatataatgttaccataaaaagaaaggttacaatcctataaagtaagttaatatcaaatagaaagatatgatatcaaagtcacttgccttccacccatctttctgccgcattgaatgctccaacatgatagctagataattgtatatatggtcttccatcacacttaagcttggaccatctgaacctctgttatcacccatctacatatcaatttttatacattagaagttccagtagtgaatgaacaaaagggggaaaaaacaagaagaagaatacaactgtcacctattaatgtaaccctcactaaaaaatgttttcatttgtcatcacagaaacgttacctcatgatttgaaattaagacctccaaaatccattcgggccattccgcaatggaagtcagtgcaattctattctcattattagttccccccaaatatagaagatcctgaaataatataagcaataagtaatcaaacaagagattttatgaaagatgatatacgatagtaaaaaagataatacttattttaagatttacaaaacatctgcacgtcgtgtatttaaatacaatgtttaatgatattggtacaatccatgccaataatgttatctgtggtaccatcaggttcttaaagtcaacagaaaatcaagacaatttaaatttaacaaatcagtaaaaaaaacctgaatagcatgggcttggaatgcccgtgatgcaaatggaagagaacggagtagaactgacaaaagtggagtatgcttaacacggtgaccagaatcatgtagtttcaagctaccatttgctgaaggaacattgatctgcattgaagaacacaagtcaacaattaaggaatttcagagtacaagcagttgaatctataatgagcaaaacttccactactgagaagcggagtaaaataaattaagggttttttttcttttttttaaccaaaatttagggctttatttgtttcaaaaatgttctcgaatgtctcttattcaaatacttccaagatgattgggaaaatgataaacataataaaatatttccagtaaaaagaagatcaatataacccaatagaaaccaaaaacatggatggccagcttttgataaatgtttggttacatttgttgagctaaagttttctgttcgagttagtgatgataatgtaaaaacctcttgaacataaagactcgttaactggtagttctgtttgaactatagaggttcctgttgaagttttttgttgcaatgtgtcacttatgtttgcagcaccatcctaaaagtcatgattgcatcactggcatggacccattagtgtaattctggaaacgtgttgtatattaattattcacaaggaacttaaaggcttaaagaacaccataccacagcagaaaataaagctttatagacatttctggtcataagccttcttggagctgcttggaaagctttctgcattgcaaagagcaacaaagaaactctgtcttcaaacatggaatttccttcgccattagaggtagttaggaaactgctgggcaactttggctttgcagcaggcaagttaaatttcaggtgacctgatgcaactaaagcacccaaaacatgaacaattccaacaagaactccatctccattatcgatattgtatatgtcgttctgaacattgtctgcaatattcagaaagtcaatgccacctagattctttaggaactgattcttcaataagcaccatttgctagagaatccaggttcagtgctgccttcgtgacagggtggttcatggtgctccaatggttgagtcttatgaccattgcagtttgcttcaccagcagtagttttcaaatccaaatcactactaatagattttgggtcagaaccagcattccacagagaattctgtggcacaatacaactgtcggaaatattgttatcaccagatttagcctccctttgcaaaagaacaagtaatgcctctacacctcctcgggaaatgaatgactgagcaaacacgttggctctagatgtgtttggatgtacaatcaatctatagatgaggagcaaaaccctagcaacctgacaaagcatatcgttaaaatcaccacaacagcacactcttactcagttaccacttaaagaagatatgtagattgagatcatgggttggctgcatatctcattcactaaaggaaagtagaaaatatatatgtgacaaatcatagaaaccacatttgatctttagaagaaaataattgcgaagaaacattttatagttcaaaatctagcaatgatgtgattaacaaagtactgttactttggaattttgctgtactgaaactaacacatctcattatatattgagatgtgagcttaacatgttctaatgaaccatgaagattaaaaattggatatgaaaggatcaagtgtaagcatcatcataatgccaacaaaactatgtcaagaatgtttgtttcgtgattgaaactaacatatcagaatatgttactaatgtgtgagcctttacatgttctggcaaaccagaaagattcaaaaattagatatggaaggagcaggtgtaaacatcatcacaatgaacaagggaaatgctggcgaaacgatgagaacagtatttgcttcatggaatgtgcaaagtccagttacctggttaggttgtggacagtcaacaacaaagcccaccaaagagcgaacatcatcagaagccaatgtagaagatactgctcctagtaacagttcaataacaaccaaaagctcatcaacaagagaattcactttctctaaaggtctctcagttccagtaaatgtgaatgtatcgattgaatctgcttcatgaattacccagtaacaccttctgcacccatcaaggagcatctgtagtgcatttgcatcatgcatgcaagccgattctgcaaaaaccatgtccgcaagtgaagatagaagctttttctgcaaaacgtagttgcatgaactccacatcttcaggtccaacagcaaagtgctaaagagctgcacttttagaccatgatcatttttttgagactgacacagagatgcaattgctgcaacaagctcctcatcactcagtatctctttctccccactttctaatctcgatagtgtttctaataggtaatgtaacacttgtgataaaagctctggtccatgggcacggcatagctcttccttatttccaggatgttgagttgccagcgaaataatcctaaaaataggaacagaaagagaagcagttgcaagagacgatgacaaatccccgagtataggttccatattatccatctcgacattgctcacagtcaatggtagcaaagccattggacctccataagctaatgcccacaatgattctgcaggtcgcactcgatatgataaatgaaccatcccaagaacttctgcgggtcttctgtgggtacctgaggttcaacatccaataatatcagtaatgattcttctaaatcaaccccaggcctttgtgcctttgtaagttatattattgcatggcatgtgtttttacacccattggaaacaccctgatcccagataatcgttaacagcatgggactataacattttgtttggatcaatattcaatataggcatgattgatgccagatagaaaagttatgcagaacgtgctaggcaatagcaggcaacccaagcaggaagtaataggataatcttttagcagactgagaaacattagtgtaactatttaaccacgattgtgagcctgtaagtagactatggttcagctgccaagtaacaaagtactctctctgtttcatattataagtcgtttgacttttttcttagtcaaacttctttaagtttgaccaaatttatagaaaagtatgttaacattttcaatacaaaacaaatatattatcaaaatatattcgatgctaaatttaatgaaactagtttggtgttgtaaatgttgctgttttttcttataaacttggtcaaacctaaagaagtttgactaagaaaaaagtcgaacgacttatgatatgaaacggagggagtagaaactaagcaaggaaagtatgactggcaatttataatctacttaattatcaggtggataggagtgcaacaacagtctgaacaatataaagaaaaaggcaagcataaaacaaacctgttgaaccagaaggtgaagcatcaggacagaatcgaccattgagtagactaggatgataaagaagatgtaagcttcctccaatctcaatgtcaagtgtataattgtcttctgcaatgtgcctaatgtgagcatttgtagctttccaaggcaaaccagaaccattgctgaagctggggagtgcatcaccacccctagaagctatacggctcattctctcaggcccaattgactctgtgaagatgtagataggccccatttctgcaaacaatggacattgtcgccggcgctgctgcaggcccgcaatagttggtggtgggttcgtcccaatgcagcagaaggccagaggtttcaagatgcgaggtaactcgaatggacagctctcatgaagctccccatccacatacaaccgcaattcactctcgaccttccctagcagggcctgcttgcttgtgtactccaaaccaacaaaataccagcactgtggtctgaattcataagtgaaatgcagagaagccttcttccccttcccagccccactctccacgaccagaaactggccatggaagtaggcctccacgccatggttatccatagtgaggaaacagaaaagtcggggcatgtgcttcgtcccctctcccgcaagtgtgctagcagcagcggctgctgctgacggtgatgacttcccggacgttgaggctgcggcggctgcaattgctgctgtagccatgcctgtgttgagcgagtccgagaatgactcaacatatatccacgttgcaaaaccaaaaccgtttgagaatggccatcggctttccgcaggggcaagcaagccagagccctccccaccgagctcaaatgtcactgcaggacccttggcctccttgcagcccacagccttctccaacgcaagggtcagcgacgtggcccagcacgtgccaagtgtcttcttgatcaggaggagccaggaatgtaggtccttgacactaaccgagtgcccacccagcatctggatgcattgcacaagcggtgctccgtcccacttgcttctctgacccattccgacgaacagcttctctgcagcgtcgagaaggatggcgagaaggcccgatgaagtgcacatggtgcggtttcgggtacaggagctgagggtggcgaggagggcgcgggccatgcgagtgcgtggcgacggctcgacgccgcaggggatgtagggcaggagctcggccgcgatggctgccgcgcgcgagctggacatgatgctaggcaacgtgacggcgccgtcgcctgccccctcgtccagaccgtcgacgccgcccatcgtgagcatcagcacgtccacgacgaaatgcgagagctcttcgtcctctccggagaccatctcgcggagcgctcgagccgccgcccatgatcaccgcgtgcaccgcccgcaccacctcctccggcacgtccgacggcacgaccggtgccaggcgcttccgcagcgatggcggaaaaggcagcgcggagtactccgagggtgccaccggcgatccctcgctcat

SEQ ID NO: 28230 - DNA, 991 bp, Oryza sativa
  unsure (1)..(991): unsure at all n locations
nnnnnnnnnnnnnnnnnnnnnnnnnnnnnnnnnnnnnnnnnnagaaaagcttggcgcacacggaagagtgcgagagctcaaaagatccctcgcagagtcccctacctggcgcgccagatgacggagcgtggggctcctcaccgggagaccgcgcaggcccccctttgccggttcggccggggaccctgggtgagactctaagctcccaatctgtggaaggttcgcgagacaggaaacacacaagacgccggcgatgtatacagattcgggccgctgagaagcgtaataccctactcctgtgttttaggggatctgtgtataaaggagctacaaagtatgagccagcctctcccttgttctgggttcccaatctggaaaagtcccgtcctcccctctaagtgggcaaggtcctccttttatatcttaaggggatatcacatgcaccatttccctcttatgtgtggggacttaccctaccttttcataaatggacggagatttgtatagttgccgtccgagtcaccttctgatgggacggctacctccactttcgttgggagcagatgcgacgtggaatcgtggctgtctactgacgacatgaccggtgtcagaccagtcacgtcggtcattcttgtccaccacgtgtcagcttagcaatctacatgttcgcccttcttcacacaacatcttgcctgtaatggttaggatgaaacctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaatgagtgcactgtactgcgttacatgcggcgtaacacgctcagccaaaccgcaataaatgtggttaggtgagccccactgtgctcacctaacccataca

SEQ ID NO: 28231 - DNA, 1896 bp, Oryza sativa
agcatcgcgggctaccggaatgtgacaccagcagcgagcccgacctggcgagggctgtggcggcgcagccggtgtccgtcaccgtcgacgctggcaacttcatgttccagctctacggcagcggtgtctacacagggccgtgcaccgccgtccgccgacgtcaaccacggcgtcatcgtggtgggctacggcgagtcccccaacactcccgccactgacggcccgcccttcccccgcgtcgtcggccgccgccgccagacctccccgtgaccccgtggcgctggagagaggagaggggagagatggggaaagaggaggtgtgagaatgctacccaccattttttaattcattcaaactgacatgtgggtcccatgagatttattatttttcggatcgaattgccacgtaagcgccacgtcaatgctacgtcagatgaagaccgagtcaaattagccacgtaagcgccacgtcagccaaaaccgccatccaaaccgtcgagggacctcatctgcactggttttgatagttgagggacctggttttcggttgaaggacgaaaatcggattcgttgacaagttaagggacctcagatgaacttattccatacgggtttggagtgtcgcgcccgtttaggctcgaggaaacgtggcatgggctttgcccttgcagagtgttgcagggccgcgtacgtgtgctcgtgggctgttttgcgggagggaactgaaataggccattgggccgagcgatggcacacggaacctggaccaggacaagctgtgaaaagcagagttgcgaaaactactcacaacattccaagatttaaatacttctatgatttaaacattgttcgacaataaaataatttttagcactatttacttatcatatcaatcgcttcccacttaaatttctacctatcttacctctcccaatcttaaccagtcctcatttatcgagggtacccaaaatctgttctcctcaacctggctataattgcttatatcagttgatacacgcgctttgctttaggatatgtggatgaatggatgtagatagatatatatgtttaaataatgtgaaaatattttggagataatgatttgacattgcttgcatattgtgttttaaaactacaataaaattgtaaataatatgtcatgtttgcatgatatttaaaaatactctagataataattgctagtaggtgatcatgttgcacacttacgtatgatttaaaatactttaaataataattgctagtgggtgatgatatagcacacttacatttgagctttaaaaattagtggacattaagtatatagatagttgaaacagaggaagtagaacacattccatctaatgctagtgttgtaagttcaagtgtcttaatttggtttcggtgattaatgacaaatctaattatatgagactaacgtttttatgagtctttctttgactagtcttatttggatatgaaagtaaaaatgatgggaggtatgtattaaacttcatatattctaacttggtctctcttgtggatccaaaatatagtgtgagctccctcattgatcttgattgattatgtgcatatgcattccttcatatccatatgtatgcacatcttgagagggagcttattctatattttgttcattataagatctctaccttgatttgaaattatctttcatctcatctctttgtattgtttatatcggattattatctatcacaaaagagaaaaaagattgaaagatcttggattaaacaatttgtgtaattgttactttggtgatagatgataaaccgatgtttatgggattaacctctcttttacataagttttcaacaaggttatttcccgataatgagatgtggtagatatgcattcttt

SEQ ID NO: 28232 - DNA, 7855 bp, Oryza sativa
ccttagtctccttcacattgagaacatggagatcatgaatgtatgtgtttttttgcttatcttcatcattactacactatgccttctctatgtgtataggataaacccccattggttcttctggacttatgcttacacttgtctctcttgtatatttctttgtatgcatatacttagggggagcaaatcctatacatttattgtgcatgttttagatccatgttgttcacctattatatatatcggtatctttgcacttgagcttgcatacgagtatatgacacttatgatgttaatgaatactcaacaaacatatccatatctttcatatgtaactggttggtcaccaagtggaggatgccaaccgatttgttgggactaatgttttcctttgagccgtgcaaaggaatagatctaattgcgatgaggctaatgaatgacaccatgggttaatggtcaccaagccaaggacatcgtcatgttggcaagaatgaagtcaagcttgtgatgagaataaagtcttgacaaatgatggcaaagacctcggcataaacatggttcaaccgaatggtcacaagtgttgatgttggctcaagcattgaccccaagttggatggcgcaaggcaaaggtataatggagctaagaatgttttcttagtctttttcccggtcttggtgtttggtgtagactggatttactagataggtgccgtactatcaagaggggtctatgaagctagcatgtggatgattttgtaccatattagttcatatgcatataggttcattttgtgggcttgtctagccaagtgtggtgagttttatcaagtcccaaacaaagagagatgtgggcacatcctataggtttgggtagcctcatgtggttatgtccggtggagtatccttttgagtgtgagccatttctccctgagaaaatttgtgtttcttggatggattgttcatgggttggatatccctttgaataagctttccatagagtcctagaacaccaaattccgagatccgagtcaagagatatcgccgttttactaacggttggttgtgctgaaaagtgacctgcggtctgaccgtgggccttaggtcggtctgaccagggctgttagccggtctgaccggcgtggtaaggccggtctgaccggccctactggtctgttgcactggtctggtttttggtggcgatacagagcccgccagagccgcaaccggtcagaccgagccaatggcggtctgaccgagccgtggacggtctaaccggctgcttcactgcggtcagaccggccaggttgagtgggctcaatgattgccctgtaacggctaattttctatccgttacaaagtagtccggtctgaccggccactctatggtggtctgaccggcagagcacagagttggagatttcgactctaacggctagttttggtggttgggggtatatatacccactccccagcagcaagggcaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtggaggtgttacccggtgacctctccgaggagattgtggaggaggcccggcgccggttgtgagtggtttggagttcaccaccttcggagtgaaggaagaactaccctagtgatcaaggctttggtagtcctctccgtgggccggctcccgccttgcccaccccttaacgaagggggcgtgaggtggcttcgtggttgagtggtggagttggggtcgtctcaacggggattaggaaaccggcgagtttctgaatctcggtgaaaattccttgtctcttgtctcctttattttgggcaaatttactttgagcaagtttacatactagagtttatttgtgctattatcaccctaggcttgcaaacctcaacataggctagcttctttgtgcacttacttgagactagttgatttaggttttgaattgtgcaaaaccattttgatttacgcttccgcatacaaaactcggttttagccaaaagtttgaaaaaccgcctattcacccccctctagtcggccttcttgatcctacaagtgtggaagctgagaacttaccaatgttttatacagttggatggtactttgatgcttcggattattacataaggtatcttttgggtcttacgtagaaaatttctatcgtcgcttcccgatattatttatacaaggtgattccccgcgcttttgcatgagaattactaagcagttttcaatatatatttttcgacaatcaagctaggagaaaatagaaaataaaataatgaaacgtgagggtttatcagtacttatcataaaacaaacaaatgatacccacgatttaatgtagaacatattgataactatatgttaaatattataaaaataatatatatatttgttaaaatattgtagaaatgatgtgaggggtaataatttgataaacttgcatgttgatttgtataattaaataaattatagatgatgttgtgtgcttgcttaaggttaaatatgtaattattgatagtgggtgatgatgtggcatggttgtatgttgagttttaagagttagtggtcatcaaatttatagtaagataggatttgtaactaaagtgtacattgctatataccaataaacaacaacgatgtcgtagaataacacatgtgttagtgtcctaggtaaatgatgtaccctgcattgcacatatctcaaacggaaaataccgcacaccaaattatataaaaaataaatccacgaaatagagattgggtaagaagtggtggcatattggggtaaagtacatggttcgactggcctacagccacaactgctcagtatgtatccttgtctcccaaactttacttgaactcttgaagaagggggcaaccctaaggtataatgacatcacatccttgaatgggagagcatcaagttatatatcaatcaagataagccgtaggtggcgtagccagcgactacaacctgtggggttaaagttgtaaaattctttaagttttatattgttgcaacacaaatatcaatagttttttgggttgttttgcaaaaactatttcctcgtagcattgccattactacacgtagcttcgctactgtaagccatacaaaaacatatatcgatttgatattcgaaggaatcccaaagcccagccaccgaccatatcgccaaggtccaccatttagaatctcacagacttagtcgaataggttacactatgatttatccatgcgttcttattctatcttggtgtatacccttataagttcatagtcaagcatgaacccaccaacattttggttaagtagtgggtcgaaaccacgctcattcgtggtagatcaatatgtttattttcatattgcttatagaattaatagcatgccttatgtatttccatggccgtattttttttggtagttatgcctgtcagggttacggataaggcataccctctatcctacgacttatggaatataccgatgaggtataccttcacgtatgcgggttgtttccgtatacgctttaggaatttatctcaagttatggaaaatatctctatgagtttaggaattgccgaagtcctactcggaaagggtaaaatctctagtatatcgtgtcagtttacatatctccaagttttacttgggggtgaaggtattccacggtataaaagggacccttagggagaggcaaagggcatcgcatctcatcgccaatacacccaccaaagtttacgaagccggagttcacggagccaactcgtcaggagatctcgtcgaatccctcgactacgatctcatcggtatcgcctgtttcggttactttctttgtaatatgttctcatcatcatcaatcccatataaactggactagggctataatctgataaggggcctgaaccagtataatctttttcttttgatgttttgatgtcgtactacgtagacccctgctccaacgtaccccaattctctattcatccggtccgcgagtatcactcgtcaacaatgcatgttgtatattttcctgaacatgaataaatcaaatggctagtcatattttacgtacttacggcccttgttaaggccaataattcccagttagtttttctttgtgaaactaggcaaagttgtaacaaggtccgtcgtcttcgtcgtaggttgggcttaagtggttttgtcggagtggatagtaatggcctgagtggaggcctcgctttgttttggcatgaaagttttaatgtcgaaattaaatcagttaatgatagatttttgatgcttatattcgtgtgtcccctactgcacctctttggcatatctcttgtgtgtatggtgaacctcgtacagagaacagacatcttatgtggcaacaccttagcagccttagacaatcttccactttaccttgggtagttctaggtgacttcaatgaggccctttggcagtttgagcacctgtcaaagaatcctagatctgaaatccaaatgcaagcttttagagatgttttagatgtttgtaatcttatagacttaggttttgagggtaatcccttcacttatgataacaggaggaaaggcagtaacaatgttcaagttagattggatagggtggttgctgatgaaagttggagggatatttttagtgcggctcatgttgttcacttggtttcaccttgttctgaccatgtgccaatccttctgagattattgcaggaggaaaaccataatcaccggaagaaatgtcgacactacgaaatcatgtgggaaagagaggctgagctaccacatatcatttcggcagcatgggaagctattgaatgcaaaacagatctaggcaacatcgaagtgggccttgacaaggtcatgtcagatttacatacatggggaagcagaaagtttggcaatgttgtgaggaaaatagaaaagttaaggaagaaattaggggagctccagtactctaattcagaccaacatgagatcaggaagatcactgatgagatgaatgagttactttacagggaagagatgctatggctacaacgctcccggatcgactggttaaaggaaggtgatagaaatactaaattctttcatggtagggcagtctggcgatctagaaaaaacaagatagaaaaacttaaggcagctgatggcaatgtttactcaaatcaggaaaccatgggtaccatggcaacaaattatttcaaagagttatttactaaagatccaaatctggtgccggctaatgtggcaaacttgttcgccccgcaagtttcttcagcaacaaatgaagccctgtgtgcagatttttctgaggaagaaatatcaacagctctgtttcagattgggccaattaaggcaccagggccggatggctttccggcaagattttttcaaaggaattggggactcttcaaggacaacattgtccaggctgtaaaaaagttccttgatacaggtcaaatgccagaaggagttaatcatactaccatagtgctaataccgaaggtggatcaaccagttgaaatgaaggattttagaccaatcagcttatgcaacgttttatacaagattgtctcaaaatgcttggttaacaggttgagacctctgctgggtgatattatctcgcctaaccagagtgcgtttgtccaggggagaatgataacagataatgctttgatagcctttgagtgcatacatcatatacaacaagtgaagagaccagacaactccttttgtgcttacaagctagatttatctaaggccaatgatagggtggattggtgtttcttggagcaggctatgcataagataggtttctctaaccggtggattacttggataatggcgtgtgtttcctcggttaggtactctgtaaaattcaatggaaccctattggaagcatttgctccatcgcgtggactgcgacaaggtgatcccctatctccctttctttttctgtttgtggctgatggtttgtctgctttattaaaggaagcggtgcaaaatggtgaaataactcctgtgaaggtatgtcgtagagctccaggcgtgtcacacctcttgtttgctgatgacacacttctctttttcaaagctaactcagatcaagctaacatggtcaagaatgtattagagagctatgcagctagtactggacagctgatcaaccctcaaaagtgctctatcctatttggccatgcatgtccagaagagttacaggaagaagtaaagaatgtcctgcaggttggtaacgttacttttgaagagaagtacctgggcctcccaaccccggaaggacgaatgaaaaaagggaagtatcaacggctgcaagaacgtctgagtaagaaattgatgcaatgggcagagaaccacttgtctcagggtggtaaggaagtcatgatcaaagccatcgctcaggctatcccagtgtacgtcatgggggtcttcaaattaccagatggggtatgtgaagaactaactaagattattcggaacttctggtggggttttgataatggaaagaggaaggtgcactggaaagcgtggtctcaactcaccaaatcgaaaaatgctggtggtttgggatttagagacatgaaagcattcaatcaagctctgctcgcaaggcaagcatggaggttaattgataatcctgtcagcctgtgtgcaagagtgttaaaggccaagtattatccaaatggttgcctaatggacacggttttctcaggtaacgcatcgccgacgtggagagcaatcgaacatggtctggaattactgaaggaaggattggtttggcggataggtaacgggacaagggttcgcatttggagagacccatggattccacgatcgttgtcgaaacatgaattcggcaataataaaagggggtagcgtacgagacctaaaagtggatggatgcggagacaaaggatttagacaggttcaggccctctcaatgagaggtaataccctactcctgtttggggatttgaatccaccgggtgtagtattgatctgacgatcaggttgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacaatcgtcaactcgtaaagtgataaccagccaaggaagatgcagaataaaatgggtggcagatctgttggatgcaaacacaaactggaatgagcaattagttagacaaatctttcttccaatggatgcggatgctattctgtccattcgcacatcacgccaaggggaagatgatttcttggcatggcacctggagaaatctggtatttttacagttaaaactgcctaccgtttagccattgaaaataagctgaattccgaaaatagcaatgcttctggcagttcaattgaggggagtaaaagcttatggaatacaatatggtcttgtccggttcctccgaaggtacgtatttttgcttggcgagttgcttctgactgtttgg

SEQ ID NO: 28233 - DNA, 2798 bp, Oryza sativa
  unsure (1)..(2798): unsure at all n locations
nnnnnnnnnnnnnnnnnnnnnnnnnnnnnnnnnnnnncaccgactagatgcacctaataggtgtagcccccgacaatgtggttaattgaacaaaccaagcatgtagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattcttcatcgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacactcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagaattgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaattttgtcaaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcctgaatattggagagccacttgttgtagtaaaataacacggcatcgcatgccgagatgtcgaggttcacaaagacgtcgtggttggtgaagtagcaaaacttgcgaagtagcagcaatagagtttgccagtgacgaagataataaagatgaagtcgctccaccatgatgacaaagttgcatcgccgtgatgaagtgaacacgagtcggcggcaacagaagcaaactggtagcgaagacgcgcagttgtgaagataaaagcaccagtcggcggcggcataaccagtcggcaacggaagacgatgatgtccatcagtagtggtagctgtctaaaccagacgtagaggtgagggcactagtcagcagcagatgtagacagcttgcgttgaagatgatgatgcttattagcggtgatggtgatgtagccagccgtgaagaagatagcatcagttggcgtcataacaggccagccgttcaggcggtgacaccagtcggcggcggacgaggcggccggtcggtgatagcgtagacgcccaacaacggcagcataataggccagccgtgcaggcggaaacaccagtcggcggcggtcgaggcggccggtcggtgaagacgtagacgcccaacaacggcggcataataagtcagccgtgcaggcggaaacaccagtcggcggcagtcgaggcggccggtcggtgaagacgtagacgcccaacaacggcggcataaagaccagccgtgcaggcggaaacaccagtcggcggcggacaaggcaagccggtcggtgaagacgtaaacgcccaacaacggcggcataaaggccagccgtgcaggcggaaacaccagt

SEQ ID NO: 28234 - DNA, 3044 bp, Oryza sativa
gcggccggtcggttaaaacgtaaacgcccaccacggtcggaataataagtcaaccgtgcagcggaaagcaccagtcggcggcgaaaaagcaagccggtcggtgaagacgtagacgcccaacaacgtcggcataaaggccagccgttcaggcggtgacaccagtcggcggcggacgaggcggccggtcggtaaagcgtagacgcccaacaacggcggcataataggccagccgtgcaggcggaaacaccagtcggcggcggacgaggcggccggtcggtgaagacgtagacgcccaacaacagcggcataataggccagccgtgcaggcggaaacaccagtcggcggcggtcgaggcagccggtcggtgaagacgtagacgcccaacaacggcggcataataagtcagccgtgcaggcggaagcaccagtcggcggcggacgaggcagccggtcggtgaagacgtagacgcccaacaacggcggcataataggccagccgtgcaggcggaaacaccagtcggcggcggtcgaggcggccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctagatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggtctaggcatttcccaaacatgcatatgattgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacgcccaacagcggcggcataatagaccagccgtgcaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcgacgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagacgtagatgcccatcagcggtggtgtgatagaccgtccgtataggcggaggcaccagtcggcggcgacggaggcaggccggtggtgaagtcgtagacgcccaacagcggcggcttaataggccagccatgcaaacggaaacaccagtcggcaagagtagtgccgcggcgttacatgcaaacagcagaaaataccaagagagattaatctgacatttagagatcaatctaataaacaacaataagttgaaaaggaaaaaacccggcgaagtcagagattaaaaggaaaaaactcgccgagattgatctcttcgactgactctgagacggagcggaggaggcggaggtcgcagtcgcgggcggcgttggtgtccatcagcacgacgcaggacggcaggaaggcatcggcgtggctgcagccatctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcaaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaagggggtagcgtacgagacctaaaagtggatggatgcggagacaaaggatttagacaggttcaggcccacacaatgagaggtaataccctactcctgtttggggatttgaatccaccgggtgtagtattgatctgacgatcaggttgtgtcatgccccctagagggcctcctgcccaccttatatagggtggggggcaggattacaagatagaaaccttaaccaatacggtatcggtttcctaaatctac

SEQ ID NO: 28235 - DNA, 8648 bp, Oryza sativa
agggctctatgggcagcatagcgcgaggtgtggcagataccggaccagacaaccaggacatatcaaggtacgaaatggctgctgcttacacttgttaaattatctgaaatggaacgaatgttcattctaatgttgttgtggcgtatttggcatgtacgtaatgaggtggttcatgataaacggcctgccccgattgaggtctccaagcgattccttgtaagctatgtggactctctactgggaatacgtcaacacccaacaaaggatatacacaaaggtaagggagtcatctgctaccagctgcggaattcatcaagacaaggtggttcagagagatcgcaggggacagacgaggcttgggtgaggcctccaccaggctggtctaagctgaatgttgatggttccttcaataacagcagcggccaagcaggcatagggatgatcctcaggaattcagaaggagaagccatctttacaggccgccaggctatagcaaattgtgttgatgctttggaatcagaactactggcctgtaaatttggtctggatttggctctacattggtcgattctgccaatcatccttgagactgacagtatcctggctgtctccgcgattaatggaaaaactgaggataaatcaaggtttgcttacttgatacgtgagctgcgtttgctccagaaaggagaaagggaagtgaaagttcagaaagtgcatcgagatcataataaaattagccatgttctggcaaatagtgctcgagtagcaaataggtcagacttctggtttggccacgagagcaactgtgtctctgcactcattctggaagattgtaatcactcttctatagattaatgaatccccttttccccgcaaaaaaaatattttacgtacttctgaccaaatttaggtagcttcctttgtttaatttgtcatggactttttatcttgtatttcaataattcattgtctgaatttcagctgttttctaatttgtgggtttgttcggttgcctgatacatgcatgcagtgctacatgaccaccagttatagcgaacgaactaatcacggcctacgggccagggcatcgttgtaaccaacggccgaacatgctagtgtatgtattttgacatggtctcttcagtattaatctagaccattttaatttgaacatgccgcacaaccaataacttttttttcattttctttgaaatgcataataatttatacccctttgagaacaagtttgaactttgaaggcttattcacaccgtgataatatatgaatatgaatatgaatataatagctaaaagtaggaaacgagcaccttccaccctctatataaagacaggcaagaggtaccacgcaatcgaagatcaataggaggaatttgtcaatttgggtccaggaaaacgagagtagttcatagtcatttcttttttgcatattcacatttttttcgaaactcatattcatcgatattatagcacccatgaacacttctaggttttttatacggcaatttggtaatctcctatgagatatctacaaaattctggtataactggttttcttctcacacgagaaaaaaagcactccacattctagttagatggcttaacttaaactatttcaacttcgggtgaactgtgcatatgtttagttaacgagtgattttttttttggccgaggaaactgtttggtagagctcaaactgctaaatttagtttcaggagttgagttagttgtggagttgtggagctgcctaaactgggcctatttggcacaactccagctctagctgcacccctcctactccaactgcacccctcctggagctagagctcagctaaacagtttcagctccacaaaaaatgggaatagagctgggtttaggtagctccacaactccattccagacccaactcctagagctaaatttaggagttggagctgtaccaaacaagccctcagctccacctctctagttcattttgtgatagcgctccacctagctccgctatcattttaggtggagctgaaactgtttggctaggttccaactccagtagaggtggagctggagctgtgccaaacaagcacagaaaacatgagagaacatacaattctcaattctttctggttaaatgtttcgacaatataaacacagcactctcatctagtgacatgttgcatgtagtattaggaaaagacatgcacaggggcgacatccaaacagatgagaaaaatcaaaggggtgaaaactcagtgatttactacggtacaccgtacaacaggcttcacaactggcaccatatgacgccacggcctttactgatttagcataccagcatggtggaaggactcatgagaaaagtatccaagtctcaaaacgaaagcatgttctagtttacagcagtaacacgactatggcaccaacgacgggggaaagagaaaaacggcaatacagtctcatacagaatgcaacacatttgcttccaggaaaagaatgacaagaaaatggttgaccatcgccaacgggaaggaattgtaggcagaggagctgtagcaaattaacgccttttcgctcctggggattgcagtaaccggcctgtgtttctcagagggctcgcgacttgacgatgtccatgctcatctcactcgggtcagtggcctgcagctccacctggatgccgtccagctccctcttgaaccgatccttggagctagcatacagcatcttgctcctcacccttgatgtatcaggagccctgcagagagtaagatgcacaaacacattgcctcagtgttacaattgaaatagcattatatagttctgttacattgggcgtttgacaagctgatggatataaacatgttttatgatgcttacagttaataatctaactgtcatgatttattcattattcaaataaagaagaaactggtagtgccaaacagcttgcagtgtttagagacataatcctgagatatgttgattaattcctgaagttatcgatccacaaatccaacatatgggaaaaagatcaattcagtgtctgtcaggctgttatctgtaattgtaatataaggttgctttacatttttttggcaaggaattcaattttctttacatgctaatatcagtttcttaagatccatggcttgggtgaacagtgaaacaatgggcacaaaagagctttagcagaaatgaccaaaagcagcattgttcctttagattattggcactgttcattgtctcactgacctcatttccctatcaaaattgttccttaccgtaaaagtagataatatgtctaataatcactagtggcagtgaggcattctcataaaaaagaacattttaagtacaggtagcgaagacattagtgctgataacaattttgataagcaaagagatgcctgatatcaaagtgtctaattttagatctatgatgctatttttagctaaaaattgataggctaataattatgcctctttcttgttcctgtttcaacctaatctaagctaattttacacttttgtaaaatagaaactatgaaatatatttctgcgtttccctttgataatgaatttgaagtgctaatgtgcttttgaacaagtgacaaaagtgcagttaacccatcctataaaaaagtgtttcgttacacctggtaagtctgaagatcgaagggaacaccaaactgcaataatctaacgtaagcaggcaattgctcacaaacaactcaatccaaattgagacttttaggtcagtaactgccacacgtaagatcgaaacaaaaccaaacataaaaaatatgctatgtaaatagaaatttacatgttgatgaaatcaacaagaatatgacactatgttgacaggggaattgttaccaggagatgaagaatatcttgctcttctggcagttttcatcagtgacaaagtcaaaatcaaataccgcgtagcggcactcatctgctggtaagcaggcagtgaagtcgtcatagctctcacccggctgccccaacctgtccaccaccacctgctggaccttctcattgatcttgaacacgatgaagcggaagctccttttcgccttaagttccaggaacttgagtttgcattcgtcacacacggccattcccgacgccgaattcgacttacatatccccacaacatacaccatttcgttaatggacagatcttgatcaacattctgaacgaaagagattgaactgcactcaccatggttgatgatccttttttttcctcttccttccttctttccttccttactatggtgagaaacagacaggccctgcaaggaggagagaggagggaatgtgccaaaacgcgagcaggagcaagatttgaaggcctgaaagagaggaaggaggaggcaaaatatagggagggaagggctggcggtggagatggaggcttgcatgatgccaccacgttcggagaggagcatttgaccaagcacgtcccctccttggtgtgtgagaaccagaagcgttgtgtgcaaccaacatgcgcgccaccacccatcgctatagcagctccccttgcatagaaaaatcatttgtggcatcaaaacaacatggcgtgagtttgatacgtttcccgtttttttaatggtgcaggtactcaggtactccacgtctctagtttctttggtttgattccaccagtaagatccacatgtaatcttctctattgtaagggaagactatttattaattccagggcaacaattagttttttttcttaaaattttagtcaattttccaactgatagaatctgcataaaagatgaagtgctttgatctatctcatataagtacaaaacttacattctatggcattgctgttcggcattgtacagatcttgcctcaaccaaactagatcctggttcttttaggaggcccctttccaccatcattctccggacatcctgaacatccctccatctgtcagctgcagcatatatgttaccaagcagcacgtaactcccagtgttctccggatcaagctgaaataatcgctttgccgcaacctccccaaactcgacattcttgtgtagaacacaggcaccaagcagagcaccccataccgaggtgctcggctcgaatggcatatcttggatgagacgatgagcctcctcaatcctcccagcacggccaagcatgtcaaccaggcacgagtagtgctcgccatttggcatcaaaccatggacgttgcgcatgtccttgaacaccttaatgccttcgtctatcatgccggcgtggctgcatgcatacagcaaagtggcgatggtcacagtattcggcttccctcctgactccaccatcctgtcgtagagcaggatggcagttcgggcgtgaccatgtataccgtacccggcgatgatcgttgtccaggcaacaacgtccttctcaggtagccactggaagagagcccacgcagcatccaagtcaccagccttagaatagacatcaatcaaaccagtggcgatctctgtgcttctgaggaatccgagagtcagtaagaaacagtgaatgttcttcccttctttcaggtctgcagattctgcataggccggcaggatgcttgccattgttgcagagtctgggcgcaccgattcagcaatcatccgcttgaacaattctatagctttcttctcccgtccactgacggtataaccagacaaggctgcattccatgtttctgcacgccatgagcccctctcaagtgttaatctcatcagcttcatcttaccgcacctcgcataagcgtcgataagcgcagtttcaacagcaatgtctgatttaaggccaagtctaatgcagagtgcatgtgtgcacttggcatgcttccctgacggcatgctggcgcatgctgagagcagatacaccattgtcactccattgggccatgctgccccagacatcagcatctgacaaccaagagaaatggcctcaaaagcacggtcgttcagcacataagcgccaatcatcgctgtccaagaaacaacatctttatcatgtttgcagtgatcaaacacccttcgtgcatcctccaagctcctacacttcccgtacatgtcgatcaatgcgttcttcactgcaacataatcccccaagcctttgtcctcaacaagccggtgcacggctctcccagtgttcaagtccttggcttgcgcacaagctggcagcactgacacaaccgtggcacggtcgatcccgacaccatcagcggccatctcgccgaacacttccagcgccctctccgcgtagccgttcttgacgcacccggcgatgaccgcattccaggacacgactgtccggttccgcatcgccccgaacaccgcctccgctgcgcccacgtcgccgcagctcatgtacatggaaatgagggcgttctgcacgtacgtgtcgccgccgaaaccagcggcgagcgcgcggcagtgcacggcacgcccatggcggccgagacgaaggccggcgcaggccttcgcggcgaaggggaaggtgaggtggtcgaaggcgcgcatcgccgagtaaaccgcgagggcctcccggtggcagccgaggccggtgtacgaacggagcagtgagttggagaaagaaaccggtggtggttggggcatttgcgcgagcaggtttgtgggcgctggagggacggccacatgcgcaatacaccatgaagagcggatggaggccgtgatagcggaggaggtggccggacgtgaggaggagcgcgtggagttgagcggcgacggcgggagcaagcggagccgtgttcttcgagtggaagatggtgacgagcgagcattgccggacaagcggggctgggtttcatccaggaacggagttgagacaaggggatgtttcggcttttgggcagattggcttctttcagcctcggtctctctcggggatagttcgattttgaacttttgggagaaaaaaaatcagttgcaaacttctaaaaactaatttgaagtttgactgaattttttacatattggtccttttataaagcttattttagacatggatactaaagtaggcagtccaccttgcagggcagtcgtcggaagaagttcgccacaacgtcaggcagcctctgccgcagaatcgggtgccgcatcaggtagaaaccagtcaacagcgccaccgcctggaacggcaccgagaacgtgatcacggcaaggcacaggcagcccagcaggtacaggcccgtggcccgcgggtcccgccacgtcatcacgcaccgcgcgcgctcggcgtgcgtcgcgatgtcgccgacgatctcctgtatccgcgcgttgaggctcctcagcttgtcgtacctcatccgcaccacctcgggcggccgcgccgtcgggaactcgtcgaactcctcgtcgagctcgtcagggtgcgccgtgtcggcgtgggacaccctcatgtcgacgtgccacgggtgcttgggccggcgcaggtagttccgcatgccgagcatgaacttgtacaggaagaaggtgggcagtacgagtctcgggtagcacacgagcatggtgaagatgacgtggaccgcgacggtggtgaccgggttcgtccagcggcagacgtggtagaaccacgcgctcgccgcggacaggggctccagcgcctccgcgaggcggaagaagtgggccttgctgcgccgcatgctccaccgcagcgcgtgcgactcgcagaggtgctcgacgcactcccggcgcagcggcgggtccatccgccccatccggtgcgcgatgatcgtgaccgcctcccgccgcagcatctcctgctgcacgacggtcagcggccggtggtagtgcatcggcggcagatgcggctgcgcgtacgtctggaacaggcccagcgtcgacgtgctggagaaacggacggcgagacgaagctcgcccatcttcttgacgccgccgccgtggagggacataagcgggtaggcgtaggcgtatgtgcggccggtctcgagcgtcgagagccggatccgcaccttgccgaggaggacgtccttgacggggtcgccggccacgaggccgcccttgtcgcctatctgagaattgtggaagacggcgacggtgagcacggtgcagtggtcgtgcacttcccagtggtactgctggtggaaacgcggcgagatgctgtcggtgacggtgcgcgtgcggtaccacttcaccccgtacttggcgacgcagtacgcgtcgcaggagcctcggccatcgcgcgtgcgcgtcgcggtgaggatggcctcgcggatgccgagctcgacgaggccgatgcacttccgctcccgctcctgctcacgcgccgccggccggacgtcgctcaggtagtggaccggctctgacagcaccttgtacccgcattcgaggcaaagaacgacgcttatcttggcagagtacttgtcaatcttggcggctccctctggctgcatcaaactaaacctgtcaaacagcatttgcgtagcagttagctagggacaaattcaatcttgcttgcctaataccaggtactttgtcgttctttgctagtacatgagatggatggacattgggcgtaccatcttgggctgtcgggcgggcgtcacaccggcgttcggagctgtcaag

SEQ ID NO: 28236 - DNA, 1639 bp, Oryza sativa
cctgatcccgaactcattgttcggcggcagcatgccggcggggcgggcataagacctcggcagtacgtcgcccatgtcggcgaacactgccgccggtcgaacgagatatgctgggctggtctggtcacactagctggtcagtgagcaagttgcatttatatatgtgtgttcagcagtctggctggccaccaaccggccgcgcgcgtgacgtcgtgcgtggcgagcgaatgcgtggatttttgggatttggtgatcgacacagtcggggtgtgtgcttgctgacggacgattggtgatccaccagggttagttagagtaagtcccagagcaaacagacatgacatgttgatttacatgacttcagcagattagagaaccgtgtcacggcttcacaggcgtttataccgtttagggaagaaatcaactgatttgagctgatttgcatgaacctctaggttctgggccttgtgttctggcagaataggccatggcaggacaaatgctaacggaataagctcactttaggtccctcgagttgtcgtcgagtctaaagttcgtctctgaaccgcaattccagatagatatatatgacgcgtctcttaactcctaaaattagtgcaaataaggttctaaggtggtttggacatcgtttctcgatgacatgacgttaacgtggcacttaaagctaaaaataatgtaacacccatacatcagtgtttggttaaaaataaaaaaccgcgaccggacccacgtcatcaacccctatttattctcctcttctatctgttcttcatctctttgtccctttcctcaccatcgactcgtcgacagcgcacgcacaatcctgtcagaaaaccacaagtccgcaacgccgccgccgccattgtcatgtccatatccatctctgcgcccacgcctttgtgacgaaacccattacgcagcatctctgcctccattacggtcgtctccccgtcgaccgtgaccaacgctctccgctccctcctcaacgctggtgtcaaaccgggcggccaccccgctcccatgactctcctcatcctcctcctcccgtctcgccttcccccgcgtggctgtggcgccgccacctctatctggcacatcgcgtggctcctacccgcatgcatgccctccttgcagggctccgctgccacacccttatatcatcgtggctagggcttagagtgagatcttgtgatctttttatcttcgggtttgcatctatttagtcttgattaatttataccataattttatgtatttatagttttattcgcatcattttcgaagatatatgatttttagaaatatatattgcaagtaaaaatatattttattttgagggcataggttacgaagctcgtttatggccctctgaaatttagagccggtcctgctcacaagtgcttccttgaaaattcctcagccctgtaaaatcttgccaatgaaccatccagctcacatttgcatgataataatcgttgatgaatttggcatgtggcaacatcaaaaaagaaaaatcatagttgcatctgcatcatcagagcagaatatgttagtgagtagtgttctgttttttcacaaatagtgagtagtgtacttacgtggtgtttgggaaggaggg

SEQ ID NO: 28237 - DNA, 2332 bp, Oryza sativa
  unsure (1)..(2332): unsure at all n locations
aaaatttggacacccctttcccctctggtgatttggtcccctttcagcagcgagagactgaagctttatacccataccccatacccctctgggggaaagtatttgcacatcgatgcctccgtgatgctgctacgattcggcccttttgggacttcttaagccaatatctttttggttttagctgcagatttttttacccaaatctttggaggttttctacaagctgttatactgcttgaattgtgatcctaatgtttaaaggactatgctttttggtgtttgcaggatgcaagtggcaaagatgtggacctgagcaccttcaaggggaaagtcctccttatcgtcaatgttgcatctcagtggtaccaattattaccaatccctcacctccacagtgtctacgttttaattttgtaaacttggaaattattctagaatgcataatgtgatttatctttttcatgttgaaatgttccatgaacaacgaaaccttggaaccctagtactgcgttatcaagcgcttaagttgaatgatatgctcatttgatgcctaatataatgtatattttcgatcaaacttccattcatgttgcaaagtaaagatgccgaatttatatggtttcatatggaacacattcgagtttctatctaggccatatgagacaaatcgaaatttgaagtattgttctgctaaatgaaactttaaaaagagccatggtagtgtttgtcccggaggatcagcctttgcatgtagattatcgatatatggaaaaaataataatctggtcagcaggtaagttggttttagctggacaacaggatgttgatctcttgccaattggaaagtttgtgcagattgtcataccattaactatttttctatttgcgtctcatcctccttgtgttaagggatacatgttctttagaggacggccattttttttttactaattttaaagaccaatgagatgcagatataataaaataacatacaaactgatatcattatcctcaaattaagaaatcttgttgctctctgtcattgttgcagtggcttgaccaattccaactacacggagctgagccagttgtatgagaagtacaaggaccagggtgagtgttagatgcatctcatcatttgttccctcattatgaaatctctcttgtgcgctgaattgctcatatgttctttcatttggagtttatgaccaaccaattgctaatgtcattgtcaatttgatttgacgacaggttttgagatccttgctttcccatgcaaccagtttggtggacaggaacctggcactaatgaggagattgtccaatttgcttgcacccgcttcaaggccgagtatccaatttttgataaggtaaatttgggcacattataccactacctcttgcatttttgcactttttttttcatttatctttcaagcggaaagaaacaactaactcaagtatatgttcaccttccagagccgtcataatattttaaaggaaattaatcccattccgaaagtgttccctttcatatgtagcctgtgatgtatttccagatacttgtctagtacttaaaaggaaattgatcaagtccatgaagtttttatccgattcttatgcatttcgtatgatgtatgcgatcgataagcctgataccagttttatcctttcatttatcacaagaaagaatcatggatgtttataatgtgatgatcaattgatttttattgtttagagaggtgagatctagaagttctaactaccattatcttaataggttgatgttaatggtgacaacactgcacccatctacaagtttctgaagtccagcaaaggtggtcttttcggtgacaatatcaaatggaacttctccaagttcttggtcgacaaagaggggcgtgttgtggagcgctatgcgccaactacttctccactcagcatggaggtaaatcccgagctccaagtgggtgtaatttgagttccatctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28238 - DNA, 1202 bp, Oryza sativa
  unsure (1)..(1202): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataactaggggcgtaaaaaagacgacgctacgctacagtacagagccgagattgaaaacgatagagggagagagagggggagggaccccccccttctttttaaaccttttttatgttgcacgcatccagggagaggattggcagtggagagagagagagagagagagagagagagagagagagaggtgtccatagcaagcagagcaggagcagagccaactgcacaaggcaaggcagggggcctctcctcgctgttctactgctgctatactctggcatcgcgtcgcgcgcgcaagcaaaagggtagttcctcaatcaaacgctccaagagaaatcaccccgccacgccacgccgcgccgggctgggctgctgctcccagatctcgccgagcggggcgctcgattatgtgggattaggtagatgagggcggcgctgttcggtgccgagaggagcggggtagtggaccacggcggcggcgataaggaggagctgttttggccggcggggaagggggggctggtggtggtggagccgatgtcggtgctggactgcacgcgcagcccgagcccgccgtattccacgtcgacgctgtcgtcgtccctgggcggcggcctcgcggactcgaccggtgtggcggcggtttcggagagcagcaccgccgccgccggagccaccaaatggggagccccaggcgagcatggtgacggcggaaagaaggagtggaaagacgggtgcgagttgcccccgatacctggagcactgaatgtggggctcgtcgggggcgaggctggacgccacggccacgctcgcaacgcagccgggccggaccagtcgttcttgaactggatcattggggccgccggcgacctggagcagctggtccgcgcttccag

SEQ ID NO: 28239 - DNA, 550 bp, Oryza sativa
  unsure (1)..(550): unsure at all n locations
nnnnnnnnnnnnnnnnnnnnnnnnnnnnnnnnnnnnntcgccatcctagttctgcgtggtgaaagtgaacctgccatataccataaacaagattctgacccatcttggtgctatacggttcagggatttagcagcagtataagtgtttgtattagtcgtggcaggtgtgcgaaacagcgtgccgataaggacgctgtgccgcttgcgtctctgtacaaaatattatctaataagaataagaagttaatcgtgctcccaagaatggtaaatagaaggattccagaacaaaaatgaatatcaacgcgtctgtttcctcagaatcgtagatgatactatataatgataacaaaatacgtatagtatcatcaacgcgtctgtttcctcagaatcgtagatgatactatacgtattttgttatcattatagtttttttttccttagcgaagattaggtcaacaccaccacattagcgaaaccatctttcaaaactatcgagatagtcaaattgcaccggttccaatagttcgggggtcgagatatccgctattgt

SEQ ID NO: 28240 - DNA, 632 bp, Oryza sativa
tgctcggtccccatagcaaaccaaagaaggggaaagggcccgatgagccaagacgccatgttgttctcctaggcaagaggaaaatcgttggagtctaggataatactgacgaaaattacaatctgtttgaggggcaaccttcgtttgcagtgacggttgacccgagcatcatactatcaaaggaggacacgccgtactcacgcaacgatcatagcgaaggaacaatagtgaggagaaagtacctgagtaagacagcgacctaagttgtttgatggaagatgtaaattatttgtattgtattgaaggtcgaacaatttggatcaatatattattcacaactgcttaatttgtaatgtattactatttttcaaccatatgatatttataaatggttactttcatttatttacactttgaataccattaattaagcaatatgttatttataactgaataatgggatttatttccactttgaaaacaattagtagggtattttctaaatataaaagattatttttatttaattacacttttaatataattaaatgggcttatgttaaatataaaagaatatttctaattaattataccttggaaacatttacttaaggcataatcctgtttatttt

SEQ ID NO: 28241 - DNA, 9033 bp, Oryza sativa
  unsure (1)..(9033): unsure at all n locations
gtcgcaaattgggggaattcgtaccaactcggcatttcacgagttatgaaagtgcaagaaaggatactaaatctcgtcgttaactgaattcagaatagaaagattcaaaataaaaaaaaaagaaatacccaatatcttgcttcagcaagatattgggtatttctagctttcctttcttcaaaaattgctatatgttagcagaaaagccttatccattaagagatggaacttcaagagcagctaggtctagagggaagttgtgagcattacgttcgtgcattacttccataccaagattagcacggttgatgatatcagcccaagtattaataacgcgaccttggctatcaactacagattggttgaaattgaatccgtttagattgaaagccatagtactaatacctaaagcagtgaaccaaatccctactacaggccaagcagccaagaagaagtgtaaagaacgagagttgttaaaactagcatattggaagattaatcggccaaaataaccatgagcggccacaatattataagtttcttcctcttgaccaaatctgtaaccctcattagcagattcgttttcagtggtttccctgatcaaactagaggttaccaaggaaccatgcatagcactgaatagggaaccgccgaatacaccagctacacctaacatgtgaaatggatgcataaggatgttatgctctgcctggaatacaatcataaagttgaaagtaccagatattcctaaaggcataccatcagagaacttccttgaccaatagggtaaatcaagaaaacagcagtagcagctgcaacaggagctgaatatgcaacagcaatccaaggacgcatacccagacggaaactcagttcccactcacgacccatataacaagctacaccaagtaagaagtgtagaacaattagctcataaggaccaccattgtataaccactcatcaacagatgcagcttcccaaattgggtaaaagtgcaatccgatcgccgcagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagataatagaaggcttgttatttaacagtataatatagactatataccaatgtcaaccaagccagccccgacagttgtatatccatacaacaaaatttaccaaaccaaaaaattttgtaaatgaagtgagtgaaaaatcaaaactcagattgctcctttctagtttccatatgggttgcccgggactcgaacccggaactagtcggatggagtagataattattccttgttacaatagagaaaaaacctctccccaaatcgtgcttgcatttttcattgcacacgactttccctatgtagaaataggctatttctattccgaagaggaagtctactaatttttttagtagtaagttgattcacttactatttattatagtacagagaacatttcagaatggaaactgtgaaagttttaccttgatcatttatcaatcatttctagtttattagttttgtttaatgattaattaagaggattcaccagatcattgatacggagaatatccaaataccaaatacgctcactgtgcgatccacggaaagaaaagtaagttgttttggcgaacatcaaagaaaaaacttgctcttcttccgtaaaaaattcttctaaaaataccgaacccaaccattgcataaaagctcgtaccgtgcttttatgtttacgagctaaagttctagcgcatgaaagtcgaagtatatactttagtcgatacaaagtcttcttttttgaagatccactgtgataatgaaaaagatttctacatatccgaccaaaccgatcaagaatatcccaatccgataaatcggtccaaattggtttactaataggatgccccgatccagtacaaaattgggcttttgctaaagatccaatgagaggagtaacagggactttggtatcgaattttttcatttgagtatctattagaaatgaattctccagcatttgattccttactaacaaagaatttattggtacacttgaaaagtaccccagaaaatcgaagcaagagttttctaattggtttagatggatcctttgcggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcgttccagaaaggttccggaagaagttaatcgcaagcaagaagattgtttacgaagaaacaacaagaaaaattcatattctgatacataagagttatataggaaccgaaatagtcttttattttcttttttcaaaataaaaatggatttcattgaagtaataaaactattccaattcgagtagtagttgagaaagaatcgcaataaatgcaaggatggaacatcttggatccggtattgaaggagttgaagcaagatatccaaatggataggatagggtatttctatatgtgctagataatgtaagtgcaaaaatttgtcttctaaaaaaggaaatattgaatgaatagatcgtaaattctgaaactttggtatttctttttcttccggacaagactgttctcgtagcgagaatgggatttctacaacgatcgcaaacccctcagatagaatctgagaataaaactcagaataaaaaaaattgttgtaatccaataatcgatcttggttaggatgattaaccaaattaatccaaaaattctgctgatacattcgaatcattaaccgtttcacaagtagtgactaaatttcttgttattagaaccaataatttcgacaagttcggaaccatttaatccataatcatgggcaaacacataaatgtactcctgaaagagtagtgggtagacgaaatattgtctaggaaatttaagtttttctgaataaccctcgaatttttccatttgtatttctacttgaatcagagagagagaaatatttctcggtttatcaaatggtgatacatagtacaatatggtcagaacagggtgttgcattttttaatacaaacccctggggaagaaaaggagtctaatccacggatctttttccgctccttttctatccaatttgtttatgtttgttctaattacaaaagagaacaaatcctttatttttgcaggccaattgctcttttgactttgggatacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataaactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctggttaaatttcactaaggttaaaagtggcaccaatcacgatcgtaaaattgtcatttttttagcatttttatttaaataaataaataaatcttgtatgagagtacaaacaagagggacaaccctaccatttgagcaaagtgtaggcaaaaaacctaatagggagtgaggataaagagacttatccatctacaaattctagatgttcaatggacctttgtcaatggaaatacaatggtaagaaaaaaattagatagaaaaactcaaaaaaataaaggcttatgttggattggcacgacataaatccagtcaaaaataggattaagaaagaggcaaattatttctaaatagttagacaacaagggatactagtgagcctctcctagttttttattcatttagttcttcaattaactcaaagttctttctttttctttaaagaattccgccttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagttgactaattttgattgacagacttgaaagaaaaaaatcctttgaaattttttgagtcgtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggacgaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaagactccgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcattctggatatttaaaaaatcgcggatcgagatcgtttttgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcagaaaaaatctgggacggannnnnnnnnnnnnnnnnnnnnnnnnnnnnnnnnnnnnnnnnnnnnnnnnnnnncacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgacccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggagtgcatgaactacttg

SEQ ID NO: 28242 - DNA, 7855 bp, Oryza sativa
  unsure (1)..(7855): unsure at all n locations
gttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgctttaacccaactcaagctgaagaaacttattcaatggtcaccgctaatcgcttttggtcccaaatctttggtgttgctttttccaataaaacgtggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactataccggttttcaagaccggagctatcaaccactcagccatctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaa

SEQ ID NO: 28243 - DNA, 9983 bp, Oryza sativa
tatataatttcttgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctggagacgtttccgcctatattcctactaatgtaatctccattacagatggacaaatatt
